United States Patent 6,783,961 (EXPRESSED SEQUENCE TAGS AND ENCODED HUMAN PROTEINS) - sequence listing, part 3

SEQ ID NO: 12562 - DNA, 390 bp, Homo sapiens
  misc_feature 333: y=c or t
gtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttyttttaaccttgaactctctcagatggccgctccagctttcgaacctggcaggcagtc

SEQ ID NO: 12563 - DNA, 398 bp, Homo sapiens
  misc_feature 387: r=a or g
agtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggtttttttgcatttctgagcctgctttgtattcatgagaarcaaaaacataa

SEQ ID NO: 12564 - DNA, 91 bp, Homo sapiens
ggagtctcctatttgattaggatggagatgaagattcccttgtttcacatttttatactaaccctattgccaaacctattcctcaaacccc

SEQ ID NO: 12565 - DNA, 315 bp, Homo sapiens
cagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaatctgacctttacatgatttaatctgaagggctagaattttttaatttctagcccctcctccaaaaaaattttaacac

SEQ ID NO: 12566 - DNA, 311 bp, Homo sapiens
taatattgaaagattttgtactatatattttaattgaatgaatctacacataatctctgtatctttgtgccaacagatgaccttcttgatttcttaaaaatcactactctctaattgtaaatttagtaagtagttgtgaaacctcaacaaagttaagacacagtgtgtgaggtaattcttgcttttcacaaagctttgcctatagaattacaggatttcagatgtcagagttaggggagaccttaccagggaacaaaggaggagtcaatgctgaatcctccatacagattcattgccaagtgctcttctgc

SEQ ID NO: 12567 - DNA, 450 bp, Homo sapiens
  misc_feature 142: m=a or c
  misc_feature 216: n=a, g, c or t
ttgaattccagcctggccaacccttgcagccatgtcttggcctcaagtggaacaagggctccttgaggccagcagggttgggggagttggggtgggcctgagcctctttcctgctagagctcttggtcctccctgcctccamcacccatcctgctctgcagaacccctgggtgctgagtggcaggagccccagggttgtcccatctgggtatggcnggctgggtcactaacctctggatctgcttccttcctttccagattatgcggatcaaacctcaccaaggccagcacataggagagatgagcttcctacagcacaacaaacgtgaatgcagaccaaagaaagatagagcaagacaagaaaaatgtgacaagccgaggcggtgagcgggcaggaggaaggagcctccctcagggtttcgggaaccagatctctcaccaggaaagact

SEQ ID NO: 12568 - DNA, 468 bp, Homo sapiens
  misc_feature 356: s=g or c
  misc_feature 362: w=a or t
gccagatttttgtgtgtggaaagacagttttctatccacgtctttttctgtttgtcagaaggtgggagtatggtccaaataaatccattaggttactcctgcagcatgcgcttttagcttctctcttgcactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatstatttwtctttgacatcctagtttgcgtcagtgacagaacttactgcttagtctttgtactttttaaaaaatctataaatttaatgcactgtccaagtgaaatgtcctagtt

SEQ ID NO: 12569 - DNA, 401 bp, Homo sapiens
  misc_feature 183: n=a, g, c or t
  misc_feature 345: y=c or t
  misc_feature 390: m=a or c
tggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgcactctccttgaggcgccggttgccggccacaacccttggcgganctgcctgcaggcctcccgaggagcccagacagctgcagccacagctccccgtatcaagaaatttgccatctatcgatgggacccagacaaggctggagacaaacctcatatgcagacttatgaagttgaccttaataagtgagtatctctgtgaaagccatytattgaaggagagttcttgatttgatttagggacatgcttttcamatccttggaag

SEQ ID NO: 12570 - DNA, 227 bp, Homo sapiens
atagaccattgtaaggacttgggttttcaaaaaatctgactgagatgggaagcgattggaaggttttgagcagaggagtagcatgatgtgattgagatatccctgactactgtgctgggagtggattgagggggcgtgggagcggccttgatgaggaaggattggctgggggctaacagagtgcagggaagaggctggattctgcatatgttgaaattgtggcaaag

SEQ ID NO: 12571 - DNA, 114 bp, Homo sapiens
agatttccatatcaccccaaatgatggtgaccctctccacataatgcattacaacagaacattcttgaatcacccaaccctggatcagaaacctccccattaacaaacactgcc

SEQ ID NO: 12572 - DNA, 497 bp, Homo sapiens
ctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcacccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggc

SEQ ID NO: 12573 - DNA, 97 bp, Homo sapiens
acaggatctagaacaagctgtccccacaaacctctaggctctggtgttgaacctgtcactgagccagactctctcttcttgggagacctcagtcaga

SEQ ID NO: 12574 - DNA, 194 bp, Homo sapiens
tttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaa

SEQ ID NO: 12575 - DNA, 293 bp, Homo sapiens
  misc_feature 127: n=a, g, c or t
  misc_feature 248: r=a or g
agggccagagcttgcggggcgcacagagcccccaggcctcatggcgcagaaacctctcagcaccgcggcggctgaacgcatgaaccttgtgggtcaggatgagatctggaaataccgtctgaaaggntgaatcggaagcacggcagaactggccccagaactgggggtttttaacaaccccttttgaggagttgatcaagtgtgaagaagatctccccaccccaaagcccaaaatcgagcttcctgarcgtttccgcatccggccggtgaccccagtggagaagtacatcaag

SEQ ID NO: 12576 - DNA, 126 bp, Homo sapiens
ggcctgttccttctctctgaacccctcacctgcctttgcccccacaggacactctgagcactttcaggacgcctttgagggttcctcctgggacatgggaaacctctctcttgccctctactctgc

SEQ ID NO: 12577 - DNA, 139 bp, Homo sapiens
ctgtgttaaatttctttgcctctttttttagccatcccatcagatgatgcttagaagtatccagagttggcatcaactgaggtggtttcaacactgcccgcgccctgcaggcctaaacctctggatgcccagttcccac

SEQ ID NO: 12578 - DNA, 502 bp, Homo sapiens
  misc_feature 359: n=a, g, c or t
  misc_feature 423: r=a or g
  misc_feature 447: r=a or g
  misc_feature 465: r=a or g
  misc_feature 477: r=a or g
ttttgtttctacaaaataaatctagttttgtgattggagtgttgcttttctggctggaaacctctgtggccagtggtgcctttgcccaagttttggtcttgcacccagggagaatgaggtaggcagacaagtggagggtgagcaagatgaagagaaggtttattgcatgttagaacagctcggaggagacctgcagtagggtagctcctctctgtaggcaggttgtctcattgagtcttcagctctcagcagagaggaggccctggaatgggtggctcctctctgtaggcaagtcatcccagtgagtgttcagctctcaggagagagggtaggtcttctctgcagctggtcatttggcnacttccactctcagcagtcaggaggccctgaagaggatagctcctctctgcagctggtcatccrgtagtctgcagctctcaacagaarggaggcctggagaaggtrctcctttctgcrctgttcatcccaacatctgttctgc

SEQ ID NO: 12579 - DNA, 170 bp, Homo sapiens
atttgcttatctgtttcttctctctttgaaaggtggtgattccctgcggtgtgcaagtccgactggaacaggctccagggagttccacgctgtccagttctctctgccgtgataaacctctgtggcccgtcatcctgagtcccaccatggaggagggccatgggctggac

SEQ ID NO: 12580 - DNA, 287 bp, Homo sapiens
  misc_feature 160: k=g or t
cttccatgcctgtaaatctcctgttcatctttcagcatctaactcacattatcatctctacctggaggccatctcagaaacctcttcctctgtgccttccctcataccaaggacatatctccattgtgcatatcacactatattaacatattcgtctgtktccttactcaaccatgagttctttgagagcagtgtctgacatatagctcaataagtgttttattaatgtcattttgaatagcagtgatcagtttatttctccccagccacttccccctcctacccga

SEQ ID NO: 12581 - DNA, 198 bp, Homo sapiens
ttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgc

SEQ ID NO: 12582 - DNA, 177 bp, Homo sapiens
atttcttccaacgaaacctgaataaccagctatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgca

SEQ ID NO: 12583 - DNA, 460 bp, Homo sapiens
  misc_feature 283: m=a or c
  misc_feature 293: w=a or t
  misc_feature 294: w=a or t
  misc_feature 297: w=a or t
  misc_feature 329: w=a or t
  misc_feature 332: n=a, g, c or t
  misc_feature 333: n=a, g, c or t
  misc_feature 348: m=a or c
  misc_feature 369: w=a or t
  misc_feature 392: n=a, g, c or t
  misc_feature 395: n=a, g, c or t
  misc_feature 434: m=a or c
aattgttgtatattagtcatctctcaaaaagaatttttaattgctgataccaaatatattggttttctctaatattattaaggggcataggggaagtagagggatgggatgggatagcattgaatctcatcaatatgtgtacttttactttcttttgtaacagccaccaaaaaagacagccaaaagagaaaaacctaaacagaaagctacttctaaaagtaaaaaatctgtgaaaagtgccaatgttaaaaaagcagatagcagcaccaccaagaagaatcamaacagttccwwaawaagaaagtgagttctgaggatagttcagatgwtgnncctttaattaaaaamgttgaagaaaccccctacagwtgaagagttaaaggaaacaatanagnaattactggccagtgctaacttggaagaagtcacaatgmaacagatttgcaaaaaggtctatgaa

SEQ ID NO: 12584 - DNA, 632 bp, Homo sapiens
tctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccc

SEQ ID NO: 12585 - DNA, 546 bp, Homo sapiens
  misc_feature 493: r=a or g
  misc_feature 494: r=a or g
  misc_feature 521: r=a or g
tctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggcctgaattcccctggctttrrgagggcacagatgtgggcaaggtgaargcagcccacgctctagcaaagatcg

SEQ ID NO: 12586 - DNA, 222 bp, Homo sapiens
  misc_feature 219: s=g or c
cagtttgaaccaaagacgcccaaggttgaggccgagttccagagcatggggtctcggttgtcccagccttttgagtcctatatcactgcgcctcccggcattgccacctggggtatcgttgtcatggcagaccccaaagggaaggcctaccgcgttgtttgaaagtaccaccagtgaatctgtcttctgtctctgtccctttccccgtgacacacagascag

SEQ ID NO: 12587 - DNA, 365 bp, Homo sapiens
  misc_feature 260: y=c or t
aacagagactgcgcagggggcctgagcgggagagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagayactggattctcctagttaagataaagagctttgggtgcctgacagtgaaaatggtgtaatctgcgttaacagttcacagcttgaaggcatgacaattaaagagca

SEQ ID NO: 12588 - DNA, 200 bp, Homo sapiens
  misc_feature 150: m=a or c
  misc_feature 151: w=a or t
gaggtaggtcttatttttttaaaacccaatttgccactctatctcttttaagtggagtgctgaggccatttccattcaaggtttttattggtatgtgagggtttgttcctatcatggtgtttggattgcatttggcaacccaaggaaccmwttgcttaaacctggaacatctcacctttttaaatcctaaaaaacactgg

SEQ ID NO: 12589 - DNA, 430 bp, Homo sapiens
agcgtttgggtcaagatgaaggcgggttctggacagacgtaaccagtcagggaatgtttactttgcctccacttctgttcctccccgccctggtgctgctccgggtcacatactcgtcctgagccggcttcagcctctccgcgcagaagtctcccggagccgacttctgagagtcgagtactcctatgtgaagactaccaagctcgtgttcaagggaaccaaggcgaagagtaagaagaaaaagaacaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagtt

SEQ ID NO: 12590 - DNA, 368 bp, Homo sapiens
  misc_feature 16: n=a, g, c or t
aaacaaccctgcggcnggcactgagtgcttcgcagctgtctgggcgagaggcacagcgatgggctccgtgctgagcaccgacagcggcaaatcggcgcccgcctctgccaccgcgcgggccctggagcgcaggagggaaccggagttgcccgtcacgtccttcgactgcgccgtgtgccttgaggtgttacaccagcctgtccggacccgctgtggccacgtgtaagttccaggggagctcggtttgcgcccacccctaaggagggcgatgtggggaagctgagggcatggtgtggggaaggagggggacggaagacagcctcttaggaaattgctgcagggagaaacctggacccgtcggatgcagg

SEQ ID NO: 12591 - DNA, 118 bp, Homo sapiens
attccattcctgagttacttcacttagaataatggtctccagctctatccagggaaaaccaagacccagacctggagacctgaatgagatttttcgaattggctatgagcactgggcc

SEQ ID NO: 12592 - DNA, 415 bp, Homo sapiens
  misc_feature 363: y=c or t
attagacccggtccaattgctggggctgcagcgctgcctccgagaccgcgaggtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgyctcagacatctacgcagcgaaatcgagcctggccttgagggtccacaccgcg

SEQ ID NO: 12593 - DNA, 216 bp, Homo sapiens
ttaaatagattgtttcataacattatgaacttacatctatacaccacacattatatactattacatctaaattggctcactcagcactgaatttggctcttcagagagatcttgtaattcccagtacctagcttagagcctagttagagtagctagtaaaagctcaatgagggagttttaaaaaatcttctcttagtgccctgtggatacttcaag

SEQ ID NO: 12594 - DNA, 480 bp, Homo sapiens
  misc_feature 230: s=g or c
  misc_feature 368: s=g or c
  misc_feature 386: m=a or c
aatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggsacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagstggccagatggatacgamtccaagttccccaaccgcctcaacctggaggccatcaactacatggcagctgacggtgacttcaagatcaaatgtgtggcctttgactgaaatc

SEQ ID NO: 12595 - DNA, 363 bp, Homo sapiens
  misc_feature 187: r=a or g
  misc_feature 338: n=a, g, c or t
  misc_feature 339: n=a, g, c or t
gttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccargagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcnnggcccctctgggctcctccctccc

SEQ ID NO: 12596 - DNA, 140 bp, Homo sapiens
  misc_feature 129: r=a or g
aggaaggggtggtgtagggccgggcgataatggcggcgtcgaggctggagctaaacctggtgcggctgctatcccgctgcgaggcgatggcagcggagaaacgggacccggacgagtggcgcctggagragtacgtagga

SEQ ID NO: 12597 - DNA, 210 bp, Homo sapiens
agaggaggggcgccggtggggagatgcgctcccaggtgtttgcagcggaagtgggaaacctgtagggtatggtccagctgtgccgcaccgaggcgagcaggagcagggaacagccatgtgacaaatctgcagcccctttgccatgattaaaggtctcctgaggccctgaccagaagcaaacgctagtgccaggcttcttgtacagcccgc

SEQ ID NO: 12598 - DNA, 207 bp, Homo sapiens
  misc_feature 196: s=g or c
aggcgtattgtggtataactgttgctgtatttattcaaatggacaatttgcaatagatattatacccaggacgacagataagtcaacacataagtagagacggggtttcaccgtgttagccaagatggtctcgatctcctgacttcgtgatccgcccgcctcgacctcccaaagtgctgggattacaggcgtgagsaccgtgcccgg

SEQ ID NO: 12599 - DNA, 161 bp, Homo sapiens
cagagtaggaactttctagaggtttaaacctgtgagcatagtggaacatggtaggcactcagtgtatagttgttgaatgaatgaatgcatgaactcacttttatatgtcaatcccatttagcattttgatgaaagatgtgggttcagatcatattgtatag

SEQ ID NO: 12600 - DNA, 322 bp, Homo sapiens
  misc_feature 23: s=g or c
agagcggtggcggcggctgcgcsggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcatgaccccatgcccaaccgaggcggcaatggactagctcctggggaggacagattcaaacctgtggtaccatggcctcatgttgaaggagtagaagtggacttagagtctattagaagaataaacaagg

SEQ ID NO: 12601 - DNA, 281 bp, Homo sapiens
  misc_feature 10: k=g or t
ctctctccgkacccggaggccgcccggcagaggcaaaggttgctggataccggtgcggtcctgcctcgggcgacattcgcgcacgcacacgaacttccagccccgacattttcgcgggaaacctgtgtctgtcttgagctggccagctaaactatgtggacccagctactggctatgtggtgctcacacagattgcccacttgcaaagaggtgaatgttgtggctctgcgtgcagacattgtccatatggtcaagtcaatgttaaagatccatctaaaaag

SEQ ID NO: 12602 - DNA, 138 bp, Homo sapiens
agaccgccgtgagagaggaggggcgccggccgggattcgtggcccggagctcgggaccggagtcaggaatggagagaagggtaatggtgttacctcttattgtggaaacctgttgagatcacagagaatatactgacg

SEQ ID NO: 12603 - DNA, 346 bp, Homo sapiens
cactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaac

SEQ ID NO: 12604 - DNA, 495 bp, Homo sapiens
  misc_feature 379: n=a, g, c or t
  misc_feature 408: w=a or t
cctactctttctattgtagtatacttctttaatctattagtattataattaaaatatttagactttattgctttatgtgtgccattttcgaaggcttttcactttcctagaaagagtacatttctagaagtaaaagtgcaaggctatactagcaaagccttactcaagaatcatcagattcagaggctagggaaatactctatgttcctagtttttcatagccacggaaaagaattaagagataatttaatctaccccagtaccatctgttcttatatatggaaatgggacttaaaaaatgacttgtccaagatcatttaatagagtatggtaagcaaagtaacagtccaaatgtgtgatatcttttttttaaattgtntttgtgtaaatttatggggtacagtgcawttttggttacatacatggattgcttagtggtgaagttagagcttttagggtattcatcacatgaataacacacattgtaccattaaa

SEQ ID NO: 12605 - DNA, 396 bp, Homo sapiens
  misc_feature 133: n=a, g, c or t
  misc_feature 396: s=g or c
aagtgagagcggttgcgcagtgaaggctagacccggtttactggaattgctctggcgatcgaggggtcctagtacaccgcaatcatgtctattatgtcctataacggaggggccgtcatggccatgaaggggnaagaactgtgtggccatcgctgcagacaggcgcttcgggatccaggcccagatggtgaccacggacttccagaagatctttcccatgggtgaccggctgtacatcggtctggccgggctcgccactgacgtccagacagtgtaagtttcaagggtccccgcccacacccaggcctcttcttggaccatccaaccccggcgtcttgaccggccaaggtgtcagtcatctaccacacaccaccagtgagtttgagactttgccgs

SEQ ID NO: 12606 - DNA, 142 bp, Homo sapiens
  misc_feature 142: n=a, g, c or t
gctggttgtgatggtggctatgacaaaccttcagcctgaagacccgggagggaaaaatgtggcactgctcttgcaagacaaggaacccgtggctcagcaccacctgccataactgcacactggcacagcttctagcaatacn

SEQ ID NO: 12607 - DNA, 317 bp, Homo sapiens
  misc_feature 174: r=a or g
  misc_feature 175: y=c or t
tttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccryagtggatgcttccctgtgagggttggcgtctgctgatgcgagagctgcctgagacctgggctcctcttgagggcctccagactgctgcccccacacgtcactgtggcgatggtgtacggctgttccttcccctcacctccac

SEQ ID NO: 12608 - DNA, 255 bp, Homo sapiens
ttaggaatcatttctctcatctctttcctactcactatccagttccaatccatcacagtgtttatagaaattaccagtcaactttctctttaaatcatctacttctatttccttcttccttcaatatagaggtaaaccttgttgaaactttgttttcaaatttaatgaatgactttatatatagttttggttttttaactatatgaatatatcacctataacaaatgcaaatatttgtttcacacatccatccta

SEQ ID NO: 12609 - DNA, 184 bp, Homo sapiens
  misc_feature 129: m=a or c
agaacgggtcacgtgagcgcctcgcctggatgtgagtttcagccaggtctgtgaagcgggtttaagagggtgagggcgggataaacctttattagttgttttctgtttatcacaggtatagagacaacmttacccaagaggtcatggcagaatcaacagcttgttttgttttctttaaacggga

SEQ ID NO: 12610 - DNA, 261 bp, Homo sapiens
ttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtgacaacactgttttgtgattttatttgtgcaggtcatgcacacagttttgataaagggcagtaacaagtattggg

SEQ ID NO: 12611 - DNA, 370 bp, Homo sapiens
  misc_feature 270: m=a or c
cattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcattacaagaacagtggtgcggtgmcagtctgtgtccgttgtgatcacaggccttgctagaccctgatcatctggttctcctctcattaagcatccctaacccccagtcacaccttcctcttaca

SEQ ID NO: 12612 - DNA, 503 bp, Homo sapiens
  misc_feature 74: s=g or c
  misc_feature 149: w=a or t
  misc_feature 150: n=a, g, c or t
  misc_feature 408: n=a, g, c or t
  misc_feature 477: k=g or t
  misc_feature 478: n=a, g, c or t
agggcatggcctaagccggtcagctaaggccatgttaatacggggctgtcccatctctctgcggggcgcgacastggaagagccgaacggataagagaagaggaggtgagaggagctgtacaccacaagaggcactgagggactcaggwnaacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctactttngtcgaagaagtttattgtgggtcagggacgtcaggtcgcttgccttcgtttactgtggtcatgattgaknatatgaggacggccattattgctgg

SEQ ID NO: 12613 - DNA, 330 bp, Homo sapiens
  misc_feature 45: k=g or t
tttgccccggaagtgctttctttgcccgccgttcgccaaacgaakcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcaggagcgcctccggcagctggccctggagaccatcgacatcaacaaggacccgtacttcatgaagaaccacctgggctcctatgaatgcaaactctgcctgacacttcacaacaatgagggga

SEQ ID NO: 12614 - DNA, 335 bp, Homo sapiens
  misc_feature 58: s=g or c
  misc_feature 318: k=g or t
  misc_feature 319: k=g or t
acttcgccattttcctccggaagtgcggatcccagcggcggtcgtgtagctgagcagscctggggcttggttctatgtccctgtggctatgtttccagtgtcctctgggtgtttccaagagcaacaagaaacgaataaatctctgacccttctcaggtgcagccagagagacactagcccactgatggacggacagacgtgggcagggtccgtgtcactaaaccacccaccactgccacagctgcctacaacagacacatcagatgacactccgggcaaataaatgattttcactgaggactactggttttaataatkkgtcctggtgtagagaa

SEQ ID NO: 12615 - DNA, 532 bp, Homo sapiens
  misc_feature 130: n=a, g, c or t
gggccctggttacggaagccgaggaaggctgagcgcgggctctcaaggaaagtagtcgcggaatctcagttagcggtggagaggcagtatgtccggttcaatggcgactgcggaagctagcggcagcgantgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccggtaagaactatcagagatgggagcccttatgcagagaaaactacttaacagctgcagaacaggatgaagaaatgaattattggctgggcgtggtggctcacacctgtcatcccagtactttgggatgccaaggcaggcgg

SEQ ID NO: 12616 - DNA, 505 bp, Homo sapiens
  misc_feature 212: s=g or c
  misc_feature 366: r=a or g
  misc_feature 367: n=a, g, c or t
  misc_feature 368: n=a, g, c or t
gttggttggctgaggctggcttctgcgtggtgcagctgcgcacgtgtttcagccggcagcgctttaagatttccggggatggaatccgaaatggaaacgcagagcgccggggcagaggagggctttacccaggtcacccgcaaggtggccgacgggcgaagaaacgacaggctgaacagctgtccgcagcaggagagggcggggatgcgggscgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttrnnctattgtggaacatttgggacttcagatacgctttaacttgaaatcaaggaatgtagaaatcaggacttgtaaagaaaccaaggatgttagtgctctgacaaaagcagctgattttgtgaaagcttttattctcggc

SEQ ID NO: 12617 - DNA, 385 bp, Homo sapiens
aaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggata

SEQ ID NO: 12618 - DNA, 454 bp, Homo sapiens
aaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggctatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgcc

SEQ ID NO: 12619 - DNA, 286 bp, Homo sapiens
catgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccgtgtagtgatgcatcctcaattgccagcagtgcatcaatgcatacaaacgacgacggtcaacccctg

SEQ ID NO: 12620 - DNA, 177 bp, Homo sapiens
aagaggcaagaggtagcaaccgcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccaccc

SEQ ID NO: 12621 - DNA, 183 bp, Homo sapiens
  misc_feature 55: s=g or c
agaaccaggaaggcgctgagcttaaactgaagcaagttcggtggacgccggcggsccctgatctaaagaaacgactcagggactgcggcgcttgcacgtcaacgggaggtgtgagcccaaagaaatgggacgtcggtcatcagatactgaagaagaaagcagaagcaagagaaaaaagaaaca

SEQ ID NO: 12622 - DNA, 245 bp, Homo sapiens
  misc_feature 116: y=c or t
  misc_feature 213: s=g or c
actggggcaccgatctgcgtagaaacgggtggcggggaagagaggggaggagagctctgagtgggaagcggaccgggggcctgggacccgtcgcgtcagagccaggcaagtgaacyggagcaaacgacttccgatccagtctgcgctgttgcggctcccgtttgggatttgatttgcagcatctttgagcctctacgacaaaaaaccgcgaasacgcccagccctcccccggcaccccgaaaagc

SEQ ID NO: 12623 - DNA, 191 bp, Homo sapiens
  misc_feature 100: r=a or g
acttccttccccaaacttagagcgcggggtcctcagccctcgccgcctggttcttcagccgcgaaggcccgcgggagatcctggaaacgagcggccgcgrttcccaagcccacgttttcctggctggagttcgatgggattaacttcctctccgagtagaatagcgctctctcgatgtcactgtgtcccag

SEQ ID NO: 12624 - DNA, 435 bp, Homo sapiens
  misc_feature 176: r=a or g
  misc_feature 379: s=g or c
ccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcacgggtgaagctrtcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggasgtggacgtgaccaacaccaccttcctgctcatggccgcctccatctatctccacga

SEQ ID NO: 12625 - DNA, 215 bp, Homo sapiens
  misc_feature 105: r=a or g
  misc_feature 165: s=g or c
ccggctgacgtgtctttcaggaagaggagctggtgagaagacagcgaaatggcgcctccggcccccggcccggcctccggcggctccggggaggtagacgagctrttcgacgtaaagaacgccttctacatcggcagctaccagcagtgcataaacgaggcgcasgggtgaaggtgcggccgcgcaggggcgcggggacgctgggggcggaggcg

SEQ ID NO: 12626 - DNA, 106 bp, Homo sapiens
  misc_feature 67: y=c or t
acactaccacacaaacggcctccttcccccacccccgggggcccatcccggtggcgggctccggagytcgggactgctaatttcagcgaaacgattaaaagacgcc

SEQ ID NO: 12627 - DNA, 313 bp, Homo sapiens
  misc_feature 136: k=g or t
  misc_feature 308: k=g or t
agtggcgcctaaagtctgcgaggaggaagtcctgcgaggacttagtccctgagtccagggatctaagagccccacagtcttcgttacaacctcatggtgctgtcccaggatggatctgtgcagtcagggtttctckctgagggacatctggatggtcagcccttcctgcgctatgacaggcagaaacgcagggcaaagccccagggacagtggcagaagatgtcctgggagctaagacctgggacacagagaccgaggacttgacagagaatgggcaagacctcaggaggaccctgactcatatcaakggacc

SEQ ID NO: 12628 - DNA, 250 bp, Homo sapiens
atctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcac

SEQ ID NO: 12629 - DNA, 248 bp, Homo sapiens
  misc_feature 106: s=g or c
agaaggcgccgggtttcccaagatggcggcggacgtgtccgttactcacggcccccgctgagccctaagtctggggccgaagtcgaagccggcgatgccgcggagsccgggcgccggaagaagagctgccgcctctagatccagaagagatccggaaacgcctggaacacaccgagcgccagttccgtaaccgcgcgcaagatactgatccggggcctcccgggggacgtgaccaaccaggaagtaca

SEQ ID NO: 12630 - DNA, 459 bp, Homo sapiens
  misc_feature 18: r=a or g
  misc_feature 52: n=a, g, c or t
  misc_feature 53: y=c or t
  misc_feature 97: y=c or t
  misc_feature 391: k=g or t
  misc_feature 393: n=a, g, c or t
  misc_feature 396: r=a or g
  misc_feature 401: y=c or t
accaccgctgctcctcargaggcgcctcaccagcctccacaccccttgcgcnygcagaaacgcgcctggccctgagctgtcaccaccgacactctcyaggctccggacacgatgcaggccatcaagtgtgtggtggtgggagatggggccgtgggcaagacctgccttctcatcagctacaccaccaacgcctttcccggagagtacatccccaccgtcctgggattccagtggacaggatgacatcagcctccctagctgtgtgcgccaggccccaccaggttctgcctggcctctcggcagccccatccctgctcctgccgctgtgtgtgtgggtgcctcatgatgtccagtggctcaagcctctgccttaagctcaggcaccccttckgntgrgtatyctgttccctcctgctccacctctccctgccccgtgacacctccaggctgccttcatct

SEQ ID NO: 12631 - DNA, 142 bp, Homo sapiens
aaagtgttgggattacaggcgtaagcaccgcgcccggtctactccagatctttaaaatcgcttttcagcgcccgacgactcctggagtgaccagactctgaaacgcgctctgggtcttggcgagaatctgaataaccaccgg

SEQ ID NO: 12632 - DNA, 310 bp, Homo sapiens
cctaaagtggcacggtagtgtttcattttatacacttcactaagtttttctaatagtttttagctgattcttttagattttctaagtgaacagttgtgcaatgtgcccataatataacaatcagttatatattgagtcatgagacctgttaatgtctaactgtctgctttaatgaaggggagtgtccctgagaacattcaggcactgatcagtgcccagaccacagggactcccacctctggatgcgtccagccggatccacagaacagggtcgtggtgaggatgaaacgcggtgatgaacataaagtgc

SEQ ID NO: 12633 - DNA, 145 bp, Homo sapiens
  misc_feature 122: r=a or g
accgtggagacagaacgtgctgtgtggatgcggcgaaacgctgaggcgcggccttcgctgtgtggtggggactcacaagaccgacgtcaagatgatgctttcaagggccaaacctgctgtarggcagagggcgtacagcacactg

SEQ ID NO: 12634 - DNA, 227 bp, Homo sapiens
  misc_feature 22: s=g or c
agatgacctgtgcgggcggcasctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagccc

SEQ ID NO: 12635 - DNA, 302 bp, Homo sapiens
  misc_feature 249: w=a or t
  misc_feature 256: k=g or t
  misc_feature 270: k=g or t
  misc_feature 273: w=a or t
  misc_feature 287: r=a or g
atatagccctcatgtcagcgctgccggcttgcagcgggctgtgagaggggccggcgccgctttgtcctaggaaacgggctgcgcgtttctctttttcactcttttccatttccaggaaggacttgtaaggacttctgaaacgctgttttcatactcgatcggggatacagtacatacaccgtctaccagtaagcccttgaagggtttcgtgtgagctcgatttttttgtgcctgatttttttttttttwaactttkgcatactttgtttkgawagtctgaggctctraaactcatcaggatg

SEQ ID NO: 12636 - DNA, 255 bp, Homo sapiens
cttcccagttaaaagtgttggcccgcggcgcgcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggc

SEQ ID NO: 12637 - DNA, 594 bp, Homo sapiens
aagaaacaagccatacttgtacacttgtacactcagtttagggataacttggggtgtttgggctttatccttttaggattattaaattatatgtctgtaaggatggtcaatttacatttggcaagatagtccaaatgggaggaaataatggcaaatccactgatgtcattggtgctgtcacccatgagaaggaaagttcctactctctctgaggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagcc

SEQ ID NO: 12638 - DNA, 250 bp, Homo sapiens
  misc_feature 140: y=c or t
tatgttttggccgcttcaagatggcggtgcaggagtcggcggctcagttgtccatgaccctgaaggtccaggagtacccgaccctcaaggtgccctacgagacgctgaacaaacgctttcgcgccgctcagaagaacatygaccgggagtctccttgggatcctgcgttctctggagtcaccaccccacccggctcaaccgcggcatccccatagacctgctggaccggctgcttatcgtctccaccacc

SEQ ID NO: 12639 - DNA, 194 bp, Homo sapiens
ctttctcgcgtccgcagtgtccctgagggtccgcgtctacacgcggctgtgaggaaggaaggcgcgtgccgcgtgggacgggctccacctgcctgcggacagatggagggtcactttgttccgagaagacccagacacccgagggaggatgtgaaacggaacgacccgtttcgagtaataacaggatggagatg

SEQ ID NO: 12640 - DNA, 246 bp, Homo sapiens
  misc_feature 20: k=g or t
  misc_feature 33: n=a, g, c or t
  misc_feature 34: k=g or t
  misc_feature 195: n=a, g, c or t
  misc_feature 246: k=g or t
atattgtgcggcggcgccgkcgtccgcggcagnkgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacatntggcttagaaattgtggtttcacctcgaagtctacacagtgaattaatgtk

SEQ ID NO: 12641 - DNA, 410 bp, Homo sapiens
  misc_feature 360: r=a or g
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaaggaaagcgctctagcgagtgctgatttagaagaagaaattcaccagaaacaagggcagaaaaggaaaaattctcaacctggtgttaaagtagcagatagaaraatacttgatgacacagaagacacagttgtcagtcaaagaaagaaaattc

SEQ ID NO: 12642 - DNA, 292 bp, Homo sapiens
  misc_feature 149: m=a or c
  misc_feature 150: m=a or c
gttccctcgtgctggcgaacggtggtgcgtggcgtggctgagtttctgtcgtccatttctagagagaatcctgacgacggcgttcgcgggagtccgccggaagactacaggcttggacaggtcgccagtagcttatttcgcggcgaacmmcattccagaggtggcaccggtcggctggcgtccctcttcagttctctggagccccagattcaacccgtgtacgtgcctgtgcctaaaggaaagcgctctagcgagtgctgatttagaagaagaaattcaccagaaacaaggg

SEQ ID NO: 12643 - DNA, 132 bp, Homo sapiens
  misc_feature 120: s=g or c
  misc_feature 121: r=a or g
  misc_feature 125: r=a or g
acatcccagtctctgatcagggaaagcagggcacagccttgggaacaatggataagcatggtgtgaagacccccttgtggaagaaggaaacggaagagctccgggccgaggacgcgggasraagraggaagg

SEQ ID NO: 12644 - DNA, 256 bp, Homo sapiens
ggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaaac

SEQ ID NO: 12645 - DNA, 156 bp, Homo sapiens
  misc_feature 68: s=g or c
  misc_feature 72: r=a or g
  misc_feature 85: b=c or g or t
  misc_feature 110: d=a or g or t
  misc_feature 129: k=g or t
agttaactgttcctacaaatgaaagacacaagccaataaagccagtgagaaaggagcttaccaaaggsagtrtacgaagaaggtbcctgggagactgtcagaaatgagtdtttcactgaacttcaccckgccggcgaacacacactgaaagtcctg

SEQ ID NO: 12646 - DNA, 330 bp, Homo sapiens
  misc_feature 118: k=g or t
agcagcccatctttcccgagggatggactgagggcttggctactcccctgaccataaatggcttggccagggttctcttggagccacctctcagcctgcctctgcagctttgtcagtkaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacagtaagtacagcagcccccattcaccaggcaacgcagagaagaccagtgcagaatttacagtaggtctccagaac

SEQ ID NO: 12647 - DNA, 65 bp, Homo sapiens
cggtcccggcgcccggcgagggccgcggctggtgtccgccccgcccgaaagcatttgcaagtgag

SEQ ID NO: 12648 - DNA, 188 bp, Homo sapiens
  misc_feature 40: k=g or t
atctattcactgttgaaggtcacctgggctgtttgcagtkagttactatgaacagtcttatacaagtctttttgtggtcttactcttttatctttcatggttatatacttagacttggtttgagtaggtcatagggcaattgtatgtttcagttttgtgagaaactatgttttaaaaaatgcttctgg

SEQ ID NO: 12649 - DNA, 315 bp, Homo sapiens
acacagaccagcagtcccagcccagggaagctcggaagatgcctaggagggcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgacctctttgacctggacccagagacaccggccaacgggtaccgcagcctagtgcacacagcccgctgctg

SEQ ID NO: 12650 - DNA, 210 bp, Homo sapiens
gtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggtgagtattcccgcccacctcatggaacga

SEQ ID NO: 12651 - DNA, 312 bp, Homo sapiens
  misc_feature 277: n=a, g, c or t
  misc_feature 290: w=a or t
  misc_feature 295: k=g or t
  misc_feature 298: w=a or t
  misc_feature 299: r=a or g
  misc_feature 301: b=c or g or t
  misc_feature 306: w=a or t
  misc_feature 308: y=c or t
  misc_feature 312: s=g or c
gtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcancaacttctcttawgtggkgawrcbctagwgycccs

SEQ ID NO: 12652 - DNA, 305 bp, Homo sapiens
gcaggtctccaaaacgaatcccggcttggaggggctcagcggccctgggcctgtgcgccgttgcggccgggagggtcattttcatgcctaaggaccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagactgcgcggggcggagaaggggtatgtgtttgggc

SEQ ID NO: 12653 - DNA, 459 bp, Homo sapiens
ggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaagactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatag

SEQ ID NO: 12654 - DNA, 458 bp, Homo sapiens
  misc_feature 42: m=a or c
  misc_feature 73: k=g or t
  misc_feature 125: r=a or g
  misc_feature 184: n=a, g, c or t
  misc_feature 237: y=c or t
  misc_feature 317: k=g or t
aaaacggctgggtaggaagcacgctagcaggggcctctggcmttgctgagggtccctgtttccccttttcctkccttttcacccaacaaaaccctgctttactcacccttcaaaccatctatgarcctaaattgtcgtggtcgtggaatggacaaggacccagtctttagctgaactaaggganagtcctgctttttggcgcgcaacaggggagctcaagaaacaggcctcactcayggcatatggaactaaccacgcccctaactaagaaggcacaccttagttgcagttagcacacaattaaagcaactctccakgttttaccttaaagttcaaaattgctaggagttgaaactactagaaatatatttacatgcaagagtcaaagaaactttgaaactatttatggcctttaataattaagtaaggtatactcctgtgatcaagacttggagcat

SEQ ID NO: 12655 - DNA, 105 bp, Homo sapiens
actgcggggtgtgcggcggcccaagcggtttcaaacggcttagagcaggccgcttggttctgacccagctgaggaaatactcttaattctaaggaaaacctggaa

SEQ ID NO: 12656 - DNA, 283 bp, Homo sapiens
acacagatctcttaagaactttctgtctccaaaccgtggctgctcgataaatcagacagaacagttaatcctcaatttaagcctgatctaacccctagaaacagtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacc

SEQ ID NO: 12657 - DNA, 347 bp, Homo sapiens
  misc_feature 127: r=a or g
  misc_feature 197: y=c or t
  misc_feature 198: y=c or t
attaacggaccatgggctgctgggaaacggcttaggagcagcacccggctggcgctggccggccggcgccggggactttcttccgcctggccagacagatccctgttttttgtttttcaaaattcaraaagcatctccgaatatttgcccagaggagtgtgaaacatacttccctggagttgtaagacgttcatcgyygtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcacc

SEQ ID NO: 12658 - DNA, 276 bp, Homo sapiens
attaacggaccatgggctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatacttccctggtctttctttcactttgttttatttctgtgtggacaaacaatggggaaaatgccgcgcgtctagccaggcagataagaaaacaactatacccgtcaggcc

SEQ ID NO: 12659 - DNA, 191 bp, Homo sapiens
gccttcctcggggtgtatgtaggtaggcaggcacacaccagtcagcttgcattctgtgggtgatactctctgaggtggactgggtcacccgggagcttccggggtccgaaacggggaccactgatgaacgagtggtgcaggagctgtaggaagtaactttcagtattggtttttaaaaaatgcgctcaggc

SEQ ID NO: 12660 - DNA, 221 bp, Homo sapiens
tttttttgtgccgcagagcggccgggatcgtctgcctgcgaggtggcggtgcctaccacagcgggtcgggagcttctgggatccgagccgagaaacgggacgctcgagtccatttgcagtcttcacgtaggaaacggtgctaggtaaacggggcgagtgggtgttttgtaaatttaaagactcagctttccctgacggggaagttttccgagtcacgtagt

SEQ ID NO: 12661 - DNA, 349 bp, Homo sapiens
  misc_feature 215: n=a, g, c or t
acccatgctcactcacctggtagagtgtaggtgcctcatgctgacgggtctgccaggcggaggcctcagagcatcctcagacgtgtgtttccacttgcacaggatcgtctcaagccagacatgtgaaccactcagccactgaggctctcggagaactcagggaaagagcccctgggcaaggcacaaacgggtttcagctgctacgccacgcagtncaaatgggacctcttaccaccgcgcaccccaccttaccaaggggatgttccactgggaatgagaaataccatctgccgtatgcagcaagggatctgcagactttttttctgccattctggtgagaaaaagcgtg

SEQ ID NO: 12662 - DNA, 159 bp, Homo sapiens
ttcgtttggaggaaggtagggtttgttctaacgctttgcacaaaggcgggaaacggtcatcaaagctgttgcgaagggaagagccaatgcattaattcgatccaagaggactcgcctcgttggatttgcagcaacctaatctctcgctcaggaagaaaa

SEQ ID NO: 12663 - DNA, 438 bp, Homo sapiens
  misc_feature 196: n=a, g, c or t
ataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggantctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcaacctctcttccgctggc

SEQ ID NO: 12664 - DNA, 259 bp, Homo sapiens
atcaaccctagggagtcatggatactcctgactgtgtagccagttggtctgaagtgcaagtggtttggggacacccaagtgtggttggcacctgaaataggggcaatcttttttgggaaacgtacccttaaacttgcaggatctgttctaactccaggtgattcctgccagagttgaactgcaattcaccagttggtgttcaatgaaccccgaagcccttcatactccaccataagagtcatacctttttttttttttt

SEQ ID NO: 12665 - DNA, 426 bp, Homo sapiens
aggcaggccgctccaggaacaaggccgtgcggacaggactgacctaggcgcttttccccgtcgctcccagaggagaaacgtaccggggaggggacagaccgtgagcaagtggtccaagtctgcgcagggtgaccccgaagcccaccggagaggccgaggcttgtgggctactagaactaggcctggtaggtgaaggaggcgggtgaagggccggatccaggactgaatccgggagaggcggggcgaggaggggactccggtgtagctgcttgggcagctcccgcggcccctctggcgggggtgaccgttattggactcgcagagggaagagttgggtagcgtcccctactcacctagaagcgctgccgcctgaggctccagctgcccccctcccaattcagccacgtcagctcgggaagccgtacg

SEQ ID NO: 12666 - DNA, 157 bp, Homo sapiens
tgaggactaccaagatttattagagtcttagactgttagaactgcaaataaacgtagaaatttactggttgtagagtcgtgttgagctcctcctacttctaccaggtgtaaacacaaatctctttttttgctgtgtatctgttctttaatagtagcg

SEQ ID NO: 12667 - DNA, 489 bp, Homo sapiens
  misc_feature 446: w=a or t
aaaaggaagacgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagccagtttgagatgtgggcttcaawatcaaagaaaacgctgcgacctagatgtatcttggagtcacca

SEQ ID NO: 12668 - DNA, 395 bp, Homo sapiens
  misc_feature 86: r=a or g
aatcagactgttttttggtcccagggaaaggaggaagaaggagattgtgatggagaaagggggtctgtgaaacgtcaggcacagcrcaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaagggaaaggggggaaccaccagcaccctccgtcggactcttgaagcctttttttttaattcttaatttttttttttactctttacaaaaagtaaagtgagaatcctgctctctaatacac

SEQ ID NO: 12669 - DNA, 115 bp, Homo sapiens
gtaagatgagagaggagggaaacgtgtcaccagcccggctgtgggagctccgcggccgaagcgtttgttgactcgcgctggagaggaaccgaggctggacgggaccccatctgag

SEQ ID NO: 12670 - DNA, 383 bp, Homo sapiens
aaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctactt

SEQ ID NO: 12671 - DNA, 145 bp, Homo sapiens
aaacgttattagcatatctttgtgctttattatcctggtgacagttaccgttctatgtaggctgtgacttgcgctgcttttttagagcacttggcaaatcagaaatgcttctagctgtatttgtatgcacttattttaaaaaaaa

SEQ ID NO: 12672 - DNA, 184 bp, Homo sapiens
gtttccacagcgccaacagcaacgcggaccacgaaggatttttactgggagaggtaagacaagaggaaacgtttagcatcagtgactcacaaatcagcaacacagaatttctgcaagtaattgttctaggagtagcagggagaaggcagcaacagaagtgtccttagttaatgaggtgatgcag

SEQ ID NO: 12673 - DNA, 371 bp, Homo sapiens
  misc_feature 37: y=c or t
  misc_feature 126: r=a or g
  misc_feature 154: y=c or t
  misc_feature 166: r=a or g
  misc_feature 174: r=a or g
gaagactggcacgacccctaaagttaggtcggaagayctgtgggcagcttgagcgccgaggagtgccctgaacgctcaactcgccctggaaacgtttttccgtacagcaacatggcggcgcccatrgactcttagaaaaggagaaagctttttytctgtggactgraaggggcrtttttcatgatcactatttagatgggtgctgttttcctgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggag

SEQ ID NO: 12674 - DNA, 142 bp, Homo sapiens
tttaataataaactaaacttttttttgtctcccgttattgaaaagtaccaaagcttctttctgttgtgtttgattttactataggggttttgctttttctagagatacttttcatttaacagcttttgttaagtgtcactgc

SEQ ID NO: 12675 - DNA, 193 bp, Homo sapiens
cagagttaacagtagtgggatgaaagtcataatgaatataaactaatattaagataaagaataaacaacaggcaaatgcaacaggagaatccagtctggaaaaaaacaaattgagacacatgtctgatacacacaggtgtttgcggttaattttgaaccggtctcatatataagaacaattgcatgcatggga

SEQ ID NO: 12676 - DNA, 149 bp, Homo sapiens
atctggaaccacgtggagaagactgtgaggtgaaaacatgctactctctgtcacatactgccaggtagatgcttgctgctggcagaaggcatagaatattttgtaaactaccctctacggcagacacatgcaggccaacccagaaacca

SEQ ID NO: 12677 - DNA, 319 bp, Homo sapiens
  misc_feature 59: w=a or t
  misc_feature 80: k=g or t
  misc_feature 92: n=a, g, c or t
tctagcacttgtgagtagtgagttattttttacagttgggatctttctctaagatttgwggaagtatattttgcattgcktttgaggggatnggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaag

SEQ ID NO: 12678 - DNA, 155 bp, Homo sapiens
tcccttatgtagaaatactggttctgctaatgctctggcactgatatggggaaaggaaactggattaggattaaagcttcacctctagactttcctgaacaaactagagtgcagatcagtcaggaaccaacgatacgagagcagtgtagtagctg

SEQ ID NO: 12679 - DNA, 397 bp, Homo sapiens
  misc_feature 143: r=a or g
gccgggcgctgtgcgaactagaaataactgggggcatggagaatgcggtggctgtaaagggccgctgaggcggtggaggcctggcagagagcgtccccgcggtcgcggcttctggcttctctgtggagcttggttcttccgtrgtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgt

SEQ ID NO: 12680 - DNA, 455 bp, Homo sapiens
  misc_feature 397: s=g or c
  misc_feature 398: n=a, g, c or t
  misc_feature 399: n=a, g, c or t
  misc_feature 444: n=a, g, c or t
atcaagccctgcaaccatgtgctgagtctctccttccccatccggcgcgacgacggctcctgggaggtcatcgaaggctaccgggcccagcacagccagcaccgcacgccctgcaagggagaggcagaaattaatacagattcaagtgttcactatcaagtcggaattgttaatatgtgaaatactactgttaaaggcaggaaaggctttattaaggacaagaagacaaactaggagaaggagctactcaagaccttccgattatctttacaaaaaggcaactacacctagaagattctgcagccacacacattctgccttcacttgaggtcaactgccttcaccaaggtatccgttacagcactgatgtgagtgtagatgaagtaaaagctttggsnnctctgatgacatacaagtgtgcagtggttgatgtgcgtttggggntgctaaagctg

SEQ ID NO: 12681 - DNA, 387 bp, Homo sapiens
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggtgagacacctctattttgtacttctcacttttaagggattagaaaatagccaaagcaatgatgattatctatgttagtgcttctctcccctcttttcaaatgagaattttgctctcatattgatactaagtttaatactgaagaaaatgtgaaaacagatactatgatggttgcatagttcagc

SEQ ID NO: 12682 - DNA, 628 bp, Homo sapiens
  misc_feature 515: m=a or c
  misc_feature 545: w=a or t
  misc_feature 620: m=a or c
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcamccaagctagagtgcagtggcctttgaagcwtactacagcctcaaacttctgggctcaagtgatcctcagcctcccagtggtctttgtagactgcctgatggagtmtcatggca

SEQ ID NO: 12683 - DNA, 290 bp, Homo sapiens
  misc_feature 2: r=a or g
  misc_feature 24: r=a or g
  misc_feature 47: k=g or t
  misc_feature 50: n=a, g, c or t
  misc_feature 73: r=a or g
  misc_feature 88: s=g or c
  misc_feature 98: s=g or c
  misc_feature 99: r=a or g
  misc_feature 100: k=g or t
  misc_feature 102: k=g or t
araccgcatctgcccactgcctarcggggcacttctctaccaatcckaanggctgctcgcccggcctcacggraaaggtagtttccasgttttgcgtsrkakgcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtgg

SEQ ID NO: 12684 - DNA, 223 bp, Homo sapiens
ctttttttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtgg

SEQ ID NO: 12685 - DNA, 214 bp, Homo sapiens
caactgaaaaaaacatatccaaaataatgaggaaatgtgtggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacat

SEQ ID NO: 12686 - DNA, 257 bp, Homo sapiens
taaatattttctttgtccacatgggccgttgaccttagagttaaggcggttgcttttttgaagaaatcaccaaagtttctgggaaactatgttcaaggttgaaatggagagtagatttaattttatttgtcttgtagggaagaaatcttcctttgaaccgcttttcttgctttttccctttttcccaaactaggttacaggttcttatctgcaaggttcaagttgcttagacattgttttccagtattctgcagggc

SEQ ID NO: 12687 - DNA, 240 bp, Homo sapiens
agtctctgagcagccattgaaggggaaggaactgcgggtgtgtgtgtgtatgtgtatatatatataaataatatgtgtatagttataaaaatatgtttgatctatcttagtgcttagtatttaatactgtttaaatgagttttgattttatatgagctgctaagaaactataaagaattaattatcatggcaattctttttcaggatggttcaacaatgctcattgaagctgcaaagggt

SEQ ID NO: 12688 - DNA, 63 bp, Homo sapiens
ccttctttgtattgtctgtttaaactataatgtaacacctattttgttttatgtatatatatg

SEQ ID NO: 12689 - DNA, 209 bp, Homo sapiens
cccttagggaatacgagtaacattgtgcctgtggattgtttctccattgcaagagttggcaaactatagtctatatgccaaatccagtctactacctgtttttgtaaataaagttttattggagcacaatcatgctcacttgtttactctatgactgctttcatcatccaatgacagaattttcatagttgcaacagacactgtatggc

SEQ ID NO: 12690 - DNA, 390 bp, Homo sapiens
aggtcgggaagtgaaggactcgcaggcatatttaacaacgcaaagttgctaggagttggtaccagcgtttgggaggtagaggtggcgctcatgcatatttgagacaacatctggatggttggggagaacggtgatgccacactcaatcagaaactatgctactgctgaagaggtatattgagccctgcctggttaacctccagtgaggttattagagaattgggagaggctcaaatcagcatcctgcacctggttatcaaaccattgtgaagtcttgattcctggatggccagaaaacttgtcattggtcaagagcaacattaagatctgcctgttactcatactgatgcttcctgcccagcaagttcatcagagggcgaggatgaatta

SEQ ID NO: 12691 - DNA, 299 bp, Homo sapiens
  misc_feature 132: n=a, g, c or t
  misc_feature 133: n=a, g, c or t
gttcctttgctcccttgggcagagaagctggcgttcggagccagcctttccagcctcactcctcgtggcttgtcctcgcagtgggtgcaggttgcaggaacagccgggacagatggtccctctgcgggcccnngcctccacccacatgcctgtctggaaagtggctttggcttagctgtaccagagcttcttcctggaggaaactcaaagccaattgttgggaagtatctgcggggactgtgtccaggggcagagggcccacccagggtacctcgtggagaagggagagaagggagacc

SEQ ID NO: 12692 - DNA, 479 bp, Homo sapiens
  misc_feature 85: m=a or c
  misc_feature 412: n=a, g, c or t
tgccgtatatggatacatggctgttcgtgacattctttatgtgcaaatttgtgatttcaaaaatgtcctgccagtttaagggtamattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttatnagaaacagctgagaggcactatggattagtcttctgaagtgaaggaaatatagatgtcacctaagtg

SEQ ID NO: 12693 - DNA, 254 bp, Homo sapiens
acagcgcgcaccaatgatgagcaaactgaaccagcgtcaggaggcgccagttaaactcaaatgtttcagctcaacaaggcctgtgaggtggtcctatttctccagttttacgttctccggtatgtctttatcagcagcatgaaaacaagactaatacacccccacaccatggtaccgaagacgggacacagctgctctactgattaaattcaactgacgtgaggttgcagctattctattcatatattcaccat

SEQ ID NO: 12694 - DNA, 293 bp, Homo sapiens
  misc_feature 30: k=g or t
ccttcaccagcagcccgtccgactggaaakatctgcctcttctccaagaaactcaaccactagtgacaatgaccagcctcctgactactccttctccaagagaagaactgacgagtgtgtccttaggacataggtccagccctacagattagctgggtgaagaaggcaagtgtctcgacagggcttagtctccaccctcaggcatggaaccattcagggtgaagcctggtatgtgggcacaggagactcagactgattttgttatttttatatcagcctgagtctcctgtgcc

SEQ ID NO: 12695 - DNA, 512 bp, Homo sapiens
  misc_feature 420: n=a, g, c or t
  misc_feature 421: n=a, g, c or t
  misc_feature 422: m=a or c
gataggaagtatgaagaggtggctcgtaagttggtgatcattgaaggagacttggaacgcacagaggaacgagctgagctggcagagtcccgttgcgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgannmagactccgcctgaggccagcctgcgggaagctgacctttaactgagggctgatctttaactggaaggctgctttctcctttctccacccc

SEQ ID NO: 12696 - DNA, 278 bp, Homo sapiens
tctagatcagttttctaaggtaaatgtgaagtacatcagtgactccaaactcaattgaggtctcccgattttcttggactgactatgtatattttaaagaattatttactttcatactttgccaagacccagacagaaagaagctttcagtgttcgtggcagcagaaaagaatactaataagtgttagtcatccacagtaaattaaaaatataataataaaggaaaattaaactgctgtgtgtttgggtgtttgctctatcaccataaattcacaacc

SEQ ID NO: 12697 - DNA, 397 bp, Homo sapiens
  misc_feature 89: r=a or g
gcacactgctcttccttaagggcgggagtctcggtttgtggtggcttcgctgaggcagtggtggccgcactataccgttagaaactcartttcccggaggttgtgaggccctttgaggcgaaatcgctctgggcgtgaaaggagcaggcgttggcaatggaaggaccaccgcgacctcaggctgaccgtaggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaa

SEQ ID NO: 12698 - DNA, 180 bp, Homo sapiens
  misc_feature 133: w=a or t
  misc_feature 134: r=a or g
attggacactctgacattataaagatgctcatgataatttttttcctacttgagattagagtctaatttgaagagagttatgttatgcatacaattaattgtaataaaggttgctaagaagatttagaggagwraaataaggcaaactcaccgaggaaatagagaacttactagaggcag

SEQ ID NO: 12699 - DNA, 397 bp, Homo sapiens
tttttccgacccaactgagccggaagtggaggcgcgggcttcccatgatgccccgcgagacctttattctaaccgcaaggagtagcggaggggaggtcgtgatggcggcgccggagggaaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccga

SEQ ID NO: 12700 - DNA, 181 bp, Homo sapiens
aaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtacccca

SEQ ID NO: 12701 - DNA, 344 bp, Homo sapiens
agttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaacgagaagtgtcttcctggactgtggaaggtgatattaatactgacccatgggcaggttatcgatatactggtaaactcagaccacattatccactgatgcc

SEQ ID NO: 12702 - DNA, 418 bp, Homo sapiens
  misc_feature 241: k=g or t
  misc_feature 273: r=a or g
  misc_feature 333: r=a or g
  misc_feature 344: r=a or g
  misc_feature 349: w=a or t
  misc_feature 351: w=a or t
  misc_feature 386: r=a or g
agtgataacattagaaactcattggagcacgaaccctggtgaactgcctatccgaagatctaggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcktcatggacaaggcttggctctgttgagtccarctaacctacctgagattctgagatttctcttcaatggcttcctgtgagctagagtttgaraatatcttaaratctwgwgctagagatggaagtagcttggacgattttcattrtcatgtaaatcgggtcactcaaggggccaacc

SEQ ID NO: 12703 - DNA, 231 bp, Homo sapiens
gtacccgccggctgtagccgtaagacgcatgcgctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcacc

SEQ ID NO: 12704 - DNA, 382 bp, Homo sapiens
agacaaccaaactccatcaatcaagaggaacttaatccggagggttcttctgctcactgggtcagaagcatccgatttcctgtcatcggttgcggttcagccatgttaatactgaaagtataagaatatcataatcccagagtgatataaagacctttccaaggaagatgagatacccggaggctgtgaaggagaagtctgaaggatttgaacgcgttcaaatgaaactttggttcagcaaaacaccagaaacaaattcaaaagataaaatacactccggagaagcccattctctcaacgcatctgacagttcacaaagagcaactgcagtccaacttaaaaaataaagaaaatggtaggaaaatgggcaacatgcactgag

SEQ ID NO: 12705 - DNA, 220 bp, Homo sapiens
gaagttctgaggcagcctttgtctggctggaacacgcattggcagcgggagctgtcggtaggacctgggacaccgcggaagtcgggaaatggcctcagtggctttagaggatggctgtgaacttcacccgagaagagtgggctttgctgggtccttgtcagaagaatctctacaaagatgtgatgcaggaaaccatcaggaacctggattgtgtagtaat

SEQ ID NO: 12706 - DNA, 371 bp, Homo sapiens
gatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttgtggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtc

SEQ ID NO: 12707 - DNA, 417 bp, Homo sapiens
  misc_feature 11: n=a, g, c or t
  misc_feature 12: s=g or c
gcgcacagtanstggccaccgcgactggtgctgaagtgtcggcgcgtgcgcagatctcgatcccaaactccctcctgccagaatctggacccgaatccacccattgcccgttttccgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttatcaaatgctgttttccatgactgtctctgttcttcccatacgcgaatggcaa

SEQ ID NO: 12708 - DNA, 275 bp, Homo sapiens
  misc_feature 258: n=a, g, c or t
ctctggtttttgtccccgccagcggctccgactccatcgcgtcctcttccagtctagtgctttttttccagatctcgatcccaaactccctcctgccagaatctggacccgaatccacccattgctcgttttccgctgccgctggagagaatctctgaggtccccaggagagcctgcctgcacggaagagacgcctcctcgggtgactgctctccatggttctaggtggttctgcatggggcctctcacatgtgctanagtcaaacattagccgg

SEQ ID NO: 12709 - DNA, 586 bp, Homo sapiens
  misc_feature 7: n=a, g, c or t
  misc_feature 8: s=g or c
  misc_feature 547: y=c or t
aggtatnscgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactgcaggtctctgaggctgtggttgctacagggtcaccacgagcttggcttacttgtctcatccttcccttgcctggtatcattttctcagttctccyaaaagccatgtcccggcccttgctcatcaccttcacccc

SEQ ID NO: 12710 - DNA, 322 bp, Homo sapiens
acgagaagccaccggaagcggaagccagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtctctgaggctgtggttgctacagggtcaccacgagcttggcttacttgtctcatccttcccttgcctggtatcattttctcagttctcccaaaagccatgtcccggcccttgctcatcaccttcacccc

SEQ ID NO: 12711 - DNA, 121 bp, Homo sapiens
  misc_feature 101: k=g or t
catcattgtctttggttcccttcaaagagaattttattgttgttttgtattttcaagtccttaatagttcttgaaactcctagttgttttcttgttgaaakcagacacacatttagtgcac

SEQ ID NO: 12712 - DNA, 406 bp, Homo sapiens
atcgtccctccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttcctgtaattgtctctgacctttttatctgagaccgga

SEQ ID NO: 12713 - DNA, 475 bp, Homo sapiens
aaaagtttccgaggctcagaggaacacaatgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgagga

SEQ ID NO: 12714 - DNA, 288 bp, Homo sapiens
  misc_feature 242: n=a, g, c or t
  misc_feature 243: n=a, g, c or t
gttacacaggaagagagcaggcagcatcagtatcggctcagcatccttcccccttctgttcgattagaagctgatcgaagcaacagtgccataaagaaatgggctagatatttccagaggctgcaatctggaggcgtttggaggtaccgaccaagaccatcactatgaccgatggagactatgattatctgatcaaactcctggccctcggggattcaggggtggggaagacaacatttctnnatagatacacagataataaattcaatcccaaattcatcactacag

SEQ ID NO: 12715 - DNA, 308 bp, Homo sapiens
  misc_feature 196: m=a or c
  misc_feature 210: r=a or g
  misc_feature 234: k=g or t
  misc_feature 235: r=a or g
  misc_feature 299: r=a or g
actcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgmtctcccggcaaggraacttcgcaggctgaccgaccaakrccatcactatgaccgatggagactatgattatctgatcaaactcctggccctcggggattcagrggtggggaa

SEQ ID NO: 12716 - DNA, 445 bp, Homo sapiens
  misc_feature 430: w=a or t
  misc_feature 431: n=a, g, c or t
aaccggaagcctcgaggtttagtcccgcccccctctcctcgctgcttaggcttccgcggcctccaagctgtagctatgacggcgcgcgggactccgagccgcttcttggccagcgttctccacaacggactgggtcgctatgtgcagcagctgcagcgtctgagcttcagcgtcagcgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccttaacggggctgtgcgcgaggagagcatccactgcaagtcggtcgaggagatctcgacgctggtgcagaagctggccgaccagtcgggcttggacgtgatccgcatccgcaagccctwncacaccgacaaccc

SEQ ID NO: 12717 - DNA, 182 bp, Homo sapiens
  misc_feature 138: m=a or c
  misc_feature 162: n=a, g, c or t
ctcttctggtggccgggaacgcccactcacccggacaagtcgcggcccttccaagcctcacactgctttcgtaggatcaattccgaatacccaaactcggagatatcacgaggactcccccgggcccccaaacgcacmtctcctctggctggaatgggagcntccagaagcagtgcgagacc

SEQ ID NO: 12718 - DNA, 251 bp, Homo sapiens
aagctcacttgtttttgggcaatctagccaaggtgtcacataatggagaaaaatgcagatggtcctgggctggtgtgaatgaagaatgacctgggcccaacatagaacttttccagtatggtctctgcatgtggggagccaaactctagagaagacatcagtgaactgctgatttggagtgactgacacttattcctgagagtaggtgattcttcagtatccaaagaaatgtatcaagtttgtattagatg

SEQ ID NO: 12719 - DNA, 181 bp, Homo sapiens
cacactggttttctgtctcccacctcccaccggatgacctttgcgcttagccatccctctattgggaacacgcttgccccagatcttcacattcaggtctcagctcaaatgtcactgctcggaaactctagccgtaagtggcaccttgctcctgccctgccgctcacccctcattacatca

SEQ ID NO: 12720 - DNA, 556 bp, Homo sapiens
  misc_feature 297: r=a or g
  misc_feature 303: r=a or g
  misc_feature 304: m=a or c
ataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgrctttgrmgttgaaagacatctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaagctgctgac

SEQ ID NO: 12721 - DNA, 274 bp, Homo sapiens
  misc_feature 51: d=a or g or t
  misc_feature 86: r=a or g
  misc_feature 190: s=g or c
  misc_feature 269: n=a, g, c or t
agcgagggcgtgcggagtttggctgctccggggttagcaggtgagcctgcdatgcgcgggaagacgttccgctttgaaatgcagcrggatttgaagttgggatatctaaagcagaagccttagaaactctgcaaattatcagaagagaatgtctcacaaataaaccaagatatgctggtacatctgagtsacacaagaagtgtacagcactggaacttcttgagcaggagcatacccagggcttcataatcaccttctgttcagcactngatga

SEQ ID NO: 12722 - DNA, 411 bp, Homo sapiens
  misc_feature 406: k=g or t
atatgcattggtatgtgtttattttcattcactgtttttatggctctcaataacctttctaatctgataactcatttctttcaattcttctaatttttcctgtattctttgataattttgtgtacttattttttctcttctttttgactctttattagttagatgttagacatgttaggctggtcctttagtttacttacctatagcttttttagttcaacatcccttctcttcaaactctgctgagagtaaatctccagttttctgctggggttggagagggatagttgcctagaagaggtctaagtgcttctatacaggttttcacaatcctgttctctgctgcattgccacccctaattttagaggtactgctgctacttcttaagactttttttttttcctkgtttt

SEQ ID NO: 12723 - DNA, 426 bp, Homo sapiens
  misc_feature 220: s=g or c
  misc_feature 351: r=a or g
  misc_feature 426: m=a or c
ccaaaatcttgggggatggaaccatctctcctggagtctcacctctgcacagtgaggccctggtggctactgtcctgacttctggtgattattttgcactggagtctctctttgttttagtcagtagaatctctaatgcccactttcactttctggtttaaatacaggctaaaggttccccactgctcccccagccccaaactctgtttcatcccagcasctaccttgggcccaccttcaatcctcattcctgctcctattactttctttttcaccccagattaaggcttctggggtatcctttcctaggacgcagaatgaggtatagtctgtcaccccaattgaagctcracatttgttgagaatttctagtttttactctgtaattcagagatcttaggaagaattttgtcttccatctcccam

SEQ ID NO: 12724 - DNA, 106 bp, Homo sapiens
tgaaactcttgaagcccataagattaagatggattcttcacatatcctactttgacagagatatgtagaagattagtctctcattatttcctattaactgaagaag

SEQ ID NO: 12725 - DNA, 364 bp, Homo sapiens
acaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccgatgtcactttccttttaggtatagtcccaaataatcccagaagctttgatagggattatctctctttctcttcccatgctccctcaaactcttgctcaaatgttactctgcggagagggctcca

SEQ ID NO: 12726 - DNA, 391 bp, Homo sapiens
acaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccgatgtcactttccttttaggtatagtcccaaataatcccagaagctttgatagggattatctctctttctcttccttgccctgagtgggaagaaacccacggtccacgtcctcaaaatttggctcaaatgttactctgcggagagggctcca

SEQ ID NO: 12727 - DNA, 142 bp, Homo sapiens
ccacatcttggcagcaccacagtgcgagacccacagctcccctttctttgaaattctttcacactcattaggataatcaaagcttccagtttagtgcatgagctaattattaagttagccaaagcttaaactcttgtaacca

SEQ ID NO: 12728 - DNA, 332 bp, Homo sapiens
gtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaa

SEQ ID NO: 12729 - DNA, 413 bp, Homo sapiens
  misc_feature 380: m=a or c
  misc_feature 381: y=c or t
  misc_feature 382: k=g or t
  misc_feature 395: n=a, g, c or t
  misc_feature 396: n=a, g, c or t
  misc_feature 399: n=a, g, c or t
aacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacmykggggatagatctnngtntgtaaaaactcacc

SEQ ID NO: 12730 - DNA, 427 bp, Homo sapiens
  misc_feature 397: n=a, g, c or t
aacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgctgtnctttgaatggtaataaagtaataagcttca

SEQ ID NO: 12731 - DNA, 502 bp, Homo sapiens
aacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaaga

SEQ ID NO: 12732 - DNA, 417 bp, Homo sapiens
  misc_feature 313: w=a or t
  misc_feature 329: n=a, g, c or t
  misc_feature 330: k=g or t
  misc_feature 332: m=a or c
  misc_feature 394: s=g or c
  misc_feature 396: r=a or g
aacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgaaatgtcacccaggctagagtgcagtggcataataacagctcactgtagcctcgatctcctgggctcaagtgatcctcctgcctcagcctcccaagtagttggaacacaggcacgtgccacacctgcccctcccttttttttttwaagatggtcttgctgnktmacccaggctagagtatagccttgatctcctgggcttaagcaatcctcccacctcagtttccsargtagctataggcacgtgccac

SEQ ID NO: 12733 - DNA, 328 bp, Homo sapiens
ctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctggg

SEQ ID NO: 12734 - DNA, 287 bp, Homo sapiens
  misc_feature 286: m=a or c
agttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggma

SEQ ID NO: 12735 - DNA, 383 bp, Homo sapiens
  misc_feature 241: r=a or g
  misc_feature 246: y=c or t
  misc_feature 264: n=a, g, c or t
  misc_feature 265: n=a, g, c or t
aagaatgaatagggccgcgcagaccaaggcgtccgatccacgcgcgctccacacccggaccctctccaagttggaaaggacaaaaagaaggcaataaatgctaaaaagggagagaaggggagctggatcgagcggcaactcccagcctctgctggaacagagagggagggagggagccggagcgagcgagcgcgcgcgagggcgagcgctgcacgtaaagaaactgacacccggacccccrattcycccttctgattcttcctnncactgaacaagccctccttttcaatcagtgctggtcctgcccttctcttcctcatgaaccatcagtggctcccacgtccactgggatagcttctcccaacctgctttctttctttttt

SEQ ID NO: 12736 - DNA, 315 bp, Homo sapiens
ctctttctacctaataaatacgaagggctgtagaagctcagggcccttgctcactagaaggagccccctgaccccttcttccaaaaatactttttgtctttgtcttcgtttctgcattcatcccccttcgttcactcccataacaaccaacagcgacaactggcacctaggacagggacgtgagtgaaggtctgctggagcagagaaactgacactgacaagaagaacgagaatgagaaaccctgcgacgagtctgctgacagctaatataagtctgcaaaatcagctggaccaccaaacggcaattgagagctg

SEQ ID NO: 12737 - DNA, 245 bp, Homo sapiens
cagaaactgaccctgaggcagcacaggcattggacttgctagacaaggacattaatgtcttcaacctactcaaagagctaacagaaaccatggacaaacaactaaaggaaacagagaatgatttatcattaaataaagaatatcagtaaagagataaaaattataaaaaggataggaacagaggaaatcaaattgtctgtttgtagatgacatggttgtacatttagaataccccatcatctcag

SEQ ID NO: 12738 - DNA, 181 bp, Homo sapiens
cttgattatagcacactgctttgccatgtttaactgtgagggtgtcttgtgttgtttgaatgtgatctgaacagaaactgaccttttcagatgtttcttctttggagatcagacagttgaagttgaagtattcttcccatcaaattatcctgagggaggactacagagccagtttaggaag

SEQ ID NO: 12739 - DNA, 187 bp, Homo sapiens
gatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttctttttttt

SEQ ID NO: 12740 - DNA, 190 bp, Homo sapiens
  misc_feature 113: n=a, g, c or t
  misc_feature 166: s=g or c
aagtttgttggctgcggcagcaggctagcaaagtgacgccgagggcctgagtgctccagtagccaccgcatctggagaaccagcggttaccatggaggggatcagtgtaagtncagtttcaacctgctttgtcataaatgtacaaacgtttgaacttagagcgcasccctctccgagcgggcagaagcgc

SEQ ID NO: 12741 - DNA, 225 bp, Homo sapiens
tatgaacgggaaggaggtgagcgggcggctgctgtacgcgggccgggcccaaaagcgcgtggagcgcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaag

SEQ ID NO: 12742 - DNA, 272 bp, Homo sapiens
  misc_feature 128: n=a, g, c or t
caaatagggaaactgaggcccagaaaggggaagggtcacccagtgagcaagtcagagagacaggtccagaacacaggtgtcctagctaccaggggttggagtgcttagcggacagctgtacgccacangtgggcatgaggcctttggtgaggaagagcgttgaggtttacgatcctggaacaaatacctggaagcaagtggcagacatgaacatgtgccggcgcaacgcagggtctgtgcagtaaatgggctcctgtatgtggttggagggg

SEQ ID NO: 12743 - DNA, 514 bp, Homo sapiens
  misc_feature 157: k=g or t
  misc_feature 162: k=g or t
gaaagaatacatatgcaaataagtttacttttatttttggtaacactttactgcattgtctgaatattgacaatcagtatgcattatgaagctacctggctaacattgtgtactcactgtgtgtgccaggccctgggttcaatgctctacatgcacktatakttcatttaattctctctgcaacctgagatggtatagccacctcattttacagagttgaaactgaggctcagagactgaaagtaagcctgaggttgcagtcaataagaggcagagctggaactgaaacctacctgtgtctgaccaccagttcgtgttctgacggcaggctagtctgcatcacagagtgtggagtagatggtgcatgcctgctaggatgggctaggtatcactgtaggtaagaaacagccccaaactatggaaatgtacaccactgaaggctcttttcctgcccatgctgcacatcctccatggctctcctgtgccctgtgccccacatgccctcatcctgcca

SEQ ID NO: 12744 - DNA, 255 bp, Homo sapiens
ttgaaattgcaggaggcggttgctccggcctgtctcaagctctgttgggtgccgatggggaaactgaggctcaggaagacagttgacttgttcctggacttctaatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacgg

SEQ ID NO: 12745 - DNA, 445 bp, Homo sapiens
  misc_feature 23: s=g or c
  misc_feature 24: s=g or c
atatcagaggctcggcgcggcgsstcctcctcgctcccgctccccactcccgggatgtgtctccgccgtacgacgggctatggccaccacgacttccgggttccgtcatttcgttctcccgccgcccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagataactccctccatgtggcttcaagccaccaggacacaggcccccccaacactcttaatcttctcctcagctcttctgctgaagaatttggccttcacgatgacaggctgctttgggagctttccctttcccagaactttgtagtagcccgacgcac

SEQ ID NO: 12746 - DNA, 440 bp, Homo sapiens
  misc_feature 23: s=g or c
  misc_feature 24: s=g or c
atatcagaggctcggcgcggcgsstcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaag

SEQ ID NO: 12747 - DNA, 128 bp, Homo sapiens
  misc_feature 31: s=g or c
  misc_feature 32: s=g or c
tttcgcttgaggcatttttgcggcgctgtgsstacagacaccttctggaagctgcggtggggaaactgagtttcccgagccgttgagacagatggggttcagcaccgcgcggggacgacaggaaagct

SEQ ID NO: 12748 - DNA, 261 bp, Homo sapiens
  misc_feature 80: n=a, g, c or t
  misc_feature 81: n=a, g, c or t
agactactgctacttacagcaccgtatagcagccctgctcctacattttgctgccttactctgccccgaatgcactggannggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaac

SEQ ID NO: 12749 - DNA, 604 bp, Homo sapiens
  misc_feature 85: s=g or c
  misc_feature 119: y=c or t
  misc_feature 120: n=a, g, c or t
  misc_feature 121: n=a, g, c or t
  misc_feature 123: k=g or t
  misc_feature 405: n=a, g, c or t
  misc_feature 551: n=a, g, c or t
cctactgcaggcgcggggagctgcctttccgcccctccgcctgctttccaagcctggactcttaggagtggctgaagctgcggasgcttttggagcctgtgaatgaaccctcctcctcynncktcttccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgccntggcaacgccgaacccagtcgcgcagctgcagtgaattttccccccaaactgcaataagccgccttccaaggccaagatgttcataaatataaagagcatcttatggatgtgttcaaccttaatagtaacccatgcgctacataangtcaaagtgggaaaaagcccaccggtgaggggctccctctctggaaaagccag

SEQ ID NO: 12750 - DNA, 378 bp, Homo sapiens
agagtttacaaaggtctaggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctggtaagaacttaataaaggctacttctcaagaaaatgagtagtat

SEQ ID NO: 12751 - DNA, 258 bp, Homo sapiens
agaagcgccgagagcgcggccgggacggttggagaagaaggcggctcccggaagggggagagacaaactgccgtaacctctgccgttcaggaacccggttactttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccc

SEQ ID NO: 12752 - DNA, 381 bp, Homo sapiens
  misc_feature 135: m=a or c
  misc_feature 328: m=a or c
aaaaaccccacatggattcacacgcatctggtagcttggttgttgcaattccgaagctgggccttcactgagagcttgcatctctgcataaactgcctctgggctttgggacctgctttagcttccaggagctgmtcttcaagaccacattcctccccagagcagccctgtcaacatccagggacagatgaaagcccgagtatgaagacctgaccatctcccccgaaatcaggaaactctgaagagcattctagctccaaagattcctgtgggttggctggggctgtccttggacctgtagtacagcccaggtcctcccactgcccamacccgctcttgcctcctctcttacacaggtgttggtctgagggcacttgtaca

SEQ ID NO: 12753 - DNA, 264 bp, Homo sapiens
ctaattgacatagggacatgcatttctgcttcaccaaagtccccaccaacccctattgtcttccatctatttcacttactcctatttctggcatggtccttgtaggcatttgagtttgccactcatggatagggcctggcatggcaaactgcctggaccttccgcactgctccctaccatcaccctccaatcccagttcctgggagggaatccgggtctcattccacccatttctcctccccagcaccttccccagttcctgcc

SEQ ID NO: 12754 - DNA, 78 bp, Homo sapiens
gttacagcgcttaactggaaactgcgatttagtttttggtgaaaggagtggaaaaaaaccatgaactgacctaccctg

SEQ ID NO: 12755 - DNA, 430 bp, Homo sapiens
  misc_feature 401: r=a or g
ccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatrgtgagaatcctgtgttcccacttcagtga

SEQ ID NO: 12756 - DNA, 181 bp, Homo sapiens
  misc_feature 59: s=g or c
atagagccctcagtgggatgagggtgaaactgctattgccggcggctcctgttttaccscgtcagcatgctggtgcatttatttcgggtcgggattcggggtggcccattcccaggcaggctgctaccgcccctccgcttccagacattctcagctgtcaggtactctgatggctaccgca

SEQ ID NO: 12757 - DNA, 503 bp, Homo sapiens
aagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggactggtacccagtgatccccaccccaggatcctaaatcatgacttacctgc

SEQ ID NO: 12758 - DNA, 445 bp, Homo sapiens
  misc_feature 206: r=a or g
  misc_feature 208: y=c or t
  misc_feature 397: m=a or c
  misc_feature 405: n=a, g, c or t
  misc_feature 410: s=g or c
  misc_feature 437: y=c or t
aagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagraycagactagaaactgctggcagaactacctggacttccaccgctgtctgaaggcaatgaccgctaaaggaggcgatatctctgtgtgcgaatggtaccagcgtgtgtaccagtccctctgccccacatcctgggtatgtgcctcctgccagggcccttgggatgctggggtggggtcttagcagaggggmgtgtggangcttsgtgggagctcatctgtgaggggcagayggaggaca

SEQ ID NO: 12759 - DNA, 298 bp, Homo sapiens
aagactcccgtagtccccacctctctcagcttccggctggtagtagttccgcttcctgtccgactgtggtgtctttgctgagggtcacattgagctgcaggttgaatccggggtgcctttaggtgagtgtggagggttctgtaacctgggaccccagtctagcgggctgaggagccggaccccagcttccctgagaacgggttgaggcttccggctggcggcgtccggcctccctggacccctacacaaggacagaaccctccacccctacccccaaccctcagacagacttatacac

SEQ ID NO: 12760 - DNA, 236 bp, Homo sapiens
  misc_feature 74: y=c or t
acgtgtcggggaggagccgggcgcggaggtacgctgagtggagctcggggctgcgtaggggagctgagccgagyggctgggcgggcctggccgggccagcggaggggagacgtcggttgagcggcggcgaacatgcgcttttgacacattggaggctttaaaggagaagctagagcatcaatatgcacagagctataagcaggtctcagtgttagaagatgatttaagtcagaccc

SEQ ID NO: 12761 - DNA, 284 bp, Homo sapiens
  misc_feature 129: s=g or c
  misc_feature 140: y=c or t
aattcttcgagtatgctgctcttgctctaagacgctcatacattggagtcacagcttcgtaaattaaactggaaatagtttgcagacttatcagtcttctgacctgcagcagtgtctctgctatgtttsagatttttgtyttggatggtgaaagctagcactccttacaagacatgacagcaaaagattcttcaaaggaacttactgcttctgaacctgaggtttgcataaagactttcaaggagcaaatgcatttagaacttgagcttccgagattaccagga

SEQ ID NO: 12762 - DNA, 526 bp, Homo sapiens
  misc_feature 31: s=g or c
gcttcctcggctccagcctccgccggcggasccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagcc

SEQ ID NO: 12763 - DNA, 561 bp, Homo sapiens
  misc_feature 253: s=g or c
aagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaagctagatcccaagattgctgtggctgcgcagaactgctacaaagtgactaatggggcttttactggggagatcagccctggcatgatcaaagactgcggascacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggat

SEQ ID NO: 12764 - DNA, 117 bp, Homo sapiens
tgagtctcaaactggaatgcctttgaagacagatgcttctatagaggttctttgacctaaatagttcagcatttgtatttttattctggtatctaatcagattcctaatcatagccc

SEQ ID NO: 12765 - DNA, 116 bp, Homo sapiens
gtccttggcgccgtagtggttaggttgagccctaggcgtgggggagaactggggaaactggaatttcccgcggagtgacagcgcttgcgctccccctactcgttctaattccacgc

SEQ ID NO: 12766 - DNA, 198 bp, Homo sapiens
actccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcga

SEQ ID NO: 12767 - DNA, 126 bp, Homo sapiens
aaactggattccatagggaaagcctgcaaatcacttctattttagcaaggagaaaacagaatctccatccagcagggtccacccctctctctttctccctctcctctctatctctctttccccacc

SEQ ID NO: 12768 - DNA, 167 bp, Homo sapiens
aactcgctctctgcctcctctaccctccctccctctcttttctctccgcctctccagcgttctagctgactgcagagctcttagcagccagatggactcagttcccagtgaaaggacagggaggaggagatggtggattgggagggggtaaactgggaggaggtgga

SEQ ID NO: 12769 - DNA, 439 bp, Homo sapiens
  misc_feature 73: y=c or t
gtcagtcttggctggcagacctgtactccgtactccgtacttcgtagtcgcagcggcgcggtcttcggcagtytagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgtttctacagcagcaatccctagatgctggagctagagggg

SEQ ID NO: 12770 - DNA, 311 bp, Homo sapiens
  misc_feature 23: s=g or c
  misc_feature 65: n=a, g, c or t
tgctttcggcttgctcggcggasaagatggcggacatctccctggacgaactcatcaggaagcgncggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccag

SEQ ID NO: 12771 - DNA, 413 bp, Homo sapiens
agatgccatccaggcgcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaaggcctggatcctcctggaatccctgatccctgttgctcctggcggagttttctagtcc

SEQ ID NO: 12772 - DNA, 455 bp, Homo sapiens
  misc_feature 306: s=g or c
  misc_feature 360: s=g or c
ccctacctcccatcctttgcccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcscatccctggccgctggcccgggaccgaagccacttgagcgagcagagagtcgtsaccttgtcttctttgccttcagggagctgctaagaaggacaaataagatagcagagtgaaagagcttttgtctccttagaaggaaggctgagaaa

SEQ ID NO: 12773 - DNA, 496 bp, Homo sapiens
  misc_feature 5: w=a or t
  misc_feature 438: n=a, g, c or t
  misc_feature 468: k=g or t
  misc_feature 480: s=g or c
ctctwcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggnagaagcgaggggcacggcgctgagacagakctggagatgagscagaccatggcactac

SEQ ID NO: 12774 - DNA, 277 bp, Homo sapiens
  misc_feature 139: m=a or c
  misc_feature 155: m=a or c
  misc_feature 201: m=a or c
acttaacatgacgcccacgatgtgcaggcactgttctaagcattttacatatgtaaactggttaatcctcatcacaactccatgagtttcctggttgaaggattaattatctgctacctgatctaaagttgataaatgmaaaacatcagtattamcacatgacatggaaaaaacaccagaggagaaaaaaccaccaaaggmagaaaaacaaaaactgtgaacagtgatgtctcaccgggggtgggagcacagcagcagacatttgtcaaaactcacc

SEQ ID NO: 12775 - DNA, 294 bp, Homo sapiens
caaggtggacatcaactgtgaggacatggaggacgggacatgcaaagtcacctactgccccaccgagcccggcacctacatcatcaacatcaagtttgctgactagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacg

SEQ ID NO: 12776 - DNA, 409 bp, Homo sapiens
  misc_feature 168: k=g or t
  misc_feature 353: m=a or c
tatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtktaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgtgttgtttttgagatttgtcatttaaggtmcagtgcacacttgatcatatttcattactatctctaacacagtcctaacatctcaa

SEQ ID NO: 12777 - DNA, 372 bp, Homo sapiens
aagaatatgaggaagtcttcttccttcgcgccttcttcttccttacgctccagggcagcctgacagagccgctcgaaggctctgctggccgcggctagccggtttacccattccactggacccagccaccacgcgctcctgctgtctgggtgcagcagaagtctcaggtagctgagaagttcatggaatcttcttatttgctacacctttcactactgcttgtgatatagtgcagggttgggatgtgcagacatttctcaagtgcactgtgtacctacacagcatgctgcaatttggctactgaagtcaagagaaactggtttgaacaactactgagtgtaacataggaagcgcatttcatttgataacagg

SEQ ID NO: 12778 - DNA, 508 bp, Homo sapiens
  misc_feature 432: w=a or t
attggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggtgagtaaaactttttttagaaatttttaaaaatactttgattcccttggctacaagtgatgtcttctcttggaagggaagaagttacattaatattgaccatcctagattcccaagaaaaattgtgaawgaattatgatagtcaaaacctttctggctgccttagaaagtacccacccaattttccaaaataggcggggctactg

SEQ ID NO: 12779 - DNA, 276 bp, Homo sapiens
  misc_feature 16: s=g or c
  misc_feature 18: n=a, g, c or t
gagtgcgcaacgcagscnaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcacca

SEQ ID NO: 12780 - DNA, 457 bp, Homo sapiens
  misc_feature 134: r=a or g
gaacattttggtctttgtccgcggttaatatgatcctctgttgaagcaagaagacaaactgtatggtggagaaagaagtgggaaggatctgcgcggaaggcctgagaagatgatgcacagatagaaggcaccarggacttaagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactg

SEQ ID NO: 12781 - DNA, 204 bp, Homo sapiens
ctttcgatgtcgacgggaggaaactgtcacgcaggccaccaaccggcggtggagggcgcggtgccgagtcctgccactgcagggtcgccccgctggctcaagctctagaagcgtagacctccccagccgcaaaaagcaagtcacgcggcgaaaccgcggactcttttgacccttccgagctaccatttactttccatagagggg

SEQ ID NO: 12782 - DNA, 251 bp, Homo sapiens
  misc_feature 21: s=g or c
atcccgcggaggagcgcgcascccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaagg

SEQ ID NO: 12783 - DNA, 180 bp, Homo sapiens
  misc_feature 69: s=g or c
  misc_feature 72: r=a or g
  misc_feature 74: m=a or c
  misc_feature 80: m=a or c
  misc_feature 157: m=a or c
aagaggctccacgttgggcggggatggggcctgaaactgtctgggtctgagctggggagcggaagccasttrtmcctctmcctccccaggacttctgtgactcctgggccacagaggtccaaccaggctaagggcctggggataccccctgcatggmccccttgcccaaactggcagggg

SEQ ID NO: 12784 - DNA, 252 bp, Homo sapiens
  misc_feature 50: s=g or c
  misc_feature 52: n=a, g, c or t
  misc_feature 179: y=c or t
aaactgtgcgaaccagacccggcagccttgctcagttcagcatagcggasgnatccgatcggatcggagcggatcggagcacaccggagcaggctcatcgagaaggcgtctgcgagaccatggagaacggatacacctatgaagattataagaacactgcagaatggcttctgtctcayactaagcaccgacctcaagttgcaataatctgtggttctggattaggaggtctgactgataaattaactcagg

SEQ ID NO: 12785 - DNA, 361 bp, Homo sapiens
tcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtga

SEQ ID NO: 12786 - DNA, 126 bp, Homo sapiens
ttgttacctccttgggtatgtacgcctcgcgaggtctctgaacattagattttggagtgccagacaaactgtgttttacataatcgtgtggactttgccaggtaagaaatgactgtgctttcaggg

SEQ ID NO: 12787 - DNA, 293 bp, Homo sapiens
  misc_feature 11: m=a or c
  misc_feature 244: s=g or c
ttataaaagamaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgastcttcctgcctttgcttcactttatccctgcctttctagactgaaccaa

SEQ ID NO: 12788 - DNA, 277 bp, Homo sapiens
ttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtag

SEQ ID NO: 12789 - DNA, 341 bp, Homo sapiens
  misc_feature 319: r=a or g
  misc_feature 334: k=g or t
ttctgccttctaccatatctggcattttcaagtcctgatccctttgaggctctatgtggtagattaggtcctcctcagctgttaggttcctttgtgtacactctaaattgaaactttttatttacttctctagaactgtgtgttgaaatcattttcttgctgatgactctactcctattttatatagttgtgtttggtttcctcccttacagtaattttaatataagaatctagaagaagataaacttgtgtgcttagccacattgaactagaagtctctgttagccatgtttaaacttacttagttgtagtatagtgrtagaactggccccckgctttaa

SEQ ID NO: 12790 - DNA, 327 bp, Homo sapiens
tagcagtctgcagggtgcttccccctggctggctggagaagccccatgtgccgagcctggtccgaggtcctctgagcccccacgtcgcctcgctaagttgctgtgccctgaccccagtgtgggaggggccatcagagcacatgtgccttctacttggtgagggcggcattatcttggggatgcaactgcaataatcaataaacttagaaatatttcggatgaattaactgagaacgcagtgcactcactggcatggccacctgccttcacctggggcgtgcctccggccctggcaccgctctgccccacccagttggtggaatcata

SEQ ID NO: 12791 - DNA, 294 bp, Homo sapiens
  misc_feature 37: s=g or c
gtgtttggagctggagacggcctgggtgctggcgaasggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacaga

SEQ ID NO: 12792 - DNA, 161 bp, Homo sapiens
tgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacagacc

SEQ ID NO: 12793 - DNA, 399 bp, Homo sapiens
  misc_feature 29: m=a or c
  misc_feature 385: k=g or t
atcttgagagaggcagggctggcctgggmggagtgcggggccgacatctgcggagggttaggaggggaaaggttttttctacccgccggctcggcgaccaggctgaaacttatgtttgaatttagtgagccgtttgttcgttagtccggaacactagcgcggtaggccaagctgcgaggaggcggcgaaatcagcgaatagcaaattataaaagaaacaaggctttatctcctaggccctctaaagcatccccaggagatccgtatccccgttttggagagaacgctgaagctcagaaaaactcagtggaaagcggcagacccaagcctcctcgccaagtctgagtgaccgtgaagccctggtttttccttctttttctttcttkttgtactttttttt

SEQ ID NO: 12794 - DNA, 129 bp, Homo sapiens
  misc_feature 94: w=a or t
tgaacattcagataagtggattttcaagtactggttggggatgggaatcgtgcttttctttaaacttcagtttacgagatgctttgagagcgtwaggcaaaagcagaaataaatatcaggagcaacggg

SEQ ID NO: 12795 - DNA, 171 bp, Homo sapiens
tcttgttttgcgaaatccagcccctagaccaagtagattgtttgtgggtaggccagtaaatcttagcaggtgcaaacttcattcaaatgtttggagtcataaatgttatggtttctttttgttgtattaaaaaaaaaacctgaatagtgaatattgcccctcaccctccac

SEQ ID NO: 12796 - DNA, 389 bp, Homo sapiens
  misc_feature 137: r=a or g
  misc_feature 139: k=g or t
  misc_feature 196: m=a or c
  misc_feature 197: s=g or c
  misc_feature 231: m=a or c
  misc_feature 277: m=a or c
  misc_feature 305: m=a or c
  misc_feature 351: r=a or g
acagtccctggaggacagcattctggagtggccacatgagttggaaacttccatgccgaagccttaagagccagcttgcagcattcctgaaagtgtagccacctgctccaatacagcgctcatcacccaacatgctrgkttgattgaagccacagctgaagaccaaggcagagctggtccaaggaattgtgatgcmsgcacaaagaacatctgctgtgaacaacctgctcmaaaccaccagcatctctgactaaatgaccttcgaatcctccagcamaatctcatctcactctgcagccattcamatcttcaacgggcagctctgaaaataaagcccaagtcttcccccargcctcggcacctccctgggatcctcccctggccacctc

SEQ ID NO: 12797 - DNA, 326 bp, Homo sapiens
  misc_feature 148: k=g or t
  misc_feature 153: k=g or t
gtcagtctactgggcgctataggaagggcgcacgcacgaaacttcctccgtcccttgcatcctcagggccctcccagcaggacgactgagcaaggccttggaagaccggagagattggagcgctacattattgagcagggggtgtgtkatttkgttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcg

SEQ ID NO: 12798 - DNA, 191 bp, Homo sapiens
atatacacattctgtcccatgtatattctaatcctcactcaaaccacccaaccacctcatacctatgtacacacacccacttcccactaaacttcctgatggcaagagcaaggactagagagggcaaggacatcagggcccgctaatataaatgtaactatctaatagatcaattccagaaagataacagg

SEQ ID NO: 12799 - DNA, 49 bp, Homo sapiens
ctcagacagacgaacttcaaacttcggtggttctgaaagaaagaaaggc

SEQ ID NO: 12800 - DNA, 186 bp, Homo sapiens
  misc_feature 39: r=a or g
  misc_feature 101: s=g or c
  misc_feature 112: w=a or t
  misc_feature 113: s=g or c
  misc_feature 120: r=a or g
  misc_feature 127: r=a or g
  misc_feature 130: n=a, g, c or t
ccctcgccttcctctttccgtctcaggtcgccgctgcgragggagccgccgccatgtctgcgcatggcagccatccgcagggccagcgccatcctgcgcascagaagcctgwsatggttraagaagraancggacccgccccaccaagagctcctgagccccctgcccccagagcaataaagtcag

SEQ ID NO: 12801 - DNA, 391 bp, Homo sapiens
  misc_feature 321: w=a or t
  misc_feature 322: w=a or t
ccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcagccgaggactaaaatttgagagactgaattaagtcttggcttaaatttgggggaaattttgacattggaaagatacataaattcacactttgcctcctcttacccagtttcaaatatacagcaacgataaagtaaaaatgagacaacaatgaagtttcctawwacagcatgcatttctcagtgggccacaaatggactttggagtgaatattttgtaaaatggagaagtatt

SEQ ID NO: 12802 - DNA, 140 bp, Homo sapiens
  misc_feature 39: r=a or g
ccctcgccttcctctttccgtctcaggtcgccgctgcgragggagccgccgccatgtctgcgcatctgcaatggatggtcgtgcggaactgctccagtttcctgatcaagaggaataagcagaaggaaaccgagatgctc

SEQ ID NO: 12803 - DNA, 476 bp, Homo sapiens
  misc_feature 307: y=c or t
ccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaagtgctccgcttgagggtttttttgtacagtttcgggtccttgatggacagagagcccatctctttgttcagcgacaggtcagtggagagattggtaccatagtccatgctctcagaggtgcagaggctgctgcagtccgagtccctcttggaaggccctggagcygcctgggcaggtggctccaggctgccattggccagcttctccccacccaaggtctccagggcgctgctgttgggccggctctggctggccttttgagatctgttggctgctgggctgaggtccccaccctgctcagcaacttgcttctcctgggctacctgaattccaa

SEQ ID NO: 12804 - DNA, 341 bp, Homo sapiens
  misc_feature 297: r=a or g
  misc_feature 312: r=a or g
  misc_feature 314: r=a or g
  misc_feature 316: m=a or c
atgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgctttrcgggaaagggttggrargmagcaggctgtaagcagcctggagca

SEQ ID NO: 12805 - DNA, 510 bp, Homo sapiens
gtaggggctggctagccgccatcttgcttctttttctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgctccacctgctaacctcccaagtcttaaagcagaaaacaaaggcaatgatcctaatgtaaca

SEQ ID NO: 12806 - DNA, 463 bp, Homo sapiens
  misc_feature 282: n=a, g, c or t
  misc_feature 283: r=a or g
accctggcggggccagcaagtattagtaagtgctgagtaactattgggagcatgaatggattaatgagcaaatggtcaaaaatcatgatgtgaccatccctgattccgttccaccatgcagcatcattgaaggaatgaacgatgaagtataaatcacagcaaggagcccccttctgaactttgaaagctcctttccatcctataaggacaaaaaatgtcaaaattatcatgtaggctgctacagcaaaataccttacagtgggtaatttataaacaacaganrttatggctcacagttctggaggctgggaagttcaagatcaaggtaccagcggattttgtgtctggtgagggctgtttctcataggtgatgccttctgtgtatacatggtggaaagggtgacaagcttcctctagcttcttttgtaagggtcttatcccattcgtgagtgtacagacctca

SEQ ID NO: 12807 - DNA, 110 bp, Homo sapiens
ggatcgtggtggctgcgcgcgaggaccctgaggtagattgggtggtttcaacaggaacgcatccactgtctgagagtttaaacttgattttgtgaggggacgaacagcgt

SEQ ID NO: 12808 - DNA, 212 bp, Homo sapiens
gtcactgggaacaaaggctctggaaagtcgacagcaacggatacggagacgtgaaggttaccctggacgggcctttctgtgcatcgcaccccagactaccccctttgctcactcaattcctcctctccaggctaaacttgctctctgccgtcaatgtccattctttccctggtaacctctcgcccacgtcccgcagagcccacgctcttccc

SEQ ID NO: 12809 - DNA, 489 bp, Homo sapiens
  misc_feature 191: s=g or c
  misc_feature 195: r=a or g
  misc_feature 207: k=g or t
  misc_feature 297: r=a or g
  misc_feature 298: s=g or c
  misc_feature 319: n=a, g, c or t
  misc_feature 337: w=a or t
  misc_feature 412: m=a or c
  misc_feature 429: r=a or g
  misc_feature 462: r=a or g
  misc_feature 464: r=a or g
  misc_feature 466: y=c or t
gaattcataagtctgtgcctgcggcactgcgtagacgcggggagttcggtatcagtttacacgttgccttcagtaaaatccgccagaggtccacccattttgccttttccccttccttgccctgggagaaatcctcccttcactgggagagaacttctctcccagggcggtgcgacccggagctccagcgsccgrgtctccacttcktttgctgaaacttgctttctaccagctaagaaccatgctgcgagtgattgtggaatctgccagcaatatccctaaaacgaaatttggcarscggatcctattgtttctgtcntttttaaggctgctgacwctggaacaatcctgtgcctcctgagggcagagaggatccatggtcccaggcttggcctcaagatgagaaaaagamaacaaagaaagttgatratgaattgaaccctgtctggaatgagattttgrartytgacttgaggggtataccactgg

SEQ ID NO: 12810 - DNA, 65 bp, Homo sapiens
  misc_feature 63: k=g or t
tatagacatgaataaacttgtggttagaaactttaggtgacctgtcaaaggtcacctaaagtktc

SEQ ID NO: 12811 - DNA, 299 bp, Homo sapiens
  misc_feature 160: k=g or t
  misc_feature 265: r=a or g
  misc_feature 293: w=a or t
catttcttacaaacttgttacaaaccagtcattgtagggctaagaaatctgggataaagttaaattaaaaattttgtattttccaaaattctgcagaaaacttaaagacattttcttacatcacagcttagaggccaatttccccttttatatcttgtckaataactctccattattagaaagtgcagaaaaaatgcttttgatggctttcgggcatgtttgtgtaatactttattaagtgccatctgcctttgctttattaatrttttattaagggccatctggttgttgcwaccgat

SEQ ID NO: 12812 - DNA, 157 bp, Homo sapiens
  misc_feature 122: n=a, g, c or t
tgagtcaggaaatctgggttggatgtgaactccccacttagcattatgggatgttaggtgagttatttaacccatctctgctttatacccttatctaataagaaaataataatttatcagcnttagaaacttgttaccattaattcttaaatgtgtc

SEQ ID NO: 12813 - DNA, 375 bp, Homo sapiens
  misc_feature 297: m=a or c
  misc_feature 361: r=a or g
aaagtaaagcggaggcagcgggggaagatggcggcggccgttccacagcgggcgtggaccgtggagcagctgcgcagtgagcagctgcccaagaaggacattatcaagtttctgcaggaacacggttcagattcgcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttmtgaaaaagggagataaaccaactttcccaaaaagggagatgttgttcactgctggtatacaggracactacaagatgg

SEQ ID NO: 12814 - DNA, 106 bp, Homo sapiens
gacaaactttataatattatctcttgactccactatttcactcttaatccagactagagctgcccacactttcaaggtatcatcaaagactcttatctcagaataa

SEQ ID NO: 12815 - DNA, 117 bp, Homo sapiens
taagatatgtaattcgtagagagacataatagaaactttatcttttgggccagtaggaggaagtgctcttttactttccctctagcccacactactagtctagcctcacagtcctta

SEQ ID NO: 12816 - DNA, 340 bp, Homo sapiens
  misc_feature 128: n=a, g, c or t
aaatacaaaaattgtttagctctgtttttcataatagaaatagaaaaggtaaaattgcttttcttctgaaaagaacaagtattgttcatccaagaagggtttttgtgactgaatcagcagtgcctgcnctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgc

SEQ ID NO: 12817 - DNA, 310 bp, Homo sapiens
aatcgaggggagagagagttacttgatgggcctacaggtgaacttgtgactggatcactttaatcaggatgttttaatcaggataactattaaactttggacttccagtaagctcagagacttctagagttagaaaattccctgctgtaactggtttgtatggttttccccatccatgttggtaggtcagaaatggaatttgtgtaactgttagtattacagatatttatgttgttgtgtgcagtacttaaatttaaaagaaaaaggaagttgattgattgtccttaatgaaaattagaataaggaagtg

SEQ ID NO: 12818 - DNA, 198 bp, Homo sapiens
  misc_feature 31: r=a or g
cagctactagaggacgcccgttccaatggcractctgccaaggcgcctatgagagcctcttggcttttacctggtctgcgagaaatcaaactttgggcacaagtcatgaagccgaccaagcccgggagacacagtgtcagaattacaaggtgagatcagccgcccggccaagctatcttctcgctagcaggtcccgca

SEQ ID NO: 12819 - DNA, 142 bp, Homo sapiens
  misc_feature 106: y=c or t
  misc_feature 107: w=a or t
agtttgctccaaactttgtttatgggacagtccgggagctgctgcggccgcgctgtctgcttctcctgcgcctccttttcgcccagcactagcgccttaggccagywcgggggatgtgagagccgaagcccttagactgcca

SEQ ID NO: 12820 - DNA, 125 bp, Homo sapiens
  misc_feature 50: k=g or t
agagggtataggccgcgagatggggaagatggcagcggccgtgggctctktggcgactctggcgactgagcccggggaggacgcctttcggaaacttttccgcttctaccgtcagagccggcccg

SEQ ID NO: 12821 - DNA, 362 bp, Homo sapiens
tctttgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttggg

SEQ ID NO: 12822 - DNA, 213 bp, Homo sapiens
atgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctg

SEQ ID NO: 12823 - DNA, 244 bp, Homo sapiens
tcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattaccttgagggaggggtctgtgcatctttcttaacccttttcctggc

SEQ ID NO: 12824 - DNA, 270 bp, Homo sapiens
  misc_feature 43: s=g or c
  misc_feature 44: r=a or g
  misc_feature 72: r=a or g
  misc_feature 105: k=g or t
  misc_feature 106: n=a, g, c or t
  misc_feature 110: y=c or t
taatcgctaatcccttagacaatgttttcccaaaatttcaggsrgctattctatcaacaaactgataattaracttgtgtcacatctttgatattctgttgtatknattytgtggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttctttttttttt

SEQ ID NO: 12825 - DNA, 333 bp, Homo sapiens
  misc_feature 121: r=a or g
  misc_feature 125: m=a or c
  misc_feature 128: s=g or c
  misc_feature 130: r=a or g
tcagtcctttctagtgtcagttgcctacagaggcctctgttgcactttttactccacgattgaaacttttttagaatttactgatcccatgtagcatcttggatattagactctgtttaargcamtasargaatacttacagaaagcatgaagctgtgattttgaaccactgctcatggttgggcctgaagttagaggaatggttatgagcgcacttattcagagcggtagcctcagcaccagcactcttacaggtgcaccatgatacttttaatcagtgggcaatatttgtcaaggtcccactgtgccatagccttgcttagtgctgtaggt

SEQ ID NO: 12826 - DNA, 131 bp, Homo sapiens
aaggaggaaaggcagagagcaataaggtctataaattaagacatccaaacttttttgtggtgaaagtttgttgtgtttatgggaatcagcatatcggaggattaagtgagggaaagaaacttgtgatggca

SEQ ID NO: 12827 - DNA, 478 bp, Homo sapiens
  misc_feature 122: k=g or t
  misc_feature 382: n=a, g, c or t
  misc_feature 406: s=g or c
  misc_feature 410: m=a or c
agtcagttggcagcggcaagcgcgctgcggttccggtggcgccatgtcgttctgcagcttcttcgggggcgaggttttccagaatcactttgaacctggcgtttacgtgtgtgccaagtgtkgctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcncagggtcactaggcgggcagccasaccmaccccagacggccaccacactgaggccacacgttggccattccaccttggagttggaacctgggcgtc

SEQ ID NO: 12828 - DNA, 314 bp, Homo sapiens
  misc_feature 281: m=a or c
  misc_feature 282: n=a, g, c or t
  misc_feature 285: n=a, g, c or t
tcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattggamntanccacatccacaaagcacaccattaatcca

SEQ ID NO: 12829 - DNA, 189 bp, Homo sapiens
  misc_feature 144: n=a, g, c or t
  misc_feature 145: k=g or t
  misc_feature 149: n=a, g, c or t
tttaattcattggtttctagtatattcacaaagttgtgcaaccatcattccacaatttcatcatcttccaaagaaagcccgtccctgttagctgtcatgcctcttctctcttcctccagtacctggcaaccaccaatgtgcttnkctgntacacagatttgcctatctggacatttcacataaactcgt

SEQ ID NO: 12830 - DNA, 121 bp, Homo sapiens
  misc_feature 2: w=a or t
cwgacataacaattcactggactgaggagcttgctttatagcaaagaaagtacgagagtgggcacataaccataggacctactagtcccactatgtactgcatctccagaagcttttagcc

SEQ ID NO: 12831 - DNA, 565 bp, Homo sapiens
  misc_feature 391: m=a or c
gaggacctgaacaagtccagaagggaagagatttgtccctctatccaacagagtacccagtgagcagcacagagggcacagcaagggacatcacccggttccccaaatgctcagagccacaagtgaagccaaaagtgaaagacaagatgcagaaaaccgccacgggcctttgaggaagggtaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcmcggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctagtgagactcccgag

SEQ ID NO: 12832 - DNA, 217 bp, Homo sapiens
aggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagcatttgacattgtgcagcaaagaaatggttatggagaagcccagtccgctgcttgtagggcgggagtttgtga

SEQ ID NO: 12833 - DNA, 147 bp, Homo sapiens
tttatatacaatataattcacttagtttacaattgtatagactttgataaacatatttttgataaatgtaggactgtgtggccaccacaaatatcaatcataaagaacagtttcctcccctctccaaattttcctgcgcccattccc

SEQ ID NO: 12834 - DNA, 271 bp, Homo sapiens
tgaaagaaccagataaatttctaattatattagagattaatgaggcatccttgtgccaactcatatttcattgttgacatcctacagatgagctactcctgagactaaatgaaaacagtctagatgtcagatgctccagggtgcttgaacagagcattaaagtttaaattgtataatgaatgataaagcaatgtagaaaatgtgggttgttaaaactgttcatatgtggccaggcatggtggttcatgcctgtaatcccaccacttagaga

SEQ ID NO: 12835 - DNA, 259 bp, Homo sapiens
  misc_feature 135: n=a, g, c or t
  misc_feature 136: n=a, g, c or t
agtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtnntcccctcactgcgtttttttttccttttatccaaagaacggggcagttagtacgcttgccttcctgtcgcccggttgggagcggggttggtgtgcggagtggttcgcctttttttctttagaa

SEQ ID NO: 12836 - DNA, 343 bp, Homo sapiens
  misc_feature 138: y=c or t
  misc_feature 282: k=g or t
attgctgaatactattgacgtttgccaagtcttctttgatattactgtaaactttgatttaacaaagaactacttagatttaattataacctatacaacactaatgatactgctgtctcgaattgaagaaaggaaggyaatcattggattatacaactatgcccatgaaatgactcatggagcaagtgacagagaatacccacgccttggccagatgattgtggattatgaaaaccctttaaagaagatgatggaagaatttgtaccccatagcaaggtaakaggcagttgttaggcatatgagagaatgggcatataacatagcatgaggatggatggttgg

SEQ ID NO: 12837 - DNA, 345 bp, Homo sapiens
aattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtg

SEQ ID NO: 12838 - DNA, 287 bp, Homo sapiens
aattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcagggaaggagaattacttgaacccgggaagcagaagttgcagtgagccgagatcacaccattgcactccagcctgggcaacaggagtgaaactccgtctcaaaaaaaa

SEQ ID NO: 12839 - DNA, 364 bp, Homo sapiens
caagaagttctttagagacaaggagaataatataggttagaaactaagatctacataaagaaaggaggataatcagaaaaggaataagggaaggtaaaatcaaaatgtatttttctttatttttaagatgctgcccaggctggagtgcaatggtgtgatcttggcccactgcagcctctgactcctgggttcaagtgattctcttgcctcagccagttggctggaatgcatcgaaggagggcacaaccccctcccaaaacaatgccttcttcaacagcagctcttgtagcattaagggcatctgtaactctgcctttcattaaatgtaaccttttgccaaattaaagaactccatgccactcct

SEQ ID NO: 12840 - DNA, 244 bp, Homo sapiens
tacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtg

SEQ ID NO: 12841 - DNA, 244 bp, Homo sapiens
ttttttccgcgggccccgcccaggcggctgcccgtgacctgcctgggcgcggggaactgaaagccggaaggggcaagacgggttcagttcgtcatggggctgtttggaaagacccaggagaagccgcccaaaagaactggtcaatgagtggtcattgaagataacaatggaaaaggaagaacaaggtcttgaagggacagcattgccagctgctgctgagtcacagatttcattataaatagcc

SEQ ID NO: 12842 - DNA, 200 bp, Homo sapiens
attctgtctaaagaactggtccagccataccagctccttcactaccaccgagcgcacccactctctggacaatcaccacctccaaggtcgtcactgctacatcaccacacccctgctcccagggtgagtgcttatttcacagggtttcttgttagaatgatgctttcccagtgaactctcaggttccattcattagcagt

SEQ ID NO: 12843 - DNA, 468 bp, Homo sapiens
  misc_feature 124: k=g or t
aagtgctcagacattaagccgttgagtagaggcatgttttgcaatctctcgtttagctaccaattggagcagtttaacgtgcttgagtccccggcgtgatgtgttcatggacgaagttgccgakggatgttgtcaggtgttgcacctggagggcccagatggatcaatgaggcatttaaagtgtagaatctcaccctgaacccagactattcaggtccgtttttctaggaaagttatttctttttcacttttagattcaagtgctcattttcttcttcaaatttagagcacttcagtatgaacaatatttcttttgttaaaaaatatttcttggaaacaacttattgaagtttcctcagagtggccaaagccgatgataattttattccagataaagaactggtgacacgtggctgtacattcagcacagctgtggtgtccccaagtgccatgacccaggagccattc

SEQ ID NO: 12844 - DNA, 414 bp, Homo sapiens
  misc_feature 230: s=g or c
  misc_feature 343: s=g or c
  misc_feature 392: r=a or g
atttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaascgagcgacctgcagctgtcgaagagactgcccccctgcttcagccacaagacgtgggtcttctctgtgctgatggggagctgcctcctggtgacctcggggttttcgctgtasctggggaacgtgttcccggctgagatggattacttgcgctgtgctgcargctcttgcatcccctcggcaat

SEQ ID NO: 12845 - DNA, 256 bp, Homo sapiens
  misc_feature 111: n=a, g, c or t
caggattagaggttagccagatgaaatcaagagaggagagaggagcccccacaaaggcactgacccagggcaataacagggggaaagaacttggaggtacagaggcagacntggtgtttcccagggtgtgggacattgggggtagtaaggctggaatgggtagaggaaagggctagggtgacaccacggggtattaggtggaactgagggaaacagaaataggagcagagaaaagggaatgagaacgggaaagaga

SEQ ID NO: 12846 - DNA, 130 bp, Homo sapiens
agcacagcctttaaggttccaaacatctgctagaagaggaatgcagatttaaactgagtgaggtgtggagtgggggaagttgattgggtctagaccaaagaactttgaggaacttgcccagagcctccct

SEQ ID NO: 12847 - DNA, 357 bp, Homo sapiens
gtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccg

SEQ ID NO: 12848 - DNA, 583 bp, Homo sapiens
  misc_feature 97: r=a or g
  misc_feature 266: w=a or t
  misc_feature 267: k=g or t
tctgtgattgtgcctatgcatgatgaatgaatgcatttcaatcatacattgcctaaatcataacttgatgatgcttgggaaagaatcaacagtttaraacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggwkagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtt

SEQ ID NO: 12849 - DNA, 373 bp, Homo sapiens
ctggaggatttttgtttggggagggacggaggagcgcctggcagagcgggatcttcagggcagcgggcaaccccttggcccaggaagcctggaacgcaaggaccggaggcgtgggctgggacgcccctaccttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatggggg

SEQ ID NO: 12850 - DNA, 411 bp, Homo sapiens
aggaagggcgggtcagcgcgccggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgacttactgcagacgctttagctaacctgaaagtctcacaaatcaaa

SEQ ID NO: 12851 - DNA, 573 bp, Homo sapiens
  misc_feature 395: m=a or c
  misc_feature 435: m=a or c
  misc_feature 449: m=a or c
  misc_feature 454: m=a or c
  misc_feature 470: w=a or t
  misc_feature 471: r=a or g
  misc_feature 487: y=c or t
  misc_feature 517: n=a, g, c or t
  misc_feature 518: y=c or t
ctcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgmaagtcatctcagctgcctgaagcaggacattctaaatgamaagactgaattggmagcamcacttaaggaagcggwrttggtaacctcattcyggtagaattgcttttgccactatttaaggnyaccattgaaaagattaattttgaaaatgcgaatctttctgcattgaatttgaaga

SEQ ID NO: 12852 - DNA, 290 bp, Homo sapiens
agagttggtgtttgtgggttatttgtgaagccggaaagaagccgtgtcctggagaatgtagctgaaggcctggccactttcgacaagaacgggaaagagacgactaacttgtactaatatcttagtgcttggcagggcattttttcattccaggaaagaagagaatccagctgagatcaagggagggacgtccgacggaggcgccatctttaacaagggctatttgggaggccatcttggcgcagggcgtctttttgaaaggttacctgctagagattacgacctatcgg

SEQ ID NO: 12853 - DNA, 346 bp, Homo sapiens
  misc_feature 126: n=a, g, c or t
accagagaagtcagactccgggagtgctttaacagtttgaaggctaatctgaaagaggaagaagaatctgtatatctgtatatattggctagcaaatgtgccctgctctctcccctcttaaaaatnagcaggcaacccatctttgcaaagaagcttgcctatagagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcagcgtg

SEQ ID NO: 12854 - DNA, 443 bp, Homo sapiens
  misc_feature 212: r=a or g
  misc_feature 314: r=a or g
  misc_feature 322: r=a or g
  misc_feature 339: s=g or c
  misc_feature 375: s=g or c
  misc_feature 395: n=a, g, c or t
  misc_feature 396: m=a or c
  misc_feature 426: r=a or g
  misc_feature 427: r=a or g
agctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccaggrtcgggctgctcttggctaacgagaggagtccgaggcggcggcgaggggcgaacgacccgacgcaagatggcgaggtaaagagatgtttgaagatactgtggrggagcgargccccttccccactcastcctaaagagttatgacatagttctacctttcccastcactcctaagagttatganmtagttctaccttccttattgactcctaagrrttacactttactaatg

SEQ ID NO: 12855 - DNA, 358 bp, Homo sapiens
  misc_feature 93: m=a or c
  misc_feature 96: s=g or c
  misc_feature 171: m=a or c
  misc_feature 182: r=a or g
  misc_feature 183: n=a, g, c or t
ctttggctgcgagcgggcgagctagctgcacattgcaaagaaggctcttaggagccaggcgactggggagcggcttcagcactgcagccacgmccsgcctggttaggctgcacgcggagagaaccctctgttttcccccactctctctccacctcctcctgccttccccamcccgagtgcgrnccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatct

SEQ ID NO: 12856 - DNA, 374 bp, Homo sapiens
tgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcag

SEQ ID NO: 12857 - DNA, 219 bp, Homo sapiens
  misc_feature 59: s=g or c
  misc_feature 154: k=g or t
  misc_feature 209: r=a or g
gttcccggaagttttgctgctagtcgcggacgcaatggcttcaaggttacttcgcggastggaacgctggccgcgcaggccctgagggctcgcggccccagtggcgcggccgcgatgcgctccatggcatctggaggtggtgttcccactgatkaagagcaggcgactgggttggagagggagatcatgctggctgctcttcatcagtrggaacaccac

SEQ ID NO: 12858 - DNA, 113 bp, Homo sapiens
actaggcttgtatgctgatgtaaagaagggagttcaggctgcagctccctggtactgagtcatgaagggcttccctcagattggaccaggaaagtctggtccccagactgggg

SEQ ID NO: 12859 - DNA, 112 bp, Homo sapiens
  misc_feature 40: s=g or c
  misc_feature 43: n=a, g, c or t
tttttcagttgcacgggcgagctccgggccggctgcggasganctccccgccgccaagtgggcgggtggctgtcgggaaagaagggctggggcctgccgttcttcctcccga

SEQ ID NO: 12860 - DNA, 312 bp, Homo sapiens
agaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccaggga

SEQ ID NO: 12861 - DNA, 389 bp, Homo sapiens
atccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccagcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaaccctgcctccatctttccaagcaccggggcgaaaaaccacaaaggaaagg

SEQ ID NO: 12862 - DNA, 330 bp, Homo sapiens
gactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaata

SEQ ID NO: 12863 - DNA, 348 bp, Homo sapiens
  misc_feature 323: y=c or t
gactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggactyattatatcaaagaacagaagttggg

SEQ ID NO: 12864 - DNA, 293 bp, Homo sapiens
  misc_feature 113: y=c or t
caattgtgattttattgtaattggttgtcactgttgtacggtgtctagaattaaagaatacatgtaaactttcatggtatttagcctttcttaaatttttttaaaatttaaaytttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggtt

SEQ ID NO: 12865 - DNA, 149 bp, Homo sapiens
ttttttcggccgcggcgcgtgactgggcttggtggagtttcaagatgctgatgaacttaaggtctggcgcttgaaagaatcagtgaagcttttcaagtagaggaggtatatttgaatatgtaacctttagtatctacagaatagaggtt

SEQ ID NO: 12866 - DNA, 475 bp, Homo sapiens
  misc_feature 378: n=a, g, c or t
  misc_feature 379: n=a, g, c or t
  misc_feature 380: y=c or t
aggaccggcgccttctccttgcttctgggggtcgtggccttgctcccgctgtgcggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccgggcgcctcctctgtgacctgctgcgccgaagttttggattaggcccagttgcttcaggactagtgtctgccagtctgataggggctgagatgggtttgcagtttttcataccagtagaagtaatgtagtcatttctgaccaacgtnnytagagcactttttttttaatgccctttgcatgcacctgatacataaactgaaaacctggtttttctctagggtgtcagtataccagcactaactt

SEQ ID NO: 12867 - DNA, 208 bp, Homo sapiens
  misc_feature 11: k=g or t
  misc_feature 12: y=c or t
gactccgggakyaatccggaaggccattgggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgag

SEQ ID NO: 12868 - DNA, 149 bp, Homo sapiens
  misc_feature 106: w=a or t
  misc_feature 127: k=g or t
  misc_feature 134: r=a or g
catgggaccacagtagaccattgtaaagaatctggctcttgctctgagggaaattggaaccactgcagggttttgagaagacaaaatgcttgatatgacttacatwaagaaggacctttctggcaaktgtttgragaatagattgtggg

SEQ ID NO: 12869 - DNA, 193 bp, Homo sapiens
tgttctattttaaagaatctttcatttatattggttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccc

SEQ ID NO: 12870 - DNA, 208 bp, Homo sapiens
ggattttgaacaccttacttctgattcagtcaccgctgccaactccagagccttgcacatgtcacttgttgcagtttcttaaagaatgaagaggttgatgcgaaagggccttcctttccagttctcacatcctacacatctgtgatttgactgggtgttctttcttctcagccagttcccttggatgttagttagatcatcacacaaa

SEQ ID NO: 12871 - DNA, 218 bp, Homo sapiens
tgtataaatctgctatttgcctggagtaaagacttatttttggtaagatggagtatagtggcttcaggtgatgcctacaagagatgagatccaggcaagtgagtgagggaacagaagtagttgtatttctagggaaagaatgaatggtatggacctgacaaaggacaggcgaacaaggcctctcaggcctgggtgtagacaagtaagaaaatccaagg

SEQ ID NO: 12872 - DNA, 161 bp, Homo sapiens
  misc_feature 23: m=a or c
aatcaaaaaacttattcttccamagagagattgttattattcctcacgatgacccgacagtctctgctttctttttcctttcttccagaaggagatttaaccatagtagaaagaatggagaactattaactgcctttcttctgtgggctgtgattttcaga

SEQ ID NO: 12873 - DNA, 468 bp, Homo sapiens
  misc_feature 64: n=a, g, c or t
  misc_feature 143: s=g or c
atgcgtgcagcaaagaatggaggagtcggaacccgaacggaagcgggctcgcaccgacgaggtncctgccggaggaagccgctccgaggcggaagatgaggacgacgaggactacgtgccctatgtgccgttacggcagcgcsgcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttat

SEQ ID NO: 12874 - DNA, 474 bp, Homo sapiens
  misc_feature 13: n=a, g, c or t
  misc_feature 358: s=g or c
atgcgtgcagcanaagaatggaggagtcggaacccgaacggaagcgggctcgcaccgacgaggtcctgccggaggaagccgctccgaggcggaagatgaggacgacgaggactacgtgccctatgtgccgttacggcagcgcggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcacctttcaacaatgtataaaaacagttacacactacagcsaatagagatttattctaggtatgcaaagttggttcaagtttcagaaatcaatgtaatcacatcaattagctaaagaaaaatgtgaatatatcaataagtgcagaaacacatttgac

SEQ ID NO: 12875 - DNA, 441 bp, Homo sapiens
caatgtttttattcttttacaagacctgcattttatttgaattacccgaatagcaatatgtaaaatacaagtgacaaaatgtgatgagagcttcttgaaccggtaaactagtacaggtctgagaaagacatattagaagaaatcattatacttccttgaattatatttattttcatgtttctctaatgcaaagaatgtttcatcaaatgtatattttctgttgcttactgtttgctctgagaagaagctgctgttttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccagga

SEQ ID NO: 12876 - DNA, 158 bp, Homo sapiens
  misc_feature 7: n=a, g, c or t
  misc_feature 8: n=a, g, c or t
cctgttnntacatattactttactttgaatgtatttcatggcacttatgattttgtagcatatatgtattattttgtacccatagcctatctttcctgctagactgtcagaaggaacttaaagacaactgcacaattctaaagaattggactttgcat

SEQ ID NO: 12877 - DNA, 315 bp, Homo sapiens
  misc_feature 298: k=g or t
  misc_feature 299: n=a, g, c or t
  misc_feature 315: n=a, g, c or t
tggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaknttcattgaaatcatan

SEQ ID NO: 12878 - DNA, 133 bp, Homo sapiens
ccctttgatcacgttaatctaaatctagatgtctttgtctaattttttttgaatagcagttataaatgtaaaggactcaaagtttaagtaaaaagtgatactccaccttgtgtttcaaagaatttagttccac

SEQ ID NO: 12879 - DNA, 266 bp, Homo sapiens
acttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacacca

SEQ ID NO: 12880 - DNA, 264 bp, Homo sapiens
  misc_feature 34: n=a, g, c or t
acttacaatctgacaacacttacaatctactcanaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctaaattt

SEQ ID NO: 12881 - DNA, 177 bp, Homo sapiens
tacattttataggaaaaaatgtttttaaatgctagtcatttatataatgtgctttgaaggatttgctagtccacttctgtcactttttagtacactggtatcttttatatgtaatgtatgcttttattattgtagcaaagcatttcagtagaaagaattttgcaacaatatggggga

SEQ ID NO: 12882 - DNA, 241 bp, Homo sapiens
  misc_feature 87: r=a or g
  misc_feature 88: r=a or g
attccactcaagaatggaatcaagctccggtggaacccaaagtccatgctgttaacttctacgctgatgtgggacatgatattcaarrgcttgaaagaatttgttgccagaagagcttcactatacaagatatgttaaaggatgtccttcaggcagaaagaagatgataccagatggaaatctggatcaacacaaagaaatgaagagcactagaaatgacgcggtagctcacacctgtaac

SEQ ID NO: 12883 - DNA, 380 bp, Homo sapiens
  misc_feature 286: y=c or t
  misc_feature 331: y=c or t
gctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaacctttgagcggtcaagggaaagacaagccgactcttcagatccctgtggacacactgcctgctcttccatatcatggccctccacccccgcagagtccggctaaagccctggytggtggcccaggtggatagtggcctctaccctgggctcatctggytacacagggactctaaacgcttccagattccctggaaacatgccacccg

SEQ ID NO: 12884 - DNA, 513 bp, Homo sapiens
  misc_feature 498: m=a or c
  misc_feature 499: k=g or t
gtttttttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggcccttttcatctacctgctcttctacttccgagtgcccttcatctatggcacaaatatgactttaccmkagtcggcatacagt

SEQ ID NO: 12885 - DNA, 345 bp, Homo sapiens
atttatacattttcttgcctgctttaaagacaatctatattatttttcaagcccacagtaatgtgtaaggcctgtaatttggacacttttcagttatgtttaaggttatgagcatgtaagatactgttgaatatggaagaatatgtctaattaccactagatagcttattttgaagagataatatctaaatgtttgtccagagttgattgggtgcagtttcataggtgtgtttctcaataaattgcatccatgttttaaagcatataggaatttgaatactgtttaacctcatatagtccttgtttgtaggtttaatatttctgaagacaaaagtcatcacagcc

SEQ ID NO: 12886 - DNA, 239 bp, Homo sapiens
  misc_feature 160: s=g or c
  misc_feature 164: r=a or g
caatatataatcaaaataaaaaaacaaaacatactctctcccccaaaaaaacatctcagtggggaacagatgtatcttttcatctgaaagacaatgctgggggaagagctccactgagatgcgggcagggaggctgggctcgagccagcccctgcgttasgaarcggggagaacagataggtaactcttttacatttcctttatgatctggcacttctccccagctccttccctctgcc

SEQ ID NO: 12887 - DNA, 162 bp, Homo sapiens
gtgttgcgtaggcttgtctcaaactcctggactcaagtcatcctccttccttggcctcccaaagtgctggaatgacaggagcatgcctttgagagcagtcagaaatataaggaaggaaaattcatcattgagcttgctcatatgatcaaagacaatggcggg

SEQ ID NO: 12888 - DNA, 233 bp, Homo sapiens
ggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatctggtttatatcagttggatcttctttcaacagagaaagacacacatttcaaagtatatgcca

SEQ ID NO: 12889 - DNA, 206 bp, Homo sapiens
gacaattattctgcaatcttcctggtcctgccattaatttatttaagtcctggaagaatacttaaattggtctcaagttccatcagcaagatgggacgactccattgaaaagaaacataatatatggaaaaattactagaaaatctaggaaaactgactgaatgctttggaaagacacagtcaagattaacatgctgagactcggg

SEQ ID NO: 12890 - DNA, 235 bp, Homo sapiens
ctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatggg

SEQ ID NO: 12891 - DNA, 484 bp, Homo sapiens
actaaaaaaaagaaagaaagaaagaaaaaaagaggtttagactaaatagagtcagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaag

SEQ ID NO: 12892 - DNA, 415 bp, Homo sapiens
actaaaaaaaagaaagaaagaaagaaaaaaagaggtttagactaaatagagtcagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagc

SEQ ID NO: 12893 - DNA, 329 bp, Homo sapiens
  misc_feature 20: r=a or g
  misc_feature 21: s=g or c
  misc_feature 30: m=a or c
  misc_feature 42: k=g or t
  misc_feature 55: s=g or c
  misc_feature 72: k=g or t
  misc_feature 79: r=a or g
  misc_feature 96: y=c or t
  misc_feature 137: s=g or c
  misc_feature 158: m=a or c
acttatctgcctgcctaggrsgcaagtacmgggtgccaagckgagagcctggatsatatttcacatgtgcckgtcccaraggaattccttaactcycccttcctggaaccgaaatgcttccaaagacagagagctcstatatatatttctctgttttmcccagcggaccgtgcatgaaaggcgcctttcctggcgcgtgtgtctctgaccctgtggatcttctggacaattcccggaatttcttgcagggtagcactttcccttaagtcgtctctttctcgtttggatagtcagtatttgtatagtcactattctcttttggttagcca

SEQ ID NO: 12894 - DNA, 220 bp, Homo sapiens
  misc_feature 97: y=c or t
agggaaacttgacttcctcagactgcttccttcttataaactcttggttccttatttatcatttttcgtttttgttttttaagttgtttgacctgaytttatcatagtagttccaaatgccttacagcccagtggagtcaagctaaggaaagacagcatgatttccacaggatttgtatttcttccctctggataaagtgatagtagttcccagacccgc

SEQ ID NO: 12895 - DNA, 330 bp, Homo sapiens
  misc_feature 62: s=g or c
  misc_feature 211: s=g or c
  misc_feature 212: k=g or t
agtgacgcggcccaagggcggaagtgagaaagttgtctgcgtctcgaggcgagttggcggastgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggasktggagtcgtcacttcgggcacaagtgcccttcgagcagattctcagccttccagagctcaaggtgcaagcgctcccctcctttgacacctctcccaccactccctccctgctagaccc

SEQ ID NO: 12896 - DNA, 129 bp, Homo sapiens
gcaaaggaaaatctggctatctggcaatattttacctaagcgcagattaattggtgaaaaaattaactcttaagatggccattaataattaggaaagtttacagagtggtcttagtagaaaattcaagt

SEQ ID NO: 12897 - DNA, 589 bp, Homo sapiens
  misc_feature 128: r=a or g
  misc_feature 129: k=g or t
ctttttagggaaagtagtttttttggagctactaacttgtatttattattgtacatgcataaccagggtggtgagggcactaatcttgtaggaaacacttacttgatgttttatttgaacttttcctrkaggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatggga

SEQ ID NO: 12898 - DNA, 281 bp, Homo sapiens
tttctactttatatgtatacatttatttgtggaatgaactactacaaattataaagtgataagggccgagagcgccttacaaggtgaaatactactttaattaacttccattaacaacaggagcaagaacttcttacagaaaggggagagaggcatagaaagaaacatgcccactgggggagggaggcaggcttgagcgaagttgggcgtgggggacaggggagaagcttccggactggtgacagggacagcacagagacagtcagacatgaccaagccag

SEQ ID NO: 12899 - DNA, 258 bp, Homo sapiens
tttctactttatatgtatacatttatttgtggaatgaactactacaaattataaagtgataagggccgagagcgccttacaaggtgaaatactactttaattaacttccattaacaacaggagcaagaacttcttacagaaagaggagactaagaaaggagtgagaagggagaggaacttaagagttgatttaggggagtgcttttgttaggactggggacaggggcaggtaaagacagtcagacatgaccaagccag

SEQ ID NO: 12900 - DNA, 164 bp, Homo sapiens
caaagaccatagtttaccttagcgtttattcttgttgttgtacattctatgggtttagacaaatttagtgacatgtgtccatcattatagtatcacatggagtaggttcactgccctagcaatcctctgtgttctgcctgtttatctctcccttcccccatccc

SEQ ID NO: 12901 - DNA, 202 bp, Homo sapiens
  misc_feature 55: s=g or c
agaggcgtctgcggtgacagctcagtcagttgagctctgtgtgccaggcgctcgsgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagccc

SEQ ID NO: 12902 - DNA, 614 bp, Homo sapiens
tggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagc

SEQ ID NO: 12903 - DNA, 129 bp, Homo sapiens
tatccgagtctttgctcaagtcacatttttggaaagacctccccaacagtctatcttgaatagcccattgtcattctatctcctcactccattattattactattattatttatctcagtacttgccac

SEQ ID NO: 12904 - DNA, 394 bp, Homo sapiens
  misc_feature 10: s=g or c
  misc_feature 212: n=a, g, c or t
  misc_feature 218: m=a or c
  misc_feature 295: s=g or c
  misc_feature 296: m=a or c
  misc_feature 370: y=c or t
agacctagtsatatgcccacttttggggaccttcatttaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagcgtcccttcaaatccgtctttngtgccmactgccatagtcaaccccgtgagaagcacagccggccctgggactttaggacaagggtctcttcggaaagggcggasmgcatgagaaagagtaagtggtggcagagagcaagtcaaaaccgtgagatttcagaattacagccctcctcccaycaaacattaacacctcccatccca

SEQ ID NO: 12905 - DNA, 480 bp, Homo sapiens
  misc_feature 10: s=g or c
  misc_feature 313: k=g or t
  misc_feature 453: n=a, g, c or t
agacctagtsatatgcccacttttggggaccttcatttaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagagcatgagaaagagtaaktggtggcagagagatggatccctgcagagacccctccagtccgggatccccactctcgtggtaggctccctcagacgcagccccaccatggtccttcggcctcagcagttccaattctaccagccacaggggatccctcntccccctcagccgtggtggtggagatg

SEQ ID NO: 12906 - DNA, 223 bp, Homo sapiens
aaataagagaagaaaggaatattttctagctgtgcaaatcctctccctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaccactccattcttgacg

SEQ ID NO: 12907 - DNA, 243 bp, Homo sapiens
ggaaattattagatgagacacttccaaataacgaaagacctgattcatatgactcccatgagctaacttttctaagaaggagtttctttaataagattttatttcaatttaaggtaatttaaatcaaactttttacattcctggtcttgatgctaatgtaacttaccagaaattgactacgtgtcagcgttttgattcatatagaatagaaaggaaggacataatgttatatgaaaccagcca

SEQ ID NO: 12908 - DNA, 432 bp, Homo sapiens
  misc_feature 99: w=a or t
  misc_feature 397: m=a or c
taggtttcatttctttgcagtaaattccttggattagattgctgggtcacagggtagttttaaaagaaactgccatacctttttccagttcaagttttwattgtgccttgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccamccgttttcagtaggtaaagtaagactgatcattga

SEQ ID NO: 12909 - DNA, 234 bp, Homo sapiens
  misc_feature 205: m=a or c
  misc_feature 214: w=a or t
  misc_feature 225: n=a, g, c or t
  misc_feature 226: n=a, g, c or t
aaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaamatcttctawtgctgcatcanngctgccct

SEQ ID NO: 12910 - DNA, 191 bp, Homo sapiens
gaggagtgtttgaagctaggagttcaagaccagcatgggcaacatagtgagacccccatctccacatttcacagaatgcaaaatgggatgtttgctgtgaacacaactacttaaaaagaccttctcctttccaggcatggaaagcctgggtttactctcccatggacctgaattccaattcccaccctgcc

SEQ ID NO: 12911 - DNA, 154 bp, Homo sapiens
acagcaccggaagagtcgctaggaggcagccatgcataaagacgagtttcatctgaaatttttcatgtgtgtgattcagtctcgccagttagtcaggactcctcagagaacagctggggaagcttctacttccagcatgctcataccaaagccc

SEQ ID NO: 12912 - DNA, 311 bp, Homo sapiens
tttgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagtcaggaggcttaggcaggagaatggcgtgaacccgggaggcagagcttgcagtgagccgtgatctcactactgcactccagcctggcaacggagcgagactccgt

SEQ ID NO: 12913 - DNA, 373 bp, Homo sapiens
  misc_feature 340: s=g or c
  misc_feature 341: k=g or t
  misc_feature 343: n=a, g, c or t
  misc_feature 344: k=g or t
tttgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggtaagtagctaagtcagttttgttgtcttggatttgtggtatccagtgtaacatttaaccaaaaaagtttagttccttattttttatatattcgacacacttttcttctataskcnktccttgaatgctcttttcccatcattcct

SEQ ID NO: 12914 - DNA, 155 bp, Homo sapiens
  misc_feature 113: k=g or t
atttccattaccaggaagaatgttagtctggactcttcagcttcattggcgttgagcatagaggttgtacatcctcaggactttcaccctgaaagtcacttggcagaacagakgttcatgtccctataaagacggaagtgatgccaaggacagac

SEQ ID NO: 12915 - DNA, 169 bp, Homo sapiens
aggggtgagaaggcccacggggttcccggaggacagggagcccgaggaggtgccggatgggcgaaccagactctctggagagggcatctccagagaggaagagacatggaagtgaaggggagccccaaagacggcctggcatagaagtgagggaactcaaagcggggga

SEQ ID NO: 12916 - DNA, 201 bp, Homo sapiens
aggcgccatctttgacgctggcagtcttggttttctgctagtgctgctgctgctgggaggacgacggacggcagcggccaagcaagaagaaagacgtggcagcaagcgggagtcggggatagtgtcatcggttcggactggtgaaaccgtaatgaagaacacccctaaactcccataatcggtgcggattcctatggggaa

SEQ ID NO: 12917 - DNA, 198 bp, Homo sapiens
aaaatgtagtctgcggacaagagccagccggcacagccagagccatgcaagcgcagttctcttcggacagagccactgtctcaagactctgcccttcttcaagagaagagcccagaagaagagagaatgactgctaggccctttatggctggattcaggttaccaaagacgttggaagaggtggctatggacatcacc

SEQ ID NO: 12918 - DNA, 244 bp, Homo sapiens
ttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaaccggaaacagga

SEQ ID NO: 12919 - DNA, 138 bp, Homo sapiens
attatattctatccccttccaaagtgctttcaaagactaaatttgtcttgataccaatccatttataccaacacatccccacatttctgatgatgaaacagattcctagagactaaatttctttcttttctttttttt

SEQ ID NO: 12920 - DNA, 310 bp, Homo sapiens
agttctctgtagtgtttgcaatgttggagccgtctgcaaagtgtccccggcaagaaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatg

SEQ ID NO: 12921 - DNA, 111 bp, Homo sapiens
aaccgtgcgttgcacagcggcggccggagcagacgcgggatggtcgcgcgtcccctgcacagcacagaggggcagccggagagcctgggaaagaggctgcctaccacaagg

SEQ ID NO: 12922 - DNA, 220 bp, Homo sapiens
  misc_feature 14: r=a or g
  misc_feature 150: s=g or c
  misc_feature 151: k=g or t
  misc_feature 169: r=a or g
  misc_feature 170: w=a or t
  misc_feature 182: m=a or c
  misc_feature 183: w=a or t
ggaagtagccggartctctgaaagactgaccgactgactctgacaggatccggggctgagggaaggaggcggcggccatggagttgggcgagctgctctacaacaagtctgagtacatcgagacggtggcgcgggtccagatatgtatcskcctctttccaaccctgcrwccctttgaggcmwggtcggcgttcccaacctgcccctaccccaccaaccc

SEQ ID NO: 12923 - DNA, 376 bp, Homo sapiens
  misc_feature 120: r=a or g
  misc_feature 132: r=a or g
  misc_feature 156: r=a or g
  misc_feature 312: n=a, g, c or t
  misc_feature 313: n=a, g, c or t
  misc_feature 314: n=a, g, c or t
  misc_feature 315: s=g or c
  misc_feature 362: n=a, g, c or t
  misc_feature 363: n=a, g, c or t
ggaagtagccggaatctctgaaagactgaccgactgactctgacaggatccggggctgagggaaggaggcggcggccatggagttgggcgagctgctctacaacaagtctgagtacatcragacggcatctrggaacaaagtcagtcgccagtcartgttgtgtggaagccagaacatcgttctcaatggcaaggctggagtgcaatggcgcgatctcggctcactgcaacctccgcctcccaggttcaagcgattctcctgcctcagcctcccgagtagctgggattactgcagaccattgtgatgaatgnnnsgtattatccgaggggatctggcaaatgtaagagttggacgtcattgnnttgtgaaaagtcg

SEQ ID NO: 12924 - DNA, 258 bp, Homo sapiens
acagtgacgtgacccttaggagacccagagccaatgcgtggattagtccctcctcctagttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaa

SEQ ID NO: 12925 - DNA, 287 bp, Homo sapiens
agcagtggcagcactgggtttctaagggaaagacaaagcaggcgcgctgtgtgggtttcagttaggcgaataatctggagagtaaagcaaattcttgtgccttctttataggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaa

SEQ ID NO: 12926 - DNA, 132 bp, Homo sapiens
agataaatttgaaatgagagatttgaaatatcattgctcggaggggccacatggaaagcatgagaatggaatatgggcagctaggagcaaagactggatcccacttgacagcaggtcactcagccaaaggag

SEQ ID NO: 12927 - DNA, 438 bp, Homo sapiens
  misc_feature 75: k=g or t
  misc_feature 342: w=a or t
  misc_feature 343: n=a, g, c or t
  misc_feature 344: n=a, g, c or t
  misc_feature 381: r=a or g
agcttgggcccgcggcggcggcaagggcgggagggagcggtcgccgcgggatttggagctgcctagcctcgcggkcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgawnntggttctcggcttatgaaggaattttaagtaaaacargttatttaatttccacatattcaaagtcaaaagccttctgtgtgaagtgccagtgat

SEQ ID NO: 12928 - DNA, 291 bp, Homo sapiens
  misc_feature 126: y=c or t
caaaaaggtagtgtgatagtataagtatctaagtgcagatgaaagtgtgttatatacatccattcaaaattatgcaagttagtaattactcagggttaactaaattactttaatatgctgttgaayctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggat

SEQ ID NO: 12929 - DNA, 358 bp, Homo sapiens
  misc_feature 144: r=a or g
  misc_feature 194: n=a, g, c or t
  misc_feature 195: n=a, g, c or t
agacggaggtttcagtgaatgaagatcgtgccattatattccagcctcggcaacacagcaggactgtgattttctttggagactcctagattttctgtggttttgaactgaatttgttggatgttggcaagtgcctcttatgarctgtttctttatcctgcatttgccccacaaagacttatctggaggtgagnnaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctct

SEQ ID NO: 12930 - DNA, 207 bp, Homo sapiens
  misc_feature 129: m=a or c
aaaaaacaagggtcctggccaaccacagtggctcatgctataatgacaacacttggggaggtgggaggattgcttgaggccaggagtttgagaccagcctgagcaacatgggcttctttgagctgttcmcttctctaagccataatctcttagtggattgagccctcttggaaagacttctctgccatccctttgcacctgagaggg

SEQ ID NO: 12931 - DNA, 369 bp, Homo sapiens
  misc_feature 252: r=a or g
cctttcggtccaggcggcggcagggctgagccagcgacgccctccattcactctccgcgcccgttctccggctgtcctcccgttccgctgcccgccctgccaccatgacggaacaggccatctccttcgccaaagacttcttggccggaggatcgccgccgccatctccaagacggccgtggctccgatcgagcgggtcaagctgctgctgcaggtccagcacgccagcaagcagatcgccgccgacaagcrgtacaagggcatcgtggactgcattgtccgcatccccaaggagcagggcgtgctgtccttctggaggggcaaccttgccaacgtcattcgctacttccccactcaagccccatcaag

SEQ ID NO: 12932 - DNA, 258 bp, Homo sapiens
  misc_feature 152: n=a, g, c or t
atccactgtgctggggactcccaagccagcactggctcatactgattcattttgatctctgctaataccagagtcctgcgtggcagagccattggcaccagaaattacaagtacgtaaagagaacatggccaagcgagttgccattgtgggngctggggtcagcggcctggcctccatcaagtgctgtctggaagaaggactggagcccacctgctttgagaggagcgatgaccttggggggctgtggagattcacca

SEQ ID NO: 12933 - DNA, 380 bp, Homo sapiens
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagaacacttcctgacctcgtgatccacccacctcagcctctcaaagtgctgggattacaggcatgagcctccacgcccagcctggcatttgcattctacttacaatgttgagtacttgtcttctgcaagttactagaa

SEQ ID NO: 12934 - DNA, 437 bp, Homo sapiens
  misc_feature 231: s=g or c
  misc_feature 232: n=a, g, c or t
  misc_feature 356: s=g or c
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccaatcctttgaagtcatcctgaagsnaccctcctttgatggggttcccgagttcaacgcctccctgccaaggcggcgagacccatccctggaagagatccagaagaaactagaagcggctgaggagcgaaggaagtaccaggaagcggastcctgaaacacctagcagagaaaacgggaacatgagagagaggtgatccaaaaggccattgaggaaaacaacaacttcatc

SEQ ID NO: 12935 - DNA, 321 bp, Homo sapiens
ataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggt

SEQ ID NO: 12936 - DNA, 229 bp, Homo sapiens
  misc_feature 34: m=a or c
cacatgctatgctatttgatggaggtatatatamggtgctatagggggacaactaactcagtgagagggcttcccataggagtaggtaccttatctaaggttctaaggacaggtaggatttcatcggatgagatgtactagtaggggttggagctgggagtaacattttggacagatggagcaacatgtacaaagatttgagagatgaaagagaatgacaagtttggga

SEQ ID NO: 12937 - DNA, 509 bp, Homo sapiens
  misc_feature 2: y=c or t
  misc_feature 3: y=c or t
  misc_feature 19: m=a or c
  misc_feature 25: y=c or t
  misc_feature 26: s=g or c
  misc_feature 344: m=a or c
  misc_feature 354: m=a or c
  misc_feature 398: r=a or g
  misc_feature 453: r=a or g
  misc_feature 455: k=g or t
  misc_feature 467: m=a or c
  misc_feature 507: n=a, g, c or t
gyyggagctcgcgagcgamggcgcysaatcctgagggtcagatctccaagaaggagggaggctggtcctagttcccgaggtcctagactaggtctagatcactgggtaaaagaaggggagcggcagcacgtatggggactaatctgtcacggcggcgccctacctcttcttccggcccggctcgtcatggcggcgccctgagtagccacttccgccctcttctggctaaattgcttcatccctatttccggcttgccatggcagcgctcggggtttaacggaagtaagcaatggaaagtatggtggtgcctcgggtccaaagagaatgcgccgctgagttgcgmggcacctgamgggattgagcctcagacacaagcgctccaaatctccgactgtarctgatctttcaagactctagtcaaaatgagcagaacattttgcagttaatcatarakttgaagatgaamgagaagatgaacgagagctacttgattgtgaactagtaanga

SEQ ID NO: 12938 - DNA, 142 bp, Homo sapiens
aatacaccaactcttatgggccaccatttaaagagacattttcatagtggacttcaatgtaattgagtccatgatccttttgagaaggggctgaactgacaagcctccctgagacaggtgccccatggaatgctagtggaga

SEQ ID NO: 12939 - DNA, 346 bp, Homo sapiens
aactgtatgattcccctcatcaggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtaccgagcgcgcccccgacagacg

SEQ ID NO: 12940 - DNA, 229 bp, Homo sapiens
  misc_feature 56: r=a or g
aaggcaagagaacccactaggggatgagcccgaactagggatgtgacagagcgcgrgacccagcctaaagagagcccggagccagcgtgggaggccgctgccgtcgcgcgccttggtcgtgctgcggttgtcccattggggacttggcggcgactgtccctgtgctggtttgcagtgtgtgggttcattcacctggtgatcgagggctggttcgttctctactacgaag

SEQ ID NO: 12941 - DNA, 203 bp, Homo sapiens
aaggcaagagaacccactaggggatgagcccgaactagggatgtgacagagcgcgagacccagcctaaagagagcccggagccagcgtgggaggccgctgccgtcgcgcgccttggttgacggcgttgcacgctctcgcggggaggctctggctttccaaacgctggcaccgagggtttttctgttccttttttttttttttt

SEQ ID NO: 12942 - DNA, 130 bp, Homo sapiens
aaggcaagagaacccactaggggatgagcccgaactagggatgtgacagagcgcgagacccagcctaaagagagcccggagccagcgtgggaggccgctgccgtcgcgcgccttggtttttctgttcctt

SEQ ID NO: 12943 - DNA, 170 bp, Homo sapiens
gcatcacagtattaggatctttaaggagatctttaagagataagaaggcaataaggtgtaaattaggtttcagagactctgtagaagaaagagagtatagggtctttttcttacatcttagaaaaatcccattcaaaagatttaaaggcttcttgtaacattactttata

SEQ ID NO: 12944 - DNA, 220 bp, Homo sapiens
  misc_feature 110: w=a or t
cttgttattccattattttaaaaaattattcttatgtcaatacatgtgatcatcataagccctttggttaagggcttatgtgtttgggatgcaaaatgaagtatttagawataaactgatatgaaattgaggatgtggttttaaatattccaggaaaaaaaataagtgaaaggaataaatcaaacaaaattggcaaatactgctaaattgttgatgaggg

SEQ ID NO: 12945 - DNA, 394 bp, Homo sapiens
  misc_feature 282: k=g or t
  misc_feature 283: n=a, g, c or t
aaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcknctagcaatgacagtgggaataaggttggcatccagcttcccgaggtggagctgtcagtttccacaaagaaagagtagcaggcctttgtatgtgtgtacatatatatatata

SEQ ID NO: 12946 - DNA, 192 bp, Homo sapiens
  misc_feature 13: y=c or t
  misc_feature 14: s=g or c
  misc_feature 176: k=g or t
gattacttgctcysgggaaagccaagcaccacatcatgaggacactcaaagagatccacatggagaaggaccaatttgctaacaccaactgccagcttagaaataaatcctccagccttcagatgaccacagccctagcctagacgtgactacaacctggtgagagaccctaatckagaactgcccagccaa

SEQ ID NO: 12947 - DNA, 424 bp, Homo sapiens
  misc_feature 265: y=c or t
  misc_feature 358: n=a, g, c or t
atttctctccttctgttggcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagccccyaccccacggatgttgtcaggaatcatgatctgactttaattgtgtgtcttctattataactgcatagtaatagggcccgtgcggggccgggangcagaggttgcagggagccgagatcgtgccattgtactccagcctgggtgacagagtgagactccg

SEQ ID NO: 12948 - DNA, 240 bp, Homo sapiens
  misc_feature 150: r=a or g
  misc_feature 151: s=g or c
  misc_feature 219: s=g or c
acggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcrsaggagagggagcagcgccggcactatgaggagcagatgcgccgggaggaggagaggaggcgtgcggasatgaacaggaatacatcaggc

SEQ ID NO: 12949 - DNA, 400 bp, Homo sapiens
  misc_feature 323: m=a or c
caattctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacaggcacacaacgacaccgatgcacamagctgcacgacactgacacactcagatacaaccagggacagcatcacatactgccacaagccctgcaatacagatac

SEQ ID NO: 12950 - DNA, 172 bp, Homo sapiens
acatttcgggtctcatcacctggaaggcacaagaaggggtggggcgctgaagcccggcagtccacgtccctctgaccccaaccttgctctccttgcctgggactcacggaggtcaaagagcagcgaggggcactggccgccctcggccctccaggggcacaggaacacgccg

SEQ ID NO: 12951 - DNA, 234 bp, Homo sapiens
tgtagacactctgtcatctgggtatattttgtgagtggactctggttagttttactgattggtgctgttgacttaatctcacctgctggatggcagaggagttatggcagttttaaagtggaagatctcaggatggctggaaagagccctatcagctgagagcagtcttcacccttcaccctgatgccagcagtcttaccaggactctgacccttttttcttggaaaatcccac

SEQ ID NO: 12952 - DNA, 222 bp, Homo sapiens
gcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatcccc

SEQ ID NO: 12953 - DNA, 327 bp, Homo sapiens
  misc_feature 228: s=g or c
aggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcasgtgacggctggcatcatcattgttggagatgagatccttaagggacacactcaggacaccaacaccttctttctgtgccggacactgcgctccctaggg

SEQ ID NO: 12954 - DNA, 228 bp, Homo sapiens
gcagtttggtctgtctcccaggcaggcgcagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctgg

SEQ ID NO: 12955 - DNA, 356 bp, Homo sapiens
  misc_feature 54: s=g or c
aatgtgaggggaggtggaggagatggcggcgacggcccgggaagatggcgccasggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgattggtccaaag

SEQ ID NO: 12956 - DNA, 252 bp, Homo sapiens
ccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagg

SEQ ID NO: 12957 - DNA, 408 bp, Homo sapiens
cactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagactgaagatcaggaagaagtaaagccgcctggctgagatggggtgggca

SEQ ID NO: 12958 - DNA, 200 bp, Homo sapiens
aatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggacca

SEQ ID NO: 12959 - DNA, 409 bp, Homo sapiens
  misc_feature 111: r=a or g
  misc_feature 112: r=a or g
agaagatggggaaagaggaaggaaaggatgcccagatacagggagctttagcgatgtagtgaacggacagaagatcaggaacaagttgagttcattgtgtggagatggcarraagatggagattggtgagctgagtggagaagtgccatagagcggtgttttgccagagtgtctgcggattgctcatacctgggaaggattctttgtatggttcccttaggctgagggagggtatcagctttacagaccttgtgggattacaaaagggccaccacacactcttcaaccaatatgtgtctatcttgcattcaaggctcattctttgttgaaattttgcagttggtcactaggctattgttatctccatctcaaagtacacagacacacacacacacacacacacacacaa

SEQ ID NO: 12960 - DNA, 83 bp, Homo sapiens
atgagacgcattacggagatcccagagacagtcagccggcagtgctctaaagaggacaaggaggaggtgacagctgtacacac

SEQ ID NO: 12961 - DNA, 382 bp, Homo sapiens
  misc_feature 381: n=a, g, c or t
ttcgagaccagcctggtggccagatggcctcaggccttgggctggtgtgaggattgggaggggagaaaggggaaggctggttagaggctgttttcctctgaatgtgtttagcggcaggtgtggatggggagtgctgggttaaccacaggtgtttgccagtaagcatgggcccaagagagttgagactatcacaggagtgagggtgctgttcctgttagaaggaaagagaccgaggccaggtggctggtgtgtggagcccacctctgcaggagtgtcacgcgcgaatgccaaagaggagccggggagaggctgagatgttgctcacagagctttgggagccttgtgtgtgtagagtggaatggcctcctcctgtgtgtagant

SEQ ID NO: 12962 - DNA, 187 bp, Homo sapiens
  misc_feature 23: s=g or c
  misc_feature 137: y=c or t
  misc_feature 154: s=g or c
  misc_feature 156: s=g or c
aagaccgcggccgccgcagccgscgaaagaggcaaagtcccgcacgccggaggacatgcgcctcggctagcggccccgggccccaccaccgtgcggctttctccagattattcctctctcgctgtctctgactgtcyctctctgtctctgtctststctctctctctcacacacacacacacacaca

SEQ ID NO: 12963 - DNA, 194 bp, Homo sapiens
acgagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcact

SEQ ID NO: 12964 - DNA, 115 bp, Homo sapiens
aagatggcggacgagaaggacagggaagagataatagtagcagaatttcacaaaaaaatcaaagaggcatttgaagtctttgaccatgagtcgaataatacagtggatgtgagag

SEQ ID NO: 12965 - DNA, 150 bp, Homo sapiens
  misc_feature 112: k=g or t
caaggtagacagtgtctaccaccacagtggccataccaaagaggctaccgattccttcctgctacctggatccctgaagttgccctggtctctgcaccttctaaacctagtkcttaagagctttccattacatgagctgtctcaaaaccc

SEQ ID NO: 12966 - DNA, 439 bp, Homo sapiens
  misc_feature 393: n=a, g, c or t
tcacagtgtcctgagaccacttcatgctctccccttgaacccaaagagtcctccttcacagctgttttctctcctgcaacaaagaggctttcctcattttcaaggctttttcaataactttccacctcttctagaatcttgccctaatttttcctctattttctaatatttttaaatctttcttccttccctagatccttgtctgctgcattcagataatgcacaaatcttccttatcccagaaaaatctgctgtctggttaattcactttcattcattcatttcctttcttctcaataggttgtctatatgtttctttttctctttacctacacacccttagcatggtattagagcatgtgatttagggtcccatacaccggtttttgagtnctggtgccactttgaagtcattttgtaatctttgtcaaattacttg

SEQ ID NO: 12967 - DNA, 150 bp, Homo sapiens
  misc_feature 13: n=a, g, c or t
gtttaaccttttntaaggatataaaaaattcattggaaagtgtgtatatttcaaagactctcaattatctggactgaaggcactgttctcactatggccagatgaatgggagtattctgtacatgaatcatgctgtattttaaatcagga

SEQ ID NO: 12968 - DNA, 83 bp, Homo sapiens
ggtcttagcccctctgtagggaaagagggtccgccatgttccccggcggcgccccgcttggctctggtagccgccgccccgcc

SEQ ID NO: 12969 - DNA, 198 bp, Homo sapiens
  misc_feature 28: r=a or g
agaaagggttcagagtcaggcacaggcrggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccggg

SEQ ID NO: 12970 - DNA, 444 bp, Homo sapiens
  misc_feature 325: s=g or c
  misc_feature 374: n=a, g, c or t
  misc_feature 375: n=a, g, c or t
aacatttcaccatggaatatgaagtcaagaaagggaagaagggctttgtatcccccatccgaaggctggtgttccccaaggccgggcgccgggcagcctgtaggagcagcgtgagcgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggctgaaggagctgccgctgaagaccacggcggasaggacagcatcctgagcctgtctgcccgctgcctgctgctcactggggnncgacaatgaagagctcattctgcgaatccctacgcacgagatcgccgccgcctcctacctgcaggacga

SEQ ID NO: 12971 - DNA, 544 bp, Homo sapiens
  misc_feature 434: y=c or t
  misc_feature 493: n=a, g, c or t
  misc_feature 517: r=a or g
agagacgtcaccggctgcgcccttcagtatcgcggacggaagatggcgtccgccacccgtctcatccagcggctgcggaactgggcgtccgggcatgcacctgcaggggaagctgcagctacgctaccaggagatctccaagcgaaacggggtttcaccatgttggccagtctggtctcgaactcctgacttcataatccgcctgcctcggcctcccaaagtgctgggattacagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctccyataaagaggtgggagctgtcctcggaccagccttacctgtgacactgcaccctcacggncaaccgactactttgcctccttgratttcctccagggagaatgtgacctaa

SEQ ID NO: 12972 - DNA, 584 bp, Homo sapiens
attaagaagatggttttgttattaaatagcattaaactggaattgacaagagtgttgagcatccctgtctaacctgctcttttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcagttcttgtataatgaagtcaatgcc

SEQ ID NO: 12973 - DNA, 139 bp, Homo sapiens
  misc_feature 21: s=g or c
  misc_feature 123: k=g or t
aatcgctcgggtgcagcgcastcagcgcaggcatgcggcctttcggcagccgaacggccgcggcagttcaggacaaagaggtgtgggcaggccactgggccagctggtaacatcatggcagakaaagtgaacaacttcc

SEQ ID NO: 12974 - DNA, 430 bp, Homo sapiens
aaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagtt

SEQ ID NO: 12975 - DNA, 269 bp, Homo sapiens
ggatgttcggttcctgctgccactgctgccgccgcccccggagctgctggtttcattcgaggtttcgggccgctcctggccctgcggacgtcagcgtctaataattctcccggtcttcctgattgcctgaaagagtcgggacggttcggttgattgtgtttcccggttaggactcggtgtaggagatccatcgaaccactcgctcaggaggatgccagcccccatcagattgcgggagctgatccggatggtccggacagcccgaaccc

SEQ ID NO: 12976 - DNA, 287 bp, Homo sapiens
atcagttgattcttagttttttcatctgttaagtagaacgtactattacttaccttaaagagtggctttgagaattttgtaaggaacaaacatgtttttgttctggaatataggaggtgctcaataaaagttgactctgactggcaaataatattgttttgtaaatgcatgatgattatttttggccatatttgacttagtttcattaggctaatattaattggtactatatgaaagtgagtcaactaattataaaagattagaaatgtcttaggtgacgatggggg

SEQ ID NO: 12977 - DNA, 231 bp, Homo sapiens
  misc_feature 47: r=a or g
cagttgctgtatgagcctggcctggtgcaaacacattgctagagacrtgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaacc

SEQ ID NO: 12978 - DNA, 228 bp, Homo sapiens
  misc_feature 123: k=g or t
tgttaaaatagaaaattttgaggaaaaatggaaatagggtggaaaagtactcggtaaacagtagtaaccaaatattttcactccagatttgtgttttctctggcacagagtagatcttttggkaaatatatatgaaagtggattaagtttgactacccttatgttagccacatctggatgagaacagttacaaagagtttggtctctaagttgatttgtacccagtgg

SEQ ID NO: 12979 - DNA, 185 bp, Homo sapiens
gtgttggccagggtggtctcgatctcctgaccttgtgatccgcctgcctcagcctcccgaagtgctgggagccaccgcgccccttaattgaagttttaattaaggcattactaagatagaagtccactgctctcctcaagaatttgagtataatgcaagattataactaaagataaacgtaaaaa

SEQ ID NO: 12980 - DNA, 244 bp, Homo sapiens
tcttgtttgtttcttgagctacctgttacctctctcagtgagggaagttaaagctgcagcaggagcttggagagctttttcaactgcgttgacagctcttattgtcacaccttagttcatacgctatctataggcgactattgtttcagtgggttgtggtttataaagtgctaacaaggcttgagacataaagatactattatttcaggtgacactacttgttatgaatctgcagcttctcaca

SEQ ID NO: 12981 - DNA, 107 bp, Homo sapiens
gttttaataactggttttgtgttggaaggctgtgattttcacttatttaaatagtattaggttctcatatgtaaatgatatggcctaaagatagaaccctcccccca

SEQ ID NO: 12982 - DNA, 151 bp, Homo sapiens
atgataaatgcttgtagtataatggtgtaattgaatctgaagtattgcattaaagataggccatagcatcctcccatcagctttgatacttactctctcaggatcatgatttgctattctttataaggatcatttttctcattatcagtca

SEQ ID NO: 12983 - DNA, 223 bp, Homo sapiens
  misc_feature 16: n=a, g, c or t
  misc_feature 139: w=a or t
  misc_feature 211: n=a, g, c or t
aaggaaagaagaacgnaagaaaaaagagaagaggagaaatgaaaagaaagaaaaagaggaaggaaggaaagggaagggaggcaggctgtggcaactgggatatagaataaagtgacagcaggattagggtgaaattaawccaggtggatctgacctaatctttgaaagatatgatggaaagggaagggaggcaggctgtggcaactggganatagaataaagt

SEQ ID NO: 12984 - DNA, 565 bp, Homo sapiens
  misc_feature 360: d=a or g or t
  misc_feature 506: r=a or g
gtttccggttcgcctccggagccatggcggcggcactgaagtgtctactgacattaggaagatggtgccccggccttggagtggctccccaggcccgggtgagtgcctacattccctgctgtcggagagactctggatctgcagagacatctccgcgcagaggaggagcgctcctggcagccccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctdgccacaggcactggctaacggtgcccagttattgctacttgggagcgctgggcccactatggagaatcaggtgcaaacactgaccagttatctctggagcagacatttgcctgtagagccagaggagttgcaaagacgggctagcrtcttgagaaaaaattcctggaaaacccagacttatctcagacagaggagaaacttcgtg

SEQ ID NO: 12985 - DNA, 196 bp, Homo sapiens
  misc_feature 152: y=c or t
  misc_feature 194: s=g or c
cttcgtaagtggctgcctggcctcccaagggccggtggggatgccgccccagtcccccggcgggtctggcgtaggtacaggggtctcaactgggcgactgaaggccgtagtagcgtcttggttggtccgtaagcttttttgagatagttgtyagcgtctaaaagatgtccagggtgctgcagaaggacgcggasag

SEQ ID NO: 12986 - DNA, 441 bp, Homo sapiens
  misc_feature 339: k=g or t
  misc_feature 340: k=g or t
  misc_feature 387: s=g or c
cactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtaagtggttaattcagtaccaagtgatcaggaactagaggtgattcttagttacctaactgtgtgactctctgtgtattataagcattttgtataatatgtgkkggcagtttttaaattctagccaagctccacagcacttctctcttcasacattaatgtggtgctgtgggactcaaattttcatttcagtgtcaagctaaaat

SEQ ID NO: 12987 - DNA, 151 bp, Homo sapiens
  misc_feature 148: m=a or c
actacacttgttaccgcttgtcctgagcgcggagagggcgagctcgggccgcgggcagggcgggagccggcagccggcaaccaagggaggcagaaaggcacaaagatcgcaataatatccgttataacccgctatctaaccccacccmcaa

SEQ ID NO: 12988 - DNA, 367 bp, Homo sapiens
cgtggtgagcccgaggtcacacagtcagaactgaagaccctgtctccagctcccagcgacagcttgttctcccacacgttctttcaagtcctcatggcccatcggccctgcaaagtgccaagtaaagatcgtagtcacccttttatgtctgcctttccaattttcctggccaatttgaggccttcccctccttggaactggcagaggcacgtctcccgtaggaagcactgctgaccaccgcagcgactctggcttctcacgttgtgcaccatccccagccttgctactccaagtgtggcctgaggaccagtgggacccgcatcatcggaaagattgtgagaaatgccttagcatgcccccactcaac

SEQ ID NO: 12989 - DNA, 254 bp, Homo sapiens
agatttttacccaggtgctgacagctgcagaagaaattgtacatggtgctgtacagaaggtatttctccactgtgccatctgcagagtgaaactgactaggagtactacatagactgtactactgagcgagtgtgcttgatccagggaacggttgaagcactgaatgcagttcatggattcattgcagaaaaaattcgagaaatgccccaaaatgtggccaagacagaaccagtcagcattctacaaccccaga

SEQ ID NO: 12990 - DNA, 104 bp, Homo sapiens
tatagagaaacattttttaatccatttgcctaaagatgagagcattaagtagaacaattaaaggtggattattgctgttatgtgatcatccaaaacaaacagat

SEQ ID NO: 12991 - DNA, 329 bp, Homo sapiens
  misc_feature 64: w=a or t
  misc_feature 170: r=a or g
  misc_feature 235: s=g or c
cccattcatacacctataaatctctaacaagaggccctttgaactgccttgtgttctgtgagawacaaatatttacttagagtggaaggactgattgagaatgttccaatccaaatgaatgcatcacaacttacaatgctgctcattgttgtgagtactatgagattcaratttttctaacatatggaaagccttttgtcctccaaagatgagtactagggatcatgtgtttaasaaaggctacgatgactgggcaagaagaaagatgggaaactgaataaagcagttgatcagcatcattggaacatggggacgagtgacggcaggag

SEQ ID NO: 12992 - DNA, 231 bp, Homo sapiens
cagaatgcttgtattagctagttctatgaaataaccatagcttattctttttttcatttcatgttttgaagaagaaagaagattggatatagatgagaaacctctagttgtacaactgaattggaacaaagatgatcgggaaggcagatttgttcttaagaatgagaatgacgccattcctcctaagtgaaaattctcgactggctgctgaggtttacaaagacatgccgg

SEQ ID NO: 12993 - DNA, 455 bp, Homo sapiens
  misc_feature 10: n=a, g, c or t
  misc_feature 34: n=a, g, c or t
  misc_feature 54: w=a or t
  misc_feature 270: w=a or t
  misc_feature 271: n=a, g, c or t
  misc_feature 277: m=a or c
  misc_feature 280: n=a, g, c or t
  misc_feature 281: n=a, g, c or t
  misc_feature 425: s=g or c
cggaagtgancgtgttgtggcggaaggaggagcnttctgggagtagccggtgcwgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctwncggcamtanngctaccctctactttgtattttgtgtggattcctcagagagtgaacttggaatcttggacctcatccaggtttttgtggaaactctggataagtgtttcgaaaatgtgtgtgaattggatttgatcttccatatggataaggtscactacatcctccaggaggtggtgatgggt

SEQ ID NO: 12994 - DNA, 237 bp, Homo sapiens
atgcgcgtggcgggcaggcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcg

SEQ ID NO: 12995 - DNA, 308 bp, Homo sapiens
aaaactctgggcaggatccaacgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatc

SEQ ID NO: 12996 - DNA, 201 bp, Homo sapiens
cttatggctttcttacatcaatattgttatgtcctagacaccttatctgaaattacggcttcaaaattctaattatgtgcaaatgtgtaaaatatcaatactttatgttcaagctggggcctcttcaggcgtcctgggctgagagagaaagatgctagctccgcaagccggagagggaacaccgccacattgttacacgga

SEQ ID NO: 12997 - DNA, 249 bp, Homo sapiens
  misc_feature 58: y=c or t
gaaagatggaggtgtggggacaggagctgggtgtgctggggactggccgcggaccccyaacctgtgtctccggtctccctccgggagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatcca

SEQ ID NO: 12998 - DNA, 131 bp, Homo sapiens
acagaagctggcgtacaggtaaagatggcagctaccatgttccgggctacgctgcggggatggagaaccggtgtccagcggggctgcgggctacggctgttgagccagacccagggccctccagattaccc

SEQ ID NO: 12999 - DNA, 179 bp, Homo sapiens
  misc_feature 57: r=a or g
agttgctttgaggcagtaccggaggagaaagatggcggctaccttactagctgctcrgggagccgggccagcaccggcttgggggccggaggattcactccagactgggaaagccgagaagtttccactggggtgaggaaggaatcggggttcataggacgtgcacaaggcctgacgcg

SEQ ID NO: 13000 - DNA, 149 bp, Homo sapiens
gtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagag

SEQ ID NO: 13001 - DNA, 504 bp, Homo sapiens
ctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 13002 - DNA, 207 bp, Homo sapiens
taaaataaatacatagacaactatgatataagctggggcttgttaggtgcctcaggaagatgtgaagttctgcgatactttggaatagagggaatgcttatagggttagaagagagcatgaaaggctttatgagataactggatgagtgggcttttagaaggagctgatgaaagatggtgtgaggagtggacacttcaggaggagag

SEQ ID NO: 13003 - DNA, 255 bp, Homo sapiens
  misc_feature 218: w=a or t
actcactgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaawcaacaggttgttttggtttctatagtacaattggggt

SEQ ID NO: 13004 - DNA, 125 bp, Homo sapiens
atttttaatctttattagggttagttggtacaatgcttcgttgtatttagtaagcctttacaagacttgttaaagatgtcagagtgccccaagctgccgttccttcccttcctgccccacaagct

SEQ ID NO: 13005 - DNA, 318 bp, Homo sapiens
  misc_feature 119: r=a or g
  misc_feature 122: r=a or g
caaattagtgtttaaacccatttgcatattgacttgtcagtacctttaactcaatttaatataacaagaaatcgtaaaatacttataacctatcttagagaaatgagtgctggttttgrgarttggttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattatagggga

SEQ ID NO: 13006 - DNA, 404 bp, Homo sapiens
actttgtctctgttctccagatattctgttaggaggccaggagggttagggtttcctttgccctgccctgctattgggtccttctctggtcaaagattcagctctaacaaaggaagggtccacctgtgagacctgttctgaggaccagccctgtacctttcccccataacaactttgaactcagtctctagcttcttttttaaaaaatattctttttttattttttaaagatgggttctcactcagccacctaggctggagtgcagtggcacagtcataactcctgtgctcaagcaatcctcctgcctgggcctcccaggtagccgggactataggtgcacaccactgtccccagcttgaactcagtctctaacctacttccttttcctgtttcacttccaggt

SEQ ID NO: 13007 - DNA, 180 bp, Homo sapiens
gttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggg

SEQ ID NO: 13008 - DNA, 194 bp, Homo sapiens
aattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaacta

SEQ ID NO: 13009 - DNA, 372 bp, Homo sapiens
  misc_feature 228: s=g or c
  misc_feature 233: n=a, g, c or t
aaacgtgcgcaggcgccggccgctgcgctgcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgstttcntttggttaaagattgggctcccaaagcatttataatttcctttaagttggagactgaccccgccattgtaattaatcgagctcggaaggctttggaaatttatcagcatcaagtggtggtggctaatatccttgagtca

SEQ ID NO: 13010 - DNA, 380 bp, Homo sapiens
  misc_feature 318: r=a or g
  misc_feature 365: k=g or t
catggattaactcttaatcctcagctaccgtatacagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaraaagatttcaccaatttacaactccatcattagtaagaatgcctgtktgcctatagtccgcc

SEQ ID NO: 13011 - DNA, 544 bp, Homo sapiens
  misc_feature 375: w=a or t
  misc_feature 480: n=a, g, c or t
  misc_feature 540: s=g or c
  misc_feature 543: s=g or c
gcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgatgaaaaggggcagtaatccagtccctcatagcactggtgaatgacccccagcctgagcacccgcttcgggctgacctagctgaagaatactctaaggaccgtwaaaaattctgtaagaatgctgaagagtttacaaagaaatatggggaaaagcgacctgtggactaaaatctgccacgattggttccagcaagtgtgagcagagacngcgtgcagtgcattcagacaccccgcaaagcaggactctgtggaaattgacacgtgccascgsc

SEQ ID NO: 13012 - DNA, 155 bp, Homo sapiens
aaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagtgg

SEQ ID NO: 13013 - DNA, 416 bp, Homo sapiens
atattgaatttctgattcataatgagaaacatcttttactggggagccatgtcatttttagaatattctggatataccaagaacagctgctgggaatcagctttctttccattcataatattgagcccgagttggtctcctggtccttttgcagcagacagaatgcttgtgcttggagatgcccacccccttcctcatttgcatgctggtcttctccaatctgagcacttatcagtttcttcagtagagatcatctactgaacaagtttgaactggcagcaaggacttcagggtcaggcttctggagatgggtcttagctccactgcttactacgtcaccttgggtgaaagcaactcacaatactaccccaattcaaaggatgtgaaataccttccacctgttgatggcaggagct

SEQ ID NO: 13014 - DNA, 218 bp, Homo sapiens
ctgatggtgacagtgatatccagatgtcttgcagcaggcttggcctgtccaatgctgtcacttccttcgttcctgcttttatctgagcttgggaggtagtttgagaagtcgctggtgcagttatggaggggtggggaaagcaagatccctttggagaggagctaacagggtttcctgccccagagctctgccaccactcagatgcccagaacctgccc

SEQ ID NO: 13015 - DNA, 174 bp, Homo sapiens
  misc_feature 15: r=a or g
gccatcttgcgtacrgaggtgaggtttgttaccgcgattctgagaggtgggcttttagtccctccagacctcggctttagtgctgtctccgcttttctttcaccttcacagagatgtcttatggtgaaattgaaggtaaattcttgggacctagagaagaagtaacgagtgagc

SEQ ID NO: 13016 - DNA, 438 bp, Homo sapiens
  misc_feature 15: n=a, g, c or t
  misc_feature 289: k=g or t
  misc_feature 290: k=g or t
tgttatttttaagcntctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctkktaattgagaaagcaatgttattgtctgtgatttccagtctttgctcattttattatccctgtcaaataatgtaatattggtacctgcagttgaatttgtaatattgtaattgaattttttagttgatcttcgatcagtttttatagca

SEQ ID NO: 13017 - DNA, 176 bp, Homo sapiens
ctcgtaatccgcccgcctcggcctcccaaagtgctgggattacgggtgtttgccaccgcgcccagcccaaattattacattcgtaagacagacacctcttagaatctatatatatgaggttttactcccttttctacactcagtatgttttaattgatgcaaagcaattaattggc

SEQ ID NO: 13018 - DNA, 403 bp, Homo sapiens
  misc_feature 114: r=a or g
  misc_feature 131: m=a or c
ccttgaagctcttgcccggtgacctcacccaggttcagaagaatttttcacacttggttgatagatcaacagcaatagcccggaagatgggctttcctgaaatcatacttgccrggagatgttcgaatgamatttatgtcactgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagagtcacacgctgtcatataagatttaccttccgacacaggtcatctca

SEQ ID NO: 13019 - DNA, 361 bp, Homo sapiens
  misc_feature 284: r=a or g
  misc_feature 296: n=a, g, c or t
  misc_feature 297: n=a, g, c or t
  misc_feature 299: m=a or c
  misc_feature 300: m=a or c
  misc_feature 349: m=a or c
  misc_feature 350: m=a or c
aatggaagcaggctgcccaaagcacacagcgccaatctgctggtgtccttttccacacggtggaaggtcgttttgctgtttgcaataaatcttgctgctgctcactttttgtgggtcccgcagctttatgagagtaacactcaccttcacaaaggtctgcagcttcactcccgaggtcagcgagaccacgaactcacaggaaggaatgaagaactgcagacgcgctgcctttaagagtgtgacactcactgggaaggtctgcagcttcactgctgaagccagtragaccaggaacnnammgggagggatgaactactccggaaggaaccaacaactccagacgcgctgmmtctaagagctg

SEQ ID NO: 13020 - DNA, 336 bp, Homo sapiens
  misc_feature 32: y=c or t
  misc_feature 37: m=a or c
  misc_feature 85: s=g or c
  misc_feature 86: n=a, g, c or t
  misc_feature 334: r=a or g
attttctgggcggtgctgtgcagcgctgcggycggamtcacgggtccggaagcaccatggacccccggggaaacgcgccggcggsnaaggagccgagccccatcttgatgtggaagaaatggaggactcagaaccaaggatttccaagtgatttcttccaaagcacaggaatctcactctgttaaagctggtctgttctaactgagatgacagtcatgtccctttccagggacctcaaggacgactttcacagtgacacggtactctccatcttaaatgagcagcgcattcggggcattttatgcgatgtcactatcattgtggaagataccarat

SEQ ID NO: 13021 - DNA, 245 bp, Homo sapiens
  misc_feature 188: n=a, g, c or t
atttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaangccacaatgaaccggggagtcccttttaggcacttgcttctggtgctgcaactggcg

SEQ ID NO: 13022 - DNA, 145 bp, Homo sapiens
gcacgagtatacatccaggagcatgctacattcaatttcaatgctgtggaacaccttgtttcattgaagttttactacactacaataccatattatacgagttactcaaagcacctaatgagaagtgcaagtcttataaactaag

SEQ ID NO: 13023 - DNA, 382 bp, Homo sapiens
ataaactgacgatatacaggcacattatgtaaacatacacacgcaatgaaaccgaagcttcgcggcctgggcgtggtcttgcaaaatgcttccaaagccaccttagcctgttctattcagcggcaaccccaaagcacctgttaagactcctgaccccaagtggcatgcagcccccatgcccaccgggacctggtcagcacagatcttgatgacttcctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacc

SEQ ID NO: 13024 - DNA, 108 bp, Homo sapiens
ctttttcagcgcctgcaggttccgggaggtcagctcccagccgaggacgtcggatgtcatcgtccttgtcaatctgacgttcggggcttccacaggccctggctattg

SEQ ID NO: 13025 - DNA, 336 bp, Homo sapiens
  misc_feature 198: s=g or c
cttttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggastgggagggggctggcgggcgggcgcgcgcacacccgctgatctatcactctcgttcttgtagctcccagccgaggacgtcggatgtcatcgtccttgctgctttgccaccccattcccgtcaataaagtggtttgaac

SEQ ID NO: 13026 - DNA, 157 bp, Homo sapiens
cttacatggccttatctgatttcccaataaccctgtaaagtgatgactattgctatgctcattttactccacaaaattgaatctgaaaggttaaaggatggaaaaacattctgtaagctgcaaagcactaggtaaatataattatatttctctctct

SEQ ID NO: 13027 - DNA, 159 bp, Homo sapiens
ctgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggt

SEQ ID NO: 13028 - DNA, 288 bp, Homo sapiens
  misc_feature 128: n=a, g, c or t
tcaagttcaaattttcacctgtaaagcccttttcagggtagtaaatacagattttgctgggtctgctctttacttgttcttctcaagagcataggtttattataaattgtttgtgtagctttagcaangtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggca

SEQ ID NO: 13029 - DNA, 268 bp, Homo sapiens
  misc_feature 7: n=a, g, c or t
  misc_feature 8: n=a, g, c or t
  misc_feature 158: k=g or t
cccactnnttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgtkgttagatatttcttcacatatcagctgcccattttgaaaaagaaattatccataaaggtaatgttggtgctccaatttgccagccattcccaacccccttctcccttacc

SEQ ID NO: 13030 - DNA, 236 bp, Homo sapiens
gaaatgtatgccatgtactttgaaagcagaatattctaagaagaatgtgcatcctttaataaatccaatagtagtttgatagccatagaaatcttttgccaccttttctacttttgctatttttgctgtataagattcaagatttttagttcttcagaatccactcccgttttttggtgagtaaacccacggcacctctgccaattcatcacccctcagagatgccaccccagccc

SEQ ID NO: 13031 - DNA, 633 bp, Homo sapiens
agagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaaccagtacccttaagtctcgaagtgaggtggatctcacaagatccttttcatttcggaactcaaagcagacatactctggggttcccatcattgctgccaatatggatactgtgggcactttgagatggccaaggttctctgtaagtcctaggttcctgggagtttctgggatgtgcccaaatgggatgtgtttttcttatatacaagttgttcactttgaaatggaagatgctgctcctgtcagtac

SEQ ID NO: 13032 - DNA, 266 bp, Homo sapiens
  misc_feature 15: m=a or c
  misc_feature 16: n=a, g, c or t
  misc_feature 17: n=a, g, c or t
agttgcttgtgtcgmnngagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtggtgtgt

SEQ ID NO: 13033 - DNA, 358 bp, Homo sapiens
tctgtatattatgggaaattggaagagtttctttcttttgttccccctcttagtacttcagctgttgtaatttttaatccatttatgtgatcaggaaatctttgtgttagagagaggaggtggtacttggaattgggaatatcggataggttttgacaggtggcagttcgaaagcagatgtgtctcacagccagagggattagtgagagcgaactagtggcaggaaagtgttgtaagaggtaggaaggaacactgatttgctgttaggatagggtatgtataacagggtggactactcgtgatggttcttaactcccttagttttaattgggtggcatttgtaaagttaatgaatgag

SEQ ID NO: 13034 - DNA, 198 bp, Homo sapiens
ggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgc

SEQ ID NO: 13035 - DNA, 295 bp, Homo sapiens
agttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagtgagtttttattagactaggtatgtatatcattattaatattttactgtaaatagctttgtaattcacacaaagtatacgggc

SEQ ID NO: 13036 - DNA, 210 bp, Homo sapiens
aaattgagtgctctggggagactttattgttgtttgtgtgtgtgtttcaacactacagaataagatgtgactgtgacccactaagtccttaaaaacaatagggtatatcataagaactagaaagcctaacttcagacactgacaagaaagcaggaaatactacgtttctcatggtagtaagactcaggaaattcttacgcaaacaaagag

SEQ ID NO: 13037 - DNA, 437 bp, Homo sapiens
  misc_feature 350: k=g or t
gtggctaatgccgtaggtctttcagggctgagccatcctgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaakagtcaacctgatttcacataacaatgtgtggcatttgttgttctgtaaacttttctgctgagcatttcagtcaagatttaaaagagg

SEQ ID NO: 13038 - DNA, 160 bp, Homo sapiens
aaggcctcaaagcaggaagatggtgaactttatgcaattctgagttgactccaatccagatgtattttggaactaggtagaatatgactggtaaagcttcagcgactgaaggagtgtggactttttgaatttcaagaacagtaaagttggaacacagcag

SEQ ID NO: 13039 - DNA, 336 bp, Homo sapiens
  misc_feature 14: s=g or c
aggcgcatgcgcasggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactg

SEQ ID NO: 13040 - DNA, 513 bp, Homo sapiens
  misc_feature 14: s=g or c
  misc_feature 328: s=g or c
  misc_feature 329: n=a, g, c or t
aggcgcatgcgcasggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctasnttctttccacaggagccagcatacttcctgaacatggagagtgttgttcgccgctgcccattcttatcccaagtcccccaggcctttctgcagaaagcaggcaaatctctgttgttctatgcccaaaactgccccaagatgatggaagttggggccaagccagcccctcgggcattgtccactg

SEQ ID NO: 13041 - DNA, 449 bp, Homo sapiens
  misc_feature 210: s=g or c
  misc_feature 218: n=a, g, c or t
  misc_feature 230: r=a or g
  misc_feature 383: r=a or g
  misc_feature 384: s=g or c
  misc_feature 418: s=g or c
agcatttggcagcaatcaccctgggctggagtgggcctgacaggaatgggcaaatcttggggcaggaaatccagtcagaagattatgacgataaagcaggtgagagatgttggtgtcccaagggcaaagggggatcccatcaagacatgagaaccgccacgtcgttctttccccaatcccactgtttctagatttttccttctaggaggsctgcaaantgtgtttccggragaaaatcctccctgctatttctccagccttcccttgttaccggtccggccctgcccctttaacattcaggaatgagagtggaagcagaaggcccaggtccccggaggtcccgacgcccggattccacagcctgtgagggtccttgagcagarsggacgaggccactggcactacgtcgtgacttcascaacagcctgcagtactcgttaacgagattt

SEQ ID NO: 13042 - DNA, 129 bp, Homo sapiens
gagtttgccataagtgcctgccctctagcctctactcttccagttgcggcttattgcatcacagtaattgctgtacgaaggtcagaatcgctacctattgtccaaagcagtcgtaagaagaggtcccaa

SEQ ID NO: 13043 - DNA, 212 bp, Homo sapiens
  misc_feature 122: s=g or c
agtcattcagttatatgttaaataacttgaagatgttttttgttccaagagagaagtgaagaatgtagttttcaaccaaagggatgacagctgatgagtgggctgagaaaatgcccaaaggsccgccgcctacctctcccaaggccacagccgacagagacatcctggctcgcctccacaaagcagtgacttcccattaccatgccatcacc

SEQ ID NO: 13044 - DNA, 431 bp, Homo sapiens
  misc_feature 195: s=g or c
  misc_feature 323: n=a, g, c or t
atcctctgatgtaggcctttcaggccttaaatccagtgggattgagaactttctaagagtggtgcggctcttgacaacatgtgggctccaccagcagcaatcatgggggatgggcccaccaagaaggtgggcaaccaggcccccctgcagacacaggccctccagactgcctctttaagggatggcccggcgaasgggccgtgtgggtccgccatacgagttcagagccacaagaacctactgaatcaaaggcagccaaggagaggcccaagcaggaggtgaccaaagcagtggtcgtggacctgggcactggctactgtaantgtggctttgccggcctgccaagacccacccacaagatctcaacaacggtgggcaagccctacatggagaccgccaagactggggataatcgcaaggagacattcgtg

SEQ ID NO: 13045 - DNA, 282 bp, Homo sapiens
gccgtgcaggtggtggcgaacgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagcactttggg

SEQ ID NO: 13046 - DNA, 65 bp, Homo sapiens
aaaaaagtacactgtgcagtttctgaagagtttacactatttaaagcataatcatagcctcacag

SEQ ID NO: 13047 - DNA, 280 bp, Homo sapiens
taggaaagcatcacaggtgagaaacacaattgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaac

SEQ ID NO: 13048 - DNA, 659 bp, Homo sapiens
  misc_feature 135: m=a or c
  misc_feature 137: m=a or c
  misc_feature 180: y=c or t
  misc_feature 181: v=a or c or g
  misc_feature 215: w=a or t
  misc_feature 318: d=a or g or t
  misc_feature 319: n=a, g, c or t
  misc_feature 391: k=g or t
  misc_feature 499: k=g or t
  misc_feature 503: n=a, g, c or t
  misc_feature 504: n=a, g, c or t
  misc_feature 505: w=a or t
tgtataaatgtatgtatcacctaggggttggcctcctggacccctcccgttctttctggatagccatcccctgggcctgtccaggactgggagttgcagctttgtgttaagctgatcacagacaccggctggcamcmatcagcgggaagcagagcccatgtccaggatgcctcctgctgyvctgtgtccatccctagtctgtcaggacttcctgwcactgttttccaaagctgtaaacctcactggtgaacgttcaccttaatgattgattcttttaatctctgttttcactctcaggctctggtaagtattcgtatdnccttcatcccagtctgattgcatagccacactgcccggcacgccacatccacccctgtctgcacatgagttkttctgacaacagcgctgtatacgcttcagtttttccacattgtccacggccagcacatgaaagcatcacttcttttttatgttgtgggaatctttgcaagttagtgtkgcannwgattttcaggtgtacatttatttttgactgggcagataggggatttttttttttccatgtccgattcacacgctacacacccacatgaacacattcgaacttcgaaggccacacactcctgcttcataggccccacggtaagtgagttcacacc

SEQ ID NO: 13049 - DNA, 223 bp, Homo sapiens
gttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcc

SEQ ID NO: 13050 - DNA, 279 bp, Homo sapiens
gtttttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgaca

SEQ ID NO: 13051 - DNA, 167 bp, Homo sapiens
  misc_feature 13: m=a or c
  misc_feature 27: y=c or t
  misc_feature 152: n=a, g, c or t
tgtctgcactggmgctgcctggtgacyagaagtttggagtaggtttggtgctgggcaggggtggggagtagggtggaaagcatggagtgaagaggtctagggagggggtctcctcacccccgccttcctgccgccttgatctcgggggtctntaaggcttgcttcca

SEQ ID NO: 13052 - DNA, 62 bp, Homo sapiens
ggttttgtgtggaaagcatgtaggagggttctttccctgatttcaagtagttccttccaccc

SEQ ID NO: 13053 - DNA, 180 bp, Homo sapiens
  misc_feature 52: w=a or t
  misc_feature 57: m=a or c
  misc_feature 68: k=g or t
  misc_feature 115: r=a or g
cctttttttgcagtctcaggacgggcgctttggagccggccccaggcagcgwgtgtmggtcgcctagkctggagaactagtcctcgactcacgtgcaaggatgatgctgaaaggrataacaaggcttatctctaggatccataagattgcccccgaggaattagcacttgttcacaacct

SEQ ID NO: 13054 - DNA, 556 bp, Homo sapiens
  misc_feature 42: s=g or c
  misc_feature 43: n=a, g, c or t
  misc_feature 259: y=c or t
attcacaaaatatttatgatgtatttactctgcaccaggtcsncatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagcyactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacaga

SEQ ID NO: 13055 - DNA, 148 bp, Homo sapiens
  misc_feature 2: m=a or c
  misc_feature 10: m=a or c
amggcaagtmggaggtagcaagatggccgccgctgaggaaggctgtagtgtcggggccgaagcggacagggaattggaggagcttctggaaagtgctcttgatgatttcgataaagccaaaccctccccagcacccccttctaccacc

SEQ ID NO: 13056 - DNA, 207 bp, Homo sapiens
  misc_feature 101: s=g or c
  misc_feature 102: m=a or c
  misc_feature 164: w=a or t
  misc_feature 165: k=g or t
agtaagttcgaagaatgcactgaagtcatagtgcattggtctgagctcctggcagatcctgtgtaatcttcagcctccctgaagctttacagccaggagtsmgattttatcacatgaactttaaaagagtaaagccaaatatctttttattaaaccagagtagwktaattatcagtatatgtgaaatcatgtccactgatcaaggca

SEQ ID NO: 13057 - DNA, 312 bp, Homo sapiens
gaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacacca

SEQ ID NO: 13058 - DNA, 282 bp, Homo sapiens
gactgttgaattgaaaaacaccaaaggagtcttcttgtctggagactggattgttccagttttaaatacctgtgcccataagtatcccatttcatgaatgtgtgttggcatggggaaaaaatttccctgctctttgagtggagcgaaagcaattggttaagctgtagcagcttttttgtttatttttttaaagtaataataaaacttgaactgaaaaaagataaaacttgaactagaatactactcttgtatgcttagaatgtttatagtgtttatgtgggg

SEQ ID NO: 13059 - DNA, 318 bp, Homo sapiens
gggcaacgccacagtttcgtgtgatagcagcagcgggtatatgatacggggccctgtatgcgggccagacagtgcggtaaagccaagggagattatccagacccccaggagcgaacagcaagcagcaaccgaagcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacac

SEQ ID NO: 13060 - DNA, 192 bp, Homo sapiens
actgtttgcttagtaccaaggattttacctgtgtgaactaccctcgtacatatttttttccttcttgttacggtgaatcaattatccatgttctatggaaagccaatcttttatgtgtgtactggatcccatcctgtacccatttaaggctattactctagcaattctttctttcccacattgacaattttc

SEQ ID NO: 13061 - DNA, 276 bp, Homo sapiens
gtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatggg

SEQ ID NO: 13062 - DNA, 234 bp, Homo sapiens
  misc_feature 157: r=a or g
ccagtgtagatgttaggcaacactcttgttggctgcccgtctgtttttcccctagggataccttatgctattaaagccctccacaacctcctgtggatcaagccccgttggctgctcctctgcccttggcaggtgttacagtaattacatcttctgrggtcctcatggttaaagccaccacctggcttctactacttcaggatcctgttatcccaatggatattatcaagccca

SEQ ID NO: 13063 - DNA, 140 bp, Homo sapiens
aagaaagccacctgggcgcaccgcggtgcggacccagcacgcctgggccgggggctgcagcatgctcttgagatctgtggcctgaaagcgctggaagcagagcctgtgagtgtggtccccgtcaccagagccccaaccca

SEQ ID NO: 13064 - DNA, 217 bp, Homo sapiens
acgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaa

SEQ ID NO: 13065 - DNA, 429 bp, Homo sapiens
  misc_feature 292: r=a or g
  misc_feature 293: n=a, g, c or t
  misc_feature 295: n=a, g, c or t
  misc_feature 299: n=a, g, c or t
  misc_feature 349: m=a or c
cctaacacccaagaagccagaacctctggtggggcccaggcccaggctgcagctcccaaggtgacccagtgttctgctaatctggagaaccagaggctcactggtgctgcgggaagatggtttctagggtgagaatgtccactgcaaagccagcaacagtcagcatccatctgagtcttctgcttttctccaaggtgcagagtgggctggcagggccggtactgtgacgagtgtatccgctatccaggctgtctccatggcacctgccagcagccctggcagtgcaactgcrngnaaanggctgggggggccttttctgcaaccagggtaagccttctctccctgaggmagcctgctccctccagagcagccctggacttccctggctgtttgatcactggaaaaataaagtcttcctgcatttgatgt

SEQ ID NO: 13066 - DNA, 179 bp, Homo sapiens
aagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccg

SEQ ID NO: 13067 - DNA, 467 bp, Homo sapiens
  misc_feature 75: r=a or g
  misc_feature 420: n=a, g, c or t
  misc_feature 421: n=a, g, c or t
  misc_feature 422: n=a, g, c or t
  misc_feature 423: n=a, g, c or t
gagttagctagagctgttgccatgacaagcattttcttaagaaagctctgctgttgagatcgtccaaagctgggrggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctggagaaacctggatctttgctagaaagagagagatccagttgtcatcggtatccaggaagcnnnncctcttcctcctcctgacgtctactactacagttgctggttgtt

SEQ ID NO: 13068 - DNA, 398 bp, Homo sapiens
  misc_feature 362: n=a, g, c or t
  misc_feature 371: r=a or g
  misc_feature 393: r=a or g
agttcagagcagctggtcacatgagcctgaattttcagttcagttcattagtcagccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggnagataaaargagaggaagctgggagaagacragcat

SEQ ID NO: 13069 - DNA, 297 bp, Homo sapiens
ccgtggtgctgcagctggcagagaagaatggctacgtgactgtcagtgagatcaaagccagtcttaaatgggagaccgagcgagcgcggcaagtgctggaacacctgctaaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacccg

SEQ ID NO: 13070 - DNA, 222 bp, Homo sapiens
  misc_feature 7: n=a, g, c or t
  misc_feature 8: s=g or c
  misc_feature 110: r=a or g
  misc_feature 111: m=a or c
  misc_feature 112: r=a or g
  misc_feature 136: s=g or c
  misc_feature 137: n=a, g, c or t
atcctcnstggctcctcgaggctccgtagatggtgaagaggttgagatgctgtccagcccacagaggccccggaaagccagtgccgcccgtcagaggggtctcctgagtrmrtgtgggtggctggattctgcatasngggttatcttaaccccggctgtgaaaactggatgaagtagcaatcctttcaaccccaagagtctgtgattcagccagagttacaa

SEQ ID NO: 13071 - DNA, 277 bp, Homo sapiens
  misc_feature 171: n=a, g, c or t
atcttggttgtgggaagtctcgtctaggctgtcctctctccagttgggaggaccaagatggagcgaaggatgaagtagcaagtgtacgtctttcttgggagcaggatgttgcgcaagtttacacttctgaccccatcacactgcttcccactgagatgcaagagaggattnctcatcttccagatgtgcaggctgaaatatttatggatgaaattgtcagatgcctagcatttgctccatgataatctgaggtgtgggccatgtttgaggattaccc

SEQ ID NO: 13072 - DNA, 468 bp, Homo sapiens
  misc_feature 13: s=g or c
  misc_feature 64: k=g or t
  misc_feature 114: y=c or t
  misc_feature 311: k=g or t
atccctccccgcsccctcggccgctccgctccctggcgtgactcggcactgagagtcccgggakaagactcggcggtcgccacctcttctgtccaggcctcggccttcctgagyatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtktgaggattgccccagcattcagttctatgagtaataaatatccacaggctgttttcttggaagtcgatgtacatcagtgtcagtacttattcctttgaagataggaagatgttatgttgatgtcattattacagatgtcattatggctgcattagtt

SEQ ID NO: 13073 - DNA, 181 bp, Homo sapiens
  misc_feature 98: s=g or c
catgttctaaatatagatgtgttaaatttcaaatgtgaaagtttttgaagggtctaaagccagtttgctaatcagggaaatgctgtgattggcgccasacttgcagtccctgagggggattgtgaaatccggcctccgcaactgtgattcaagtctgggatgaaagaaaactccatgatac

SEQ ID NO: 13074 - DNA, 409 bp, Homo sapiens
  misc_feature 20: s=g or c
  misc_feature 163: k=g or t
  misc_feature 340: m=a or c
  misc_feature 367: n=a, g, c or t
  misc_feature 369: r=a or g
acccggcccgagtgcgggcsgtggaaggcggaagtaggagaggagttcggcgccgcttctgtggccacggcagcttcacggtgatgatatggcatctgccagctctagccgggcaggagtggccctgccttttgagaagtctcagctcactttgaaagtggtktccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaamggtctggagctgccataccttgagaantractgctaggcaccgcatctgtcaacctctccaacgtcttg

SEQ ID NO: 13075 - DNA, 119 bp, Homo sapiens
tacctagggcatctgcctccctagcagccagttgcagaagcatgaacctgattcttgaaatggtgagcacctactgagtgcaaagcccacactagccaagaccccgtggtgatacagac

SEQ ID NO: 13076 - DNA, 217 bp, Homo sapiens
aagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgaaatctacagcctgattacatcaaccccagagccgtgcagctgggctcccttctcgtccgcg

SEQ ID NO: 13077 - DNA, 125 bp, Homo sapiens
  misc_feature 6: n=a, g, c or t
gtttantccacctactcagaacacgctggtgtggcagagagagcacgtatgcctgggttttggatgctgagcacagaaagccccatttggaacggctggaggcgatgatgcgccggtccctggag

SEQ ID NO: 13078 - DNA, 690 bp, Homo sapiens
  misc_feature 8: m=a or c
  misc_feature 30: m=a or c
  misc_feature 65: y=c or t
  misc_feature 204: n=a, g, c or t
  misc_feature 205: w=a or t
actctccmaacacatacgcagcagtgttamagctcttttagaatttgtctagtaggctttctggytttttaccggaaagcccctcttatgatgtttgttgccaatgatagattgttttcactgtgcagaaattatgggtagttttggtggtcttgatgcagttgtaagcttggggtatgaaggtttgggccccgcctgggcgcnwccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcg

SEQ ID NO: 13079 - DNA, 106 bp, Homo sapiens
cctaaactctgagtccgcagactgagatgacgccccggattttgtgggcagcgctgcaacttaccctctccgaaagcccgggagtaggggagcggctcctccggcc

SEQ ID NO: 13080 - DNA, 196 bp, Homo sapiens
ttcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccc

SEQ ID NO: 13081 - DNA, 328 bp, Homo sapiens
  misc_feature 10: y=c or t
attcatcagyatgcagagatgacaactgaagtgaggcacagtaaggtgagggctcatgaatgagcctcagaagatgctgaaaatacttgtaatacatggaattaatcttccttttgtgatgaacacacacgttaagtggcaggaatattttgctgaaatggagcttgctggtttcctctctagctcttccccataaagcatataagctatgatttttttaaatgaagtgccacttttatatcaactacttaattgacagctccacctagatgtttcctagacatcttagaaatgacatttccaaaaaatttttttcctttcaaaaccc

SEQ ID NO: 13082 - DNA, 183 bp, Homo sapiens
gagtaggtgatgtacatttttcttgcaggtttgttaagaagttggagcactcttggaaagccctggtacatgacggagtaagtagtaatactagaggctctcttaccgtacacttctgcctccatcacttctgattggcctcagtttcttgcaattttttcttttttcttttttctttttttt

SEQ ID NO: 13083 - DNA, 221 bp, Homo sapiens
attaatcccattttacaataagagaactgaaggctcaggaagtgcgaaagttgtggagccaggaatcaaagccctgttgtctgactctgtagctcacaggccttagtattcctggtatactgctagcctggccaatggagaacgtatttaaaatagtagctatggccatgtacaggtacaggctcacgcctgtaatcccagcactttgggatgctgaggaa

SEQ ID NO: 13084 - DNA, 133 bp, Homo sapiens
gtgtcggtgcctcctcgccatcttgttgcaaagccctttcttgtcggcgggactcccgggggccgcggggcgggaggcatcggaagggaggtagagagggaggggaagaagggaggcagtgccgccttttttt

SEQ ID NO: 13085 - DNA, 485 bp, Homo sapiens
  misc_feature 283: s=g or c
  misc_feature 356: n=a, g, c or t
  misc_feature 358: n=a, g, c or t
  misc_feature 394: k=g or t
  misc_feature 437: r=a or g
  misc_feature 466: n=a, g, c or t
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtgaaatgcctttcgggtcaatgttatccatgcccggcagcaggtgcgcascccgtcaccaacattgctcgcaccagcttcttccacgttaagcggtccaacatttggctggcagcagtcacangnagaatgtcaacgctgccatggtcttcgaattcctckataagatgtgtgacgtgatggctgcctactttggcaagatcarcgaggaaacatcaagaacaattttgtgcncatatatgagctgctggat

SEQ ID NO: 13086 - DNA, 240 bp, Homo sapiens
acttttcacgggtgaggcctggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgactccctaaaggttgaggg

SEQ ID NO: 13087 - DNA, 173 bp, Homo sapiens
aatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccggga

SEQ ID NO: 13088 - DNA, 209 bp, Homo sapiens
  misc_feature 91: s=g or c
agaggttctccagcttttctttgattgtctctgctttagcgtctctaaatccggtcaccatgtcggaccccgaaggcgagaccttgcgaasacctttccctcttatatggccgaaggagcggctctacctgtgcggggaattttctaaagccgcgcagagcttcagcaacgtgagtcgagctctcaacctatccatcaccccatcaccc

SEQ ID NO: 13089 - DNA, 158 bp, Homo sapiens
  misc_feature 49: n=a, g, c or t
aatgaatacaaagccgcggtctgggtgccgcctcggccgcggccgctcnccgcgctcctttgccagaagatcgtactgagaagcactccacaatgccagactcacctgtggatgtgaagacgcaatctaggctgactcctccaacaatgccacctccc

SEQ ID NO: 13090 - DNA, 203 bp, Homo sapiens
  misc_feature 87: s=g or c
  misc_feature 130: s=g or c
agacgccgggcctacagcgggagcgtgaggaaagccgtgcgttgcgttccaaggcatctgtgagcccgcggagtatacaccatgagsaaagctcaccctcccgagttgaaaaagtaagtatgtgtgagasccaaaccgaagtggtcagttatttgcgtcctgcgagtcccttggttccctctccgttagccgaatgtcttgag

SEQ ID NO: 13091 - DNA, 470 bp, Homo sapiens
  misc_feature 16: y=c or t
  misc_feature 220: k=g or t
  misc_feature 424: n=a, g, c or t
agcaaagtcctcaggytcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcakgcagatgtttgtcgactggaatggccgccaaatcttaaaggcagaccacgcaaaaagaaaccatgcacaaagaagagattcattcagtggtgttaaggattccaacaacaattccgatggcaaagccgttgccaaggtgaaatgtgaggccaggtcagccttgaccaagccgaagaataaccataactgtaaaaaagtctcaangaaaggaaaaaccaaaggttgccattggtagaagagtgcagggcag

SEQ ID NO: 13092 - DNA, 480 bp, Homo sapiens
  misc_feature 62: s=g or c
  misc_feature 451: k=g or t
cacttgttgccggcccgctagcccgaaaggttgcgcgcgcagaccgagaagtctcgcgatascagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggtagggactgaaggttggagaagcatattaactgctccagggtcatttgaagctgggctgcaagtccaggtcggctgacctgctcctaggggtctctgaagcaaggaatgttcccatcaggcctgaccgccgctgcctacagagtcacactcaatcctccgggcaccttccttgaaggagtggctaaggttggacaatacacgttcactgcagacactggcagtkagcgcccaagaggctcctgctgtgcccgt

SEQ ID NO: 13093 - DNA, 437 bp, Homo sapiens
  misc_feature 62: s=g or c
cacttgttgccggcccgctagcccgaaaggttgcgcgcgcagaccgagaagtctcgcgatascagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccggttttcgccagtatgaatgctctgatgtagagtaagtttttggcgcaatctaaag

SEQ ID NO: 13094 - DNA, 146 bp, Homo sapiens
accaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgccc

SEQ ID NO: 13095 - DNA, 174 bp, Homo sapiens
atctcttagtttatttaaatcaatttaaagagacagtgaaaagcaagaggaaagagatgggataagtaaacgctgtcaagagacggtgcaaatctggtggaagatgcctgctacctaaagcctacctcatacaatgttcaggggccaccatcccccacctgccccaacctccac

SEQ ID NO: 13096 - DNA, 151 bp, Homo sapiens
acaaccacaagggctgtttcgtcggtttgttgtaaacaacatttgctccagtcatctcactggaaaatagactttctctactgggcagccgctgaggtgagggtgctcaggatgtttaaaaacaaaaccacgcgtctatgcggtagcggca

SEQ ID NO: 13097 - DNA, 317 bp, Homo sapiens
  misc_feature 95: y=c or t
  misc_feature 151: r=a or g
aggaagtgaagtccccgagcacgttagaaagcctgacatggcctgactcgggacagctcagagcagggcagaactggggacactctgggccggcyttctgcctgcatggacgctctgaagccaccctgtctctggaggaaccacgagcgarggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgacccc

SEQ ID NO: 13098 - DNA, 360 bp, Homo sapiens
  misc_feature 185: r=a or g
  misc_feature 204: s=g or c
  misc_feature 219: s=g or c
  misc_feature 351: n=a, g, c or t
acttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcrcgacgcgcccggcccggascccccagcgcaggcscgcgtttgaaggatgacctctaggaagaaagtgttgctgaaggttatcatcctgggagattctggagtcgggaagacatcactcatgaaccagtatgtgaataagaaattcagcaatcagtacaaagccagnataggagct

SEQ ID NO: 13099 - DNA, 268 bp, Homo sapiens
  misc_feature 53: w=a or t
  misc_feature 59: r=a or g
  misc_feature 71: s=g or c
  misc_feature 93: n=a, g, c or t
  misc_feature 103: k=g or t
  misc_feature 111: m=a or c
aaagtgtttttttaaaaagcctggtttttctcaatacgcctttaaaggttttwaaattrtttcatatctgstcaagttgagatttttaagaancttcattttkaatttgtmataaaagtttacaacttgattttttcaaaaaagtaacaaactgcaagcacctgttaataaaagtcttaaataaaaacgaacaggcctagcaatgaaaggatggaatcagcacacgccggtgttgaaaacggctttgacacataggctcaatgtgcta

SEQ ID NO: 13100 - DNA, 437 bp, Homo sapiens
  misc_feature 428: w=a or t
attacgagattggcttggattctgtcggatggacttggggctagctgcggcggggctgggtaagaaaatattgttagaacttgcgggcgacggggagttggggaacctgagaaaatgagtcgaaggctcctaattattggatatatcttcacgggggtgatgagccctcaggtgttgagggagcgaggacgggggaccgaaaagccactgtcctgagacccattcatggcactcgtgccctgccaggccaggcctgcgtcttcagggaaacagtcgggataactatgagagtgtcgcctttgtggcggtgcctcgaagaccttgagcaatccccggactgcgagcagggaaagctgcttccagtacccaaattgacagactgtatttcctcgccagaaaaatttacttgagcttcagtttttcctgtwaagtcgaga

SEQ ID NO: 13101 - DNA, 94 bp, Homo sapiens
aactttcctggctagacttttctcctaaagccttatttgtcattccaggcacttcgatatccttacttccaagttggacacccactaggcgcac

SEQ ID NO: 13102 - DNA, 220 bp, Homo sapiens
gacgtaagcggcgttggcgtggtgagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggc

SEQ ID NO: 13103 - DNA, 71 bp, Homo sapiens
tggagaaaaatcaagcagaaggggagaaggggtgatggtgaaagccttggcaattcttgatagggtaatca

SEQ ID NO: 13104 - DNA, 410 bp, Homo sapiens
  misc_feature 53: y=c or t
  misc_feature 306: n=a, g, c or t
  misc_feature 310: m=a or c
  misc_feature 383: w=a or t
  misc_feature 393: k=g or t
  misc_feature 394: s=g or c
aagtaggcggggtgacgtgtggttgacgagctcggcggcgggtttgctgagayctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggtagcnaggmgaagaaccaggcaggctctgtggttcaggactcccgacttgacacgatattttttgctaagcaggtaattaawaatgcttgtkstactcaagccatagtg

SEQ ID NO: 13105 - DNA, 329 bp, Homo sapiens
aacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggatttttttt

SEQ ID NO: 13106 - DNA, 284 bp, Homo sapiens
ctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccaggcttcctgttgaaataaatatatagc

SEQ ID NO: 13107 - DNA, 308 bp, Homo sapiens
  misc_feature 99: r=a or g
  misc_feature 100: w=a or t
  misc_feature 102: w=a or t
  misc_feature 119: n=a, g, c or t
  misc_feature 130: m=a or c
  misc_feature 202: y=c or t
cattttaggtggtccgcggcggcgccattaaagcgaggaggaggcgagagcggccgccgctggtgcttattcttttttagtgcagcgggagagagcggrwgwgtgcgccgcgcgaagantgggaggcgamgagagcggccgccgctggtgcttattcttttttagtgcagcgggagagagcgggagtgtgcgccgcgcgagyagtgggaggcgaagggggcaggccagggagaggcgcaggagcctttctttgggctattgggcccctcctgggccttctttccagactgttaataacacagcagccc

SEQ ID NO: 13108 - DNA, 256 bp, Homo sapiens
  misc_feature 48: s=g or c
tctctgctacctgtagctgagggtgctgttgatgggcagcgcggcgcstgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgaggcttggcttgaggcacgcctggtggaaaggg

SEQ ID NO: 13109 - DNA, 225 bp, Homo sapiens
  misc_feature 12: s=g or c
  misc_feature 79: r=a or g
  misc_feature 106: s=g or c
  misc_feature 188: r=a or g
agtacaggttcstgctgttggctgggctcgggagggaacgctccaggtaaagcgctgggggaggaagcgacgccgaggrgctacggtttcctccagaggtctccgsccctctgcccctatattcccagagctcgagtctgatccgggccttgccgggcaccctggaaaggcgggggtgatagtacagrtggagacgcaactgcagagcattttcgaagaggtggt

SEQ ID NO: 13110 - DNA, 797 bp, Homo sapiens
gttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttactctggggccagccaggaaaaacaaacaacccggggcacattgggtagactcagtgtaggaaaaatggtggcagctccactgtttatttttggtgattcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagc

SEQ ID NO: 13111 - DNA, 178 bp, Homo sapiens
agttctagaacgttgctgtggtagcgctcgggcgcatgttaggacgaaggggaaggaggagaagcgcttaaagcggcgggagcggtgcgggagaggggttggacccagggctgaggcaggcccccccctccctcccgcctcagtggatcatgcccagggcggcagcggcggcgggttg

SEQ ID NO: 13112 - DNA, 300 bp, Homo sapiens
aacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtgagcaatgagccaaggcggggaggacctgaggaaaaggagctggttcctgctgtgtctggggtgaagtgaaagagttaaaaatgatttttccacaccacgaagaag

SEQ ID NO: 13113 - DNA, 64 bp, Homo sapiens
ttcggacggctgcagcatcgcggtggggatcgaaagcgggggcttctgggacgcagctctggag

SEQ ID NO: 13114 - DNA, 434 bp, Homo sapiens
  misc_feature 113: k=g or t
  misc_feature 205: n=a, g, c or t
  misc_feature 269: n=a, g, c or t
  misc_feature 424: r=a or g
aaggttccccttaacacagagcgccccgcagtcttcgcggaaagcgttcggggtaggcgatggctgcgacgcgtgcagggccccgcgcccgcgagatcttcacctcgctggaktacggaccggtgccggagaagccacgcatgcgcactggctggccgaggtgatccagaagcaccagcggctgctgtggaccctggaatccctngtgactgggcgggctgttcgagaggttcgagacggggacgtccagctggcccagcagctgctcnactaccatgcaatccaggcatccacccaggaggaggcactggcaggctgggagcccatgggagtaattggcctcatcctgccacccacattctccttccttgagatgatgtggaggatttgccctgcccctggctgtgggtaaatgatggcctgrggggtcctga

SEQ ID NO: 13115 - DNA, 360 bp, Homo sapiens
  misc_feature 224: r=a or g
  misc_feature 293: y=c or t
  misc_feature 297: y=c or t
  misc_feature 323: n=a, g, c or t
gtctctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcrtccaaaggagagggctttgatgtcatgaagtcgggtgatgcgtgtggcgctgattggatttccctctgygggyaagtccacattcttgagtctgatganctccacggccagcgaggcagcgtcctatgagttcacc

SEQ ID NO: 13116 - DNA, 180 bp, Homo sapiens
  misc_feature 143: s=g or c
  misc_feature 145: n=a, g, c or t
  misc_feature 147: n=a, g, c or t
agtaggcgagggcgcggctgcggggttcctggtgctgaggacggacgccattggagttcccgagaagcatggctgagggaagcttcagcgtgcaatcggaaagctacagtgttgaagacatggatgagggtagcgacgaagtsgngngaggaagagatggttgaaggcaacgactatgaa

SEQ ID NO: 13117 - DNA, 473 bp, Homo sapiens
  misc_feature 434: s=g or c
  misc_feature 438: n=a, g, c or t
  misc_feature 439: s=g or c
atccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggasgttnsagcagtatcgcttggttattccaaatttatgggc

SEQ ID NO: 13118 - DNA, 479 bp, Homo sapiens
  misc_feature 217: s=g or c
atccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccastacctcctttggttcgggagaaagctacgaccaagtacgcccagctcgggccttagaacttctgaacgggcagtgcgggtaggccctgcttagcccttcccggaggacacctgaccaaaagaggaagatagtcttgggacccttgcatggtgtttcaaagggtggtgaagaactaagatatcttcttgaagccctgcatcctcccattctaatttgaactgttagcttcccatcactgtcatctcgggtagaagaatacatg

SEQ ID NO: 13119 - DNA, 454 bp, Homo sapiens
  misc_feature 16: w=a or t
  misc_feature 32: k=g or t
  misc_feature 33: y=c or t
  misc_feature 367: k=g or t
  misc_feature 410: k=g or t
ttttttttttcctctwacccccccttctggakyggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaaacaaaacttggcaagcaaacctgcggctgatctccaagtttgatactgttgaagacttttgggctctgtacaaccatatccagttgtctagtaatttaatgcctggctgtactcggggacggttctagtttttgctcattcagtatgatgtkggttgtgtgtttgttaaagatggctcttcttattttgaggtakattccttttgatgcctagtctgttgggggtttttatcatgaaga

SEQ ID NO: 13120 - DNA, 229 bp, Homo sapiens
gtttagtttttcacatatctcaaagtgcatatgttttaattcacttgattctcccagcaatagcatgaactattagcctcattttgtggattaggaaactgtagtttaaaaaggtaacttagctgtggtcacaaagctagtaagtagcagagccaggttatggtcccagttctgttggattccacggcctgtgccttgaccacttctcccagctgcttccactgcacca

SEQ ID NO: 13121 - DNA, 317 bp, Homo sapiens
acagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgagtaagtacttttcagtttttccattttatctgaaactttaagttggcatttctgaccagcctttcttgagaccatcattttttgggcacttactgtagacaggaatcagcaccctagcctccttcagcccaccccatgtaacactaaagagacaactgg

SEQ ID NO: 13122 - DNA, 504 bp, Homo sapiens
ctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagaagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgct

SEQ ID NO: 13123 - DNA, 353 bp, Homo sapiens
  misc_feature 40: y=c or t
  misc_feature 47: r=a or g
  misc_feature 129: s=g or c
  misc_feature 165: s=g or c
  misc_feature 216: r=a or g
  misc_feature 233: s=g or c
  misc_feature 254: s=g or c
  misc_feature 271: r=a or g
  misc_feature 282: s=g or c
  misc_feature 289: n=a, g, c or t
  misc_feature 345: s=g or c
agtaccccattccttgctgcaatgtaattacaagtgtgcycctggtrgtctttaactgaagggcactgactgggtactggtgaagttccccgcaggaactgagtcagaccccatctcagggccctgcasaagataggtgcctgctctaaggcgtggaccctcgcsacagccctggcccgtcttgacgggcgagggttactgtacttgtcccaaccrtacagatgagaaagctsagactcagggccagcaacccsggtcccagcggagcgcrccggcacacgscgacacntcagcaccagtggcggtggccaccactgtgcgcggagatggctgcgacgcgtgcgsaggtaaag

SEQ ID NO: 13124 - DNA, 348 bp, Homo sapiens
  misc_feature 303: r=a or g
  misc_feature 315: r=a or g
  misc_feature 331: s=g or c
aaattttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagrccctggagtgaraccattaagcttgtgsgtcaagtcatggtaagg

SEQ ID NO: 13125 - DNA, 277 bp, Homo sapiens
tttacatagtggaaattaaaaaatgaagtgtgactactctatttacaacttataacaggacatttgcctttttcctccaaggtatgtatgagtgtgagtaatataatttagcaaaggaaataagagttaagttattgaacccctcctgggtcccaggtgcagtgagatgtgctttatacgcccccttccctcccacccccactccaggtctgcaaagctcatttggccagctaggccactggaggctctatttggactagtgaatcttacatggtat

SEQ ID NO: 13126 - DNA, 452 bp, Homo sapiens
  misc_feature 404: r=a or g
  misc_feature 408: r=a or g
actgacaggttgcccacctcccccaacgccaccccgcttcgcagtagacggacagaggagtcgtagcggtcgaggcttttgcggctccggcgtgccggaaagtgcatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaractrattgatcattactactttaatttagctatcagtgccagctgttt

SEQ ID NO: 13127 - DNA, 458 bp, Homo sapiens
  misc_feature 399: n=a, g, c or t
  misc_feature 400: k=g or t
aaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggnkgcatcatctcattttttaggaagacatgataatactgcccatcatattcatgtgtact

SEQ ID NO: 13128 - DNA, 485 bp, Homo sapiens
  misc_feature 111: y=c or t
  misc_feature 148: r=a or g
  misc_feature 150: m=a or c
  misc_feature 151: s=g or c
  misc_feature 152: n=a, g, c or t
  misc_feature 158: y=c or t
  misc_feature 161: n=a, g, c or t
  misc_feature 164: r=a or g
  misc_feature 282: m=a or c
  misc_feature 312: r=a or g
  misc_feature 327: n=a, g, c or t
  misc_feature 328: n=a, g, c or t
  misc_feature 411: s=g or c
  misc_feature 470: n=a, g, c or t
tcttccggttcccgcgcggcgctccaaagctcggggagtggtggtctccctttcctggagtcatttgtgggagttagggtcttatcctgatctttcctcgtcccccgctcycccgtcctccgaggtggcagctgcgtagaagtctggramsntttttyctnagrgtcccagaattgagactgaagtgtacccagagacacaaagaaatacagaagtccagaatgatcaaatgagatcactacccaatgaaatgatgggccgaggagccagaagttgtcctamtacctgctttccaggtccagattccacgaragccttctgggctcnnaccagagaccctcagtgaagactctgttgaagactttaagaccatgctagaaagcctcccggcagaggttcaggaagttctgstatgaggatgcagctggccccagggatgtcctcaggcatctctaggaccttgctggacngtggtggctgagact

SEQ ID NO: 13129 - DNA, 309 bp, Homo sapiens
  misc_feature 126: m=a or c
  misc_feature 132: s=g or c
  misc_feature 149: w=a or t
  misc_feature 155: s=g or c
  misc_feature 158: n=a, g, c or t
  misc_feature 160: k=g or t
  misc_feature 167: m=a or c
  misc_feature 177: r=a or g
  misc_feature 180: m=a or c
  misc_feature 242: s=g or c
acggaaatcaggaagtgcgagagagctgagagccaggactcagtgctgagcttggtgtcccaccgccacaaggaggcagggaagaaacccactagtcccagctcctggggtggcacagacattgcmactggscctgcctgtggggtccwaggggsccntkggctacmaggaggctargamcactgctcatgaatgacagtgagccctgaaagctctgggggtgtcacccagtcccacaagcstgcatcccctgcagtggagatgggctcagctcctggacgtgccacagacagaaagcataacatacac

SEQ ID NO: 13130 - DNA, 432 bp, Homo sapiens
  misc_feature 68: n=a, g, c or t
  misc_feature 105: k=g or t
  misc_feature 198: r=a or g
  misc_feature 199: m=a or c
  misc_feature 378: n=a, g, c or t
agctttgcggacccgggagctcgggacgcaggcggggcttgtgctccgcgggggcagggcgtagggtnggcctcctacctcccctgatctcgcggtttgttccgkttcattggagcttcccggaccgtgtgctcgacggtgccctaggtgccgtggggccacacgcgagtctgataagcaccctcccccggaatcatrmggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgnagagtcattcctgcctttgagcggactcccttttaagggtcccactctgttgcc

SEQ ID NO: 13131 - DNA, 452 bp, Homo sapiens
  misc_feature 68: n=a, g, c or t
  misc_feature 105: k=g or t
  misc_feature 154: w=a or t
  misc_feature 155: r=a or g
  misc_feature 174: r=a or g
  misc_feature 286: k=g or t
  misc_feature 291: s=g or c
  misc_feature 294: k=g or t
  misc_feature 301: k=g or t
agctttgcggacccgggagctcgggacgcaggcggggcttgtgctccgcgggggcagggcgtagggtnggcctcctacctcccctgatctcgcggtttgttccgkttcattggagcttcccggaccgtgtgctcgacggtgccctaggtgccgwrgggccacacgcgagtctgrtaagcaccctcccccggaatcatgcggtgctgtgaggcctagcgaagatgaagatagaatgcaaggtagaaagtgctggatacctttagaaagctgcaggactggtgcgatkgggasttkaagacgkaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagcca

SEQ ID NO: 13132 - DNA, 214 bp, Homo sapiens
agtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgc

SEQ ID NO: 13133 - DNA, 255 bp, Homo sapiens
  misc_feature 188: y=c or t
  misc_feature 243: k=g or t
cggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttyaaggcattgctaggccctcgagatactagagtaaaaggatggtttcttctggackattatataccca

SEQ ID NO: 13134 - DNA, 476 bp, Homo sapiens
  misc_feature 74: s=g or c
  misc_feature 452: s=g or c
atccgtcccggataagacccgctgtctggccctgagtagggtgtgacctccgcagccgcagaggaggagcgcasccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagtgcgaagggccatgaagggagccggcactgatgasggctgcctaattgagatctggcct

SEQ ID NO: 13135 - DNA, 502 bp, Homo sapiens
  misc_feature 100: s=g or c
  misc_feature 478: s=g or c
atggtggggcatgtgtgtggtggaatgtgtctggtgtgtgtggtgggatgtctggccctgagtagggtgtgacctccgcagccgcagaggaggagcgcasccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagtgcgaagggccatgaagggagccggcactgatgasggctgcctaattgagatctggcct

SEQ ID NO: 13136 - DNA, 202 bp, Homo sapiens
aggggcgggcgtcggggacattaccggacaggccttgtccggcaataccaaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccga

SEQ ID NO: 13137 - DNA, 138 bp, Homo sapiens
actaaaacctaatcatttagtcacagtgtaaaaacaaatggaaataacagctcaaatcttcaaaatattactatagcattatgtttaaaataatctacaacaaaaatgtaccattttcaagcagtactacattaggag

SEQ ID NO: 13138 - DNA, 632 bp, Homo sapiens
cgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaatctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcct

SEQ ID NO: 13139 - DNA, 352 bp, Homo sapiens
  misc_feature 89: r=a or g
ttaacccttgagtgcatgtctttttgatggatttaatattctgtgtgatgagctgggaagtgtgcataaagctgtcctgctgcacaacrgagttacaaatgtcctgaggacaagtgcttaccttgccacttttcttaatggaatatcatttttacttggaagaatgacagacaactatggttatttagactcgggaatttggcagacattttctctaaaacagatgaagtgatgtggcactttaaaacaaacaactggtggtatttattgccagtgataaaattcaggcttccaagaacattagaatttcgaaaaatttgtactggccatcatgacagcttctcagaatttt

SEQ ID NO: 13140 - DNA, 97 bp, Homo sapiens
aggcagagaggagactatggaacgtcagactgctgagcagagagtctccttcaggcaccatgaaagctgtgctgcgcaaggctggaggcacgggccc

SEQ ID NO: 13141 - DNA, 282 bp, Homo sapiens
  misc_feature 98: n=a, g, c or t
  misc_feature 282: n=a, g, c or t
agccttgtaagtaacgccgcggaccgggaaagtgggaggggccgctcccggaacgcagccttcttgtaagaacctccaaggaagcaagaagaaaaaangaggcgctaccctggcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggn

SEQ ID NO: 13142 - DNA, 142 bp, Homo sapiens
attttagactcgctgtttgtggcccaggtgcaggaagcttacgcggtggcagccgctcgctgaggtagtctctcgcggcgccggggatccctgaacacagacagcgcgggactgagaaggaaagcttctttctgggcaacca

SEQ ID NO: 13143 - DNA, 200 bp, Homo sapiens
atcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgccccttt

SEQ ID NO: 13144 - DNA, 126 bp, Homo sapiens
tagaactactccaaagctttcccttctcagactaagcttttgccccatcagtggtagctaccaggacaaatttttcaccttaaatctagcatgtgatgtaaattctattggattatgttgacttac

SEQ ID NO: 13145 - DNA, 183 bp, Homo sapiens
  misc_feature 45: k=g or t
  misc_feature 110: r=a or g
actctaagggaagcgttacttgaggctcggttgggaagagatggkcagctctcaaaaaaggcacaaacaattgaaggatggataccatggcatatgttaaaagcgtgttraaaggaaaataagaaagccaggaatctcaggatgaatcagtctagatcgagatcagatggtggcagtgaagaa

SEQ ID NO: 13146 - DNA, 255 bp, Homo sapiens
ttttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggtaggtgagcccggcgacc

SEQ ID NO: 13147 - DNA, 282 bp, Homo sapiens
  misc_feature 32: s=g or c
  misc_feature 210: r=a or g
  misc_feature 229: r=a or g
ttttttgttttggggaggaagggcaggggctsgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtraccggcaatggcggcgctracgagagtcctggtcagctgagtggaaatagaaggatttctgctgccatcatc

SEQ ID NO: 13148 - DNA, 148 bp, Homo sapiens
tctgctcaacataaaggaactctgctcgatcactcctttcctagaagttctgatgaggggaatgaggacctaagctccattctaaaggtcagctggcatgacttatattcaatatcctaaagccaatgactgtcagtatttttttttt

SEQ ID NO: 13149 - DNA, 291 bp, Homo sapiens
cataactcaatcagggctgttgatatggagacttctgacttgacaccaaaaggacctaatttatatagtgactgttttgggcatcagaaggtaaaggaacttgtgtgaaaccctgactcaccatttgttgcaaatggcagttggaaactcctggggtatcctactgcctactggcccttctctacatgtagctgttcttggttaagggatctcctttagcatgtatgagatggggaagtacaagcatataacatcaagttctactgtatattcagatgtagaagcaacaac

SEQ ID NO: 13150 - DNA, 502 bp, Homo sapiens
  misc_feature 321: y=c or t
  misc_feature 339: r=a or g
ataaggggcttttccctcttgttcggcacttcctgctgccacgtggagaagggtgtgtttgtttccccatctgccatgattataagttttctgaggcatccccagccatgctgaactggaagtggcactaaggtccaaaggaagctacatatgggtggtccctgctacaccagcctcccaagcctcccagtgcaccttctaggagacaagcaaggaaggccgctgcttgtttgtcatcctgctcatggcggtgtactggtgcacggaggccctgccgctctcagtgacggcgctgctgcccatcgtcctcttccccttcaygggcatcttgccctccarcaaggtctgcccccagtacttcctcgacaccaacttcctcttcctcagtgggctgatcatggccagcgccattgaggagtggaacctgcaccggcgaatcgcctcaagatcctgatgcttgttggagtccagccggccaggctcatcctggggatgatggtga

SEQ ID NO: 13151 - DNA, 162 bp, Homo sapiens
acaaggaagagagggagaaagtggtataactagatggtatgaacttcaaaggaaggagtggttttctccaggctgcaatggttagaagcagtgttagggagtaaggaagatactgatcccacttccaacctgtggatatgtggaatacatgagaataagccc

SEQ ID NO: 13152 - DNA, 135 bp, Homo sapiens
  misc_feature 127: w=a or t
aataaggaagtggaattccaaaggaaggcaaagtgtaaagtcgtctttatggaaatgagtgatgaaggtgaatacctgaatgagatgtcaagaggaggaacacactggagagaagcagtaaagattwaggactga

SEQ ID NO: 13153 - DNA, 395 bp, Homo sapiens
acgttggaacggaacgtggaggtggccctggccggggaggaggggcggcggcgaatgctgggagagtccgacgagcgctgcactaacgcaggatccggctgccgaagtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattacag

SEQ ID NO: 13154 - DNA, 478 bp, Homo sapiens
  misc_feature 7: n=a, g, c or t
  misc_feature 8: n=a, g, c or t
  misc_feature 9: n=a, g, c or t
  misc_feature 131: w=a or t
  misc_feature 135: w=a or t
taaagtnnnaattagtcaaagactaatccaggttagattgaccggttcactgctcacttgcaaccttatcaaagggtttgacaaagggaaatgtaaaataaatctgtttatggatattgagtgcatcttgwatgwgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaa

SEQ ID NO: 13155 - DNA, 424 bp, Homo sapiens
attttgtaagccagtgctgccaaggaaaggaatgcagcaacaccagcgatgccctggaccctcccctgaagaacgtgtccagcaacgcagagtgccctgcttgttatgaatctaatggaacttcctgtcgtgggaagccctggaaatgctatgaagaagaacagtgtgtctttctagttgcagaacttaagaatgagaccatcaagcttcagatgatcgtgcaacaaaggttccagccagttctaggtgaagacaccactgctggccatgaaagagctaccctgcctccactagacagagcagggaacaccaggtgatggtgcagattgagctgtagactcacctagacaaatacccccttggggttcacttcctacccaagaagctggatgaggcagtggctgaagtccacctgcacaggcta

SEQ ID NO: 13156 - DNA, 138 bp, Homo sapiens
ctgatatatcttccttagctgtactatcacatctttttgtgagataccaaaggaatttttgttagggtgcagcattgctgtctgtcctacatctgatttttagaatctgacatgcaaagtctcacctgccgcaacacc

SEQ ID NO: 13157 - DNA, 278 bp, Homo sapiens
  misc_feature 89: r=a or g
  misc_feature 91: r=a or g
  misc_feature 95: n=a, g, c or t
caggatcagttaactattgcatttatatgtaccgtaggctttgtattcaaaaattatctatagctaagtacacaataaggcaaaaacararaganaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggc

SEQ ID NO: 13158 - DNA, 237 bp, Homo sapiens
  misc_feature 107: n=a, g, c or t
actggtcttatccttatggaatagacagtacacggatctggaatggaagcaaataataaccgggtctccagattccatcgtatcacagaacatagaaccaagaaagnaccttagaagtcatctgatccagtcacccctgttttaccaatgaggaatctagacccagaagaagttaaaggacttacccaagagtacccaacaactctctcaccaccccaggctcccatctttgtgtct

SEQ ID NO: 13159 - DNA, 404 bp, Homo sapiens
  misc_feature 342: n=a, g, c or t
  misc_feature 343: r=a or g
tcacattttcctgtctttctggtgaattagttctttgattcttaagatcctctagttgtggagggtatgaccagaggacccagggaagacacttctgctaccatctagttggggtactccccagtggtcccagctatggaagactggtcttcctggtttagagtgcctcaataagaaaggacttccatgagacttagcactattccatctccattctcctccgaagtcttttacgttcctcaggatagataactcaaagttggccaggcctggtggcatgcacctgtagtcctagctactcatgaggccaaggcaggagtataaggatgcaagggagttatnraggtgccactgcactccagcctgggtgacagagtaagatgtctcataaaaagagcaccacg

SEQ ID NO: 13160 - DNA, 129 bp, Homo sapiens
  misc_feature 93: s=g or c
  misc_feature 128: r=a or g
gaaacaggacacagaggttacactctgggatcctggccatgaggttggatgcctcaccttactgaaaggagacactggacctaaatggcgcasatgattttgttcctgcttggctaaatttctcaacrc

SEQ ID NO: 13161 - DNA, 203 bp, Homo sapiens
  misc_feature 191: m=a or c
  misc_feature 201: m=a or c
  misc_feature 202: m=a or c
aaaaaggattaagccacagatttaagcgccgggagcccatttctgccttgcaaaggagaccggactgaaaaacctaaagccagctctgatttcttttcgccaagtgggaaggtggtttatttttcttgctttttggagtcaacacccttccccaccagcccttatccccaccctcaccccgcaaccccttmacgccccctmmc

SEQ ID NO: 13162 - DNA, 229 bp, Homo sapiens
tttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactagg

SEQ ID NO: 13163 - DNA, 440 bp, Homo sapiens
  misc_feature 341: s=g or c
  misc_feature 391: n=a, g, c or t
  misc_feature 408: y=c or t
tgtggataaccttgtctcgaacgtatgcttttgaaatgcccttcttcaaatgtgtgctttggccgtccatgcaaccacccctactaagctcttgctacagagaaggcatggtgccaagtatccaaccacagtgaaactctctgctcccagtaagctggggagcagagactggggcctgaaaggagacttgtcagagtacgtggagcctgagcctcctttcccactagctctgtcattaagtgagtggcgaagagaaggcccagtggatcaccagttctcaccatgatggcactgtggctgccagggaccaaactctcagtcctgaggtgtttttgtagaascatttaccttacctggaatgatgcctcattcttattcctcacccttatgncgtacacatccaaataycacccatacttcactgttaacttcaatgcatc

SEQ ID NO: 13164 - DNA, 164 bp, Homo sapiens
aagtaaatattgtgtcatcccagggacaagcaggaccaagccttgaaaggagaggtcagactcccctctgtgttgatttccccaggagaagctcgggaaatgagccggccgaagacgagggaatcagtgcagtgagatgtacagaaggaagtctaattcaaaag

SEQ ID NO: 13165 - DNA, 248 bp, Homo sapiens
tagaggaaaatgtcaaatacgattaattatgaccagaaatgtattttggatgtttgtagagttgtatttcatatcacattttacaaatttcttccgatttaaaggagagttctaggaagttttgtgatctatgtccggtgtgggtttttgtcctctcgagttttgtctctaataaaggccttttttgtatcaaattacatacgctttttactgcacaatttttgtattgaccttatttcaactgaagc

SEQ ID NO: 13166 - DNA, 330 bp, Homo sapiens
aggaggaggaggaagaggaggaaggagggcgagcgaggaggatggcggagtcggggctcctgacggtgaattatgtaacctcattacgctggatgtagctcacaatcaacttgaacaccttccaaaggagattggaaactgtacacagataaccaaccttgacttgcagcacaatgaactgctagacctcccagatactataggaaacctgtccagtttaagtcgtcttggtctgagatataacagactgtcagcaatacccagatcattagcaaaatgcagtgcacttgaagaattaaatttagagaacaataacatttctactttacc

SEQ ID NO: 13167 - DNA, 230 bp, Homo sapiens
  misc_feature 31: r=a or g
aggaagaggaggaaggagggcgagcgaggargatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatcttt

SEQ ID NO: 13168 - DNA, 386 bp, Homo sapiens
agtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgcaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaag

SEQ ID NO: 13169 - DNA, 300 bp, Homo sapiens
  misc_feature 48: y=c or t
  misc_feature 49: w=a or t
  misc_feature 54: w=a or t
actacccaggaaggcggactgggtgcgagcgccctaccgctttcgctywtcccwtcgcggtgcccactccactccttgtgcggcgctaggccccccgtcccggtcatggccatgctcagggtccagcccgaggcccaagccaaggtggatgtgtttcgtgaagacctctgtaccaaggtaagacatgcctcatcagcgtggccccacccctgcccaactcctactgctcaaccctgcctcactacctaggacgggcatttgatgctgactcccatcctcctccacccccacctcacacac

SEQ ID NO: 13170 - DNA, 259 bp, Homo sapiens
  misc_feature 45: y=c or t
  misc_feature 170: k=g or t
agcctaagctctctcgccaaccgtggtggctccttgcgttcctayatcctctcatctgagaatcagagagcataatcttcttacgggcccgtgatttattaacgtggcttaatctgaaggttctcagtcaaattctttgtgatctactgattgtgggggcatggcaaggkttgcttaaaggagcttggctggtttgggcccttgtagctgacagaaggtggccagggagaaggcagcacactgctcggagaatgaaggc

SEQ ID NO: 13171 - DNA, 397 bp, Homo sapiens
tctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgct

SEQ ID NO: 13172 - DNA, 267 bp, Homo sapiens
ttctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctctt

SEQ ID NO: 13173 - DNA, 148 bp, Homo sapiens
caatgtgaatagcttagaatactgcaaaggataagctaattgaatgccttgaaagtattatccactggtcagatggtcaacttttttcagtattatttatagttggcacttgattgcagttctgtgaggcttgagcattcatacaccc

SEQ ID NO: 13174 - DNA, 146 bp, Homo sapiens
aactaagagtactagacataactgccctcacagcactcctgatatgtgacttatcaccagatcctgcgattgctgacagcggtgcacagaacagtctggaatgttgctagggacaggcagatggaaaggatactgcagagaagacc

SEQ ID NO: 13175 - DNA, 137 bp, Homo sapiens
atacagagttgttgaaaggatccagtgacaaaagtattgggacagagtgagtcctagtaaattaaagctggttgtattattaatattattcttggccaagtacagtggctcacatttgtaatcccagcactgggacg

SEQ ID NO: 13176 - DNA, 479 bp, Homo sapiens
  misc_feature 143: m=a or c
  misc_feature 146: m=a or c
  misc_feature 148: n=a, g, c or t
taatgaatttcaaaaagatcagagtcggctaaaggaaattgaaaaacaactgacacagattttacctgtcaactctttacaaacagaagatcgaatgccttgcctactgttttcctttgtaggatgacatgacttccttttamaamantcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatg

SEQ ID NO: 13177 - DNA, 256 bp, Homo sapiens
  misc_feature 110: w=a or t
cctgggaacccttcaataagagcaaagcaggagtttgttttttctttgtgcagatacatacagagactgggatatgtaaaaattaagtatcacaaaagaccatcacacgwttctaccaatgcatgttgcatctataattcacgaacatggtcaacaagatcatgttcacttcaaccccatttcatttaaattaaagaaaaaaacctggccgtgagccacggcacctggagagaaaaaagcttctttaatgacgacc

SEQ ID NO: 13178 - DNA, 229 bp, Homo sapiens
tcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatg

SEQ ID NO: 13179 - DNA, 259 bp, Homo sapiens
  misc_feature 166: n=a, g, c or t
atatgagctggcaactgctttcacagagttctatgatagctgctactgtgtggagaaagatagacagactggaaaaatattgaaggtgaacatgtggcgtatgctgctatgtgaagcagtagctgctgtcaggccaaggggtttgatacctgggaataaaacctgncaaaggatgtaatccttcataggtttgaacactgtgtgtttttaccaaagtggccattggcactgtttgcttttttacaatcatgtggacaca

SEQ ID NO: 13180 - DNA, 422 bp, Homo sapiens
aagttacatcagtgttgttttgtttaaaaagccttcatgagatacaattcacataccatataatcacacatttaaaatacacaattcagtggttttaacatatttaaatacatgtgcaatcatccccccagacaaattgtgttttctaaaggatgtgtatcacttacctttggttacctcatagactgtagcaatcttagtgtatagacattttgcaagtcatataaacaagtattgatttatatattttgtctcaaaagtggaaaaattatattgtctaattatgatgaattattttcttgtatcaagctgaattttctaaaagttaaccttgtgggctgttgccaaaataagagtatttagaggacactgattagttgtcaatactttagcaagccactaaagataactatattcctttg

SEQ ID NO: 13181 - DNA, 270 bp, Homo sapiens
  misc_feature 45: w=a or t
ataactatttacatgaagtactacggtgtattgtttgggtttttwtgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagg

SEQ ID NO: 13182 - DNA, 683 bp, Homo sapiens
  misc_feature 11: s=g or c
  misc_feature 12: m=a or c
  misc_feature 33: r=a or g
  misc_feature 280: m=a or c
cagagggatasmgctgaccctgcagatccagarcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgamactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataagatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtca

SEQ ID NO: 13183 - DNA, 395 bp, Homo sapiens
  misc_feature 141: n=a, g, c or t
  misc_feature 143: n=a, g, c or t
  misc_feature 289: r=a or g
attctttgttggaaacaggaaaattttttagattatttggtgtacggttttgctcacaacaataggtggaagttgctagtgcagtcttggtctgatggctgtgtgcatcgcacattcggcttggtgaaatccttctctaangnctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtraaatggccatctttaagcatatttattttctgccactttatttaaaggcaagcaatattttcttgatcataaatattttgtaatgaaatacttcctcttttccagg

SEQ ID NO: 13184 - DNA, 253 bp, Homo sapiens
tgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaagcttaaagtaggacaaccatggagccttcctgtggcaggagagacaacaa

SEQ ID NO: 13185 - DNA, 399 bp, Homo sapiens
  misc_feature 172: r=a or g
  misc_feature 177: w=a or t
  misc_feature 185: m=a or c
  misc_feature 221: m=a or c
  misc_feature 225: m=a or c
  misc_feature 229: r=a or g
  misc_feature 237: n=a, g, c or t
  misc_feature 245: y=c or t
  misc_feature 251: s=g or c
ttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggraaaawtaaaaaamccatgtatatttgtacaaaaagtttttaaagttatmctamcttrtatttccnatttatgyccaggsgtggaccgctctgccacgcactagctcggttattggttatgccaaaggcactctccatctcccacatctggttattgacaagtgtaactttattttcatcgcggactctggggaagggggtcactcacaagctgtagctgccatacat

SEQ ID NO: 13186 - DNA, 396 bp, Homo sapiens
tttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttct

SEQ ID NO: 13187 - DNA, 278 bp, Homo sapiens
  misc_feature 192: r=a or g
atgagtgtcatcccattgaatcttctgggaggtcctacaagctgggagcctcgggaagaagagtggtggggcctcctgggagctgggcatggggctccccatcagttccagctctgacctctctgggctgttcaggcaaaggcagcagttgctaatgaagacactggaggacagcgtggcttagtcagcacrggaaggaaatgacttagtgcagccgggtgctggcaggcgaccacagcaggggcaggcagcccataagaccagcacagccaggaggc

SEQ ID NO: 13188 - DNA, 415 bp, Homo sapiens
  misc_feature 306: n=a, g, c or t
atttttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgncgaaagttgtgctaaaaagcaccaccaagatgtctctaaatgagcggtgaggcagccaacagcaacttcaactccttcctaagaaaacattacttaacttggccctggg

SEQ ID NO: 13189 - DNA, 256 bp, Homo sapiens
agaagcgccgttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcataatggaaaactcagggaaagcaaataaaaagg

SEQ ID NO: 13190 - DNA, 356 bp, Homo sapiens
  misc_feature 256: w=a or t
ggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcwcccctgctggtgggggcttccctcggaggcactcagtcaccctgcccagctccaagttccaccagaaccagctcctcagcaagcctcaagggtgagccag

SEQ ID NO: 13191 - DNA, 468 bp, Homo sapiens
  misc_feature 89: k=g or t
tctcacttaaaagttccctaaagctttggtagaaaggagacaggaagggcctagtctgtttttgtgttgggctactctctgatactatktttctcctttagatctagggttaacttgtaaggtctctagggattttaacaagattttctttattttagaagtacacagattaaatttcaaatgatcagcacaatcccacattctcaaaatgtagattcagttgtttaagagtttaagataatgtcgagtctttaacagtttgacatactgttttaaagttgccaaaaggcagagtatgtttaatattaatacttgagctacctgacgcaatgtaagacacctacgttaaaggcatagatccctgctttgcatgtaatagctgaccttggggtcacttgcatcttgagcctcagtttcccctttatagtggagtcagtgggaagtgcctcacccctcaatccttatgag

SEQ ID NO: 13192 - DNA, 429 bp, Homo sapiens
  misc_feature 149: r=a or g
  misc_feature 415: r=a or g
tgttttctttatttgattgtatcatgctttcctgatcttttcctattttttgtagctttgtattgatgtctggagatttgaagaaacaactaactcttctagcaattctccataaagtggctttggacagaaaaaaatttcctgatcargcctggctagggattccaggcctgtgttcctagttgcccgggtatctagtctttttgtttttaaagctcatggtttcttgctcctgctggtgttagactgtgtcagttcctttagtgctccgtgtaaggcaagacaggcactgactccttgagaagtgtgctgaaaggccagggacattggagtcacattccactcatcttctttcctgagggagaagtctcagttctgtactgtttccaatcttgcagctctgtgctacctgtargggggtgcccgccc

SEQ ID NO: 13193 - DNA, 380 bp, Homo sapiens
tacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgc

SEQ ID NO: 13194 - DNA, 393 bp, Homo sapiens
  misc_feature 97: s=g or c
gaaaggaaagaggtcgggagcgctcgcgagatctcggaccacccaacctgaaaggattcggacggagagcgcgaggactcggcggctgagcgcgccsgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgaggcgcttacctttcagacttcattaaacttatgacc

SEQ ID NO: 13195 - DNA, 386 bp, Homo sapiens
gttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgacc

SEQ ID NO: 13196 - DNA, 468 bp, Homo sapiens
  misc_feature 10: s=g or c
  misc_feature 108: n=a, g, c or t
attgctttcsaggggtcactctggcttcgactccgtcgctctcaattcgtcaccaggaggaagacggagctggctgcccagcccaaaggcccatgaggggatgcagtnatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggcttaagttggcctgcttgaggatctgcccagtccggcggctgccgtcttccagcctccccatcagcgtttggatgccttcctctaggtcctttaggaggtgatagtcatctctggatttggtgatcagactctatattgacagtaggatctcaaaccctgcatccatccttcctccagcaagccc

SEQ ID NO: 13197 - DNA, 322 bp, Homo sapiens
  misc_feature 43: n=a, g, c or t
acctctgcagagccgggtggagcccattgacgtccagcgaagnaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtacgttcctcatcacccgcctcacagggcccgccctgcagtgggtgatcccctacatcaagaaggagagccccctc

SEQ ID NO: 13198 - DNA, 319 bp, Homo sapiens
  misc_feature 276: n=a, g, c or t
  misc_feature 277: k=g or t
gattttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccanktcacgtgtgtggcaagatgctgagctcggcttatatttcgga

SEQ ID NO: 13199 - DNA, 381 bp, Homo sapiens
  misc_feature 318: k=g or t
  misc_feature 319: n=a, g, c or t
aaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggcttgggacttttcagcaacgacattccacacgtggtgcggttcagcgcgctcaagcgccggttctatgtaacaacctgcgtgggcaagagtttccacacctatgacgtgagtgacttcttkngttagcttcccaggaaaaccaccctccttggcctctaactctgtcctggagcagtccggttc

SEQ ID NO: 13200 - DNA, 497 bp, Homo sapiens
  misc_feature 337: r=a or g
  misc_feature 445: r=a or g
  misc_feature 448: k=g or t
  misc_feature 454: n=a, g, c or t
  misc_feature 469: w=a or t
  misc_feature 471: r=a or g
atatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcaggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcgraagacgcggtgtatggtcgcgacggctatgattacgatgggtaccgtctgcgggtggagtttcctcgaagcggccgtggaacaggccgaggcggcggcgggggtggargtkgcgaanttccccgaggtcgcwtrgccccccatccaggcggtctgaaaac

SEQ ID NO: 13201 - DNA, 165 bp, Homo sapiens
gtctgaaggggctgcgccgctgtttaccaccccgcaagcagcagaggcggcgcccagccctcctctcgaacaaaggcgcggccgccgcattcgacccgcgccatggcagaggagagcgggtgccgggagggaagccgggaaccgtctccattctgaaactagggc

SEQ ID NO: 13202 - DNA, 301 bp, Homo sapiens
  misc_feature 198: s=g or c
attgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcascccaagacatggctcacaacaagatcccgccgcggtggctgaactgtccccggcgcggccagccggtggcaggaagattcttacctctgaagacaatgttagg

SEQ ID NO: 13203 - DNA, 296 bp, Homo sapiens
  misc_feature 14: n=a, g, c or t
  misc_feature 156: s=g or c
aagataaggccgcncgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcctgcgcsccgtggatttcgctgagcggcacggctacatcaagggcatctgcggaatatactgtgaggcatggtgaacgagcagaagtatcgggtttctccatcctttggctaatcagtgtaaaattataaaatgctccttctttttt

SEQ ID NO: 13204 - DNA, 163 bp, Homo sapiens
  misc_feature 30: m=a or c
  misc_feature 35: w=a or t
cccccgaagcgagctgcgctgacagccggmggcgwgctgggtgtttgcaatacaaaggcggccacgcgcggcgccgctcggtgcagaccatgaattacgtggggcagttagccggccaggtgtttgtcaccgtgaaggagctctacaaggggctgaatcccgc

SEQ ID NO: 13205 - DNA, 203 bp, Homo sapiens
  misc_feature 25: r=a or g
  misc_feature 101: n=a, g, c or t
agacgcagagtcttgagcagcgcgrcaggtgagtagctgtgcgaattcggttctctagggagctccttcttcgcctgctggccttacctgggctccccgcntctctggaggggaggcggtgcgggaactcccgtaggcgtgagctggagcgcgcgcccgctgctctctccaggtcccgccgcgccagttcgcctccgcaaagc

SEQ ID NO: 13206 - DNA, 206 bp, Homo sapiens
  misc_feature 190: n=a, g, c or t
tatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgncatggtgcttttcagg

SEQ ID NO: 13207 - DNA, 278 bp, Homo sapiens
  misc_feature 266: s=g or c
  misc_feature 267: m=a or c
aaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaacsmtttgagaacac

SEQ ID NO: 13208 - DNA, 170 bp, Homo sapiens
tacggacatatatacaagacagtatctctatcacaacttaaatgtgacagatagtgggtgatgatgctggtggtttgactgggaaaggctccctggagattgctgttggtaaaacaattcagggatcatttattttctttctttctttctctctttccttccttcctccc

SEQ ID NO: 13209 - DNA, 164 bp, Homo sapiens
taggtgttttgtttgtttgtttgtttgttttttgtcatcagctattgtttttgatgtgtggcccaagacaattcttcttccagtgtggcccagggaaaccaaaagattggacacccctgtactaaaggctctcccactcatgtgcctgagtgaagatagtgtag

SEQ ID NO: 13210 - DNA, 307 bp, Homo sapiens
  misc_feature 37: k=g or t
ttatgaaattaagaattattttccttaactggaacakttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggc

SEQ ID NO: 13211 - DNA, 231 bp, Homo sapiens
  misc_feature 100: y=c or t
  misc_feature 168: m=a or c
  misc_feature 169: s=g or c
  misc_feature 200: n=a, g, c or t
gtttggtgactgcggggcaggccgggggcagctgtctgtctggctctttttgacagcccccagtgcgaaaggctgccagcatgtcatcagtgagccccayccagatccccagtcgcctcccgctgctgctcacccacgagggcgtcctgctgcccggctccaccatgmscaccagcgtggactcggcccgcaacctgcanctggtgcggaccgccttctgaagggcacgtc

SEQ ID NO: 13212 - DNA, 225 bp, Homo sapiens
  misc_feature 136: n=a, g, c or t
atatagagggcggagaaggctggagcgcggcggtgattttgtgccagggattcccagagacgcgctgaaaggctggcagggcttaggaagctggggggttagggacacacattcaagcccccacccccgggagggnaagggggctggaggcgaggcttgagggcggcggaggaatggtgtctgctcggggggaaggggcgagccctgcctgttggtactgagggg

SEQ ID NO: 13213 - DNA, 337 bp, Homo sapiens
  misc_feature 118: k=g or t
aagtcacgtgagaacctggggacgctaggttccggaacctgacctgagctggggcctgtgcttccagcgggtggtggggggcctggtgtgctggcatcaagtaagccgactacctcgkcaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgccccaccgccat

SEQ ID NO: 13214 - DNA, 391 bp, Homo sapiens
  misc_feature 190: s=g or c
  misc_feature 266: y=c or t
tatttaatgtaggctagcttgttttcaaattttaaaagtttaaaaataaaatactttgcattctaagttgccaataaaatagaccttcaagtttattttaatgctcttttctcactaataggaacttgtaattccagcagtaatttaaaggctttcagagagaccctgagtcttctcttcaggttcacasaacccgccgcctttttgggtagaagttttctactcagctagagagatctccctaagaggatctttaggcctgagtygtgaagcgcaacccccgcaaaacgcatttgccatcacagttggcacaaacgcagggtaaacgggctgtgtgagaaaacggccctgactgtaaactgctgaaggtccctgactcctaagagaacca

SEQ ID NO: 13215 - DNA, 243 bp, Homo sapiens
ccccctggacttggctggggctggctctagtgccctgccttctatgacaaattcgcgggcgtaaagggaaatacctcttctagggatccggagcctgggaatttaagtaaccctgacatcagcgcttcctccttttagtgaggcttcagtggacaggcgtatttggggtggccgcgggcggtctgagatgttttttggtggaatgagacaatggcaactacaagaagtggtagcttggagacg

SEQ ID NO: 13216 - DNA, 147 bp, Homo sapiens
  misc_feature 85: y=c or t
acatggccggagagtcacaaaaacaacagctttggccaagaccgtgacttcagtaaagggaacccggggctctcgcagccagccytcctgcccatggaggacagtttccttcaatcttttgggaggctgagcctccagccccagcaa

SEQ ID NO: 13217 - DNA, 205 bp, Homo sapiens
agaaccccgatcgctgaggagcaagggggcgctaggaaagggaactgggttgcgacggtccggcgagagagagctggggtgctggggtgcggggaagttggggagcagaggccgcttggtgtccgagtagggtaagaccccactgacggccacagccccctctgccctcccttcctcctgggcgcccagcgtgaccagctccacc

SEQ ID NO: 13218 - DNA, 238 bp, Homo sapiens
aaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagc

SEQ ID NO: 13219 - DNA, 111 bp, Homo sapiens
ccccaagtgtccatgtaacttttgttttaacctttgcaccttctcagtgctgtatgcggctgcagccgtctcacctgtttccccacaaagggaatttctcactctggttgg

SEQ ID NO: 13220 - DNA, 377 bp, Homo sapiens
  misc_feature 2: r=a or g
  misc_feature 136: y=c or t
  misc_feature 140: k=g or t
  misc_feature 152: m=a or c
  misc_feature 153: w=a or t
  misc_feature 181: k=g or t
  misc_feature 305: k=g or t
  misc_feature 327: k=g or t
  misc_feature 355: w=a or t
araaacacagtagctgtagctgcacatagacgcttcctctttctgtttccccctcatccccctccctagacctctctgggctttgacgtcatgtgtgctcctttcggttgccatagcaaccccattccccaaagcyctckgtccgtctcctmwgaatctcttccatgttagtctggaatgkggttaatgaaaaacaagtagggaggatttctggggcaaacactgccggatcaggatcgtagttctcaggcacggaatggctagtgtgagaaacaccaacagcaggcccatctcagatcttcackatggcaacttatgcaagaaackgttgaattagacccgtttcctatagatwgagaaaccatacaagctgtggt

SEQ ID NO: 13221 - DNA, 514 bp, Homo sapiens
  misc_feature 276: s=g or c
  misc_feature 442: k=g or t
  misc_feature 464: k=g or t
  misc_feature 492: w=a or t
acaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtttaagattgggttttcttggaaatcacctgtccatcgttaattttaaacaatstccatatctccaaagaatctcttccatgttagtctggaatgtggttaatgaaaaacaagtagggaggatttctggggcaaacactgccggatcaggatcgtagttctcaggcacggaatggctagtgtgagaaacaccaacagcaggcccatctcagatcttcackatggcaacttatgcaagaaackgttgaattagacccgtttcctatagatwgagaaaccatacaagctgtggt

SEQ ID NO: 13222 - DNA, 189 bp, Homo sapiens
  misc_feature 121: n=a, g, c or t
aaatgctctccccagcccggagagccctgtccccatcggccactctgagctcgaggcctaaagggacagtgaggaggaccctgcccaggctctcccggggttaggagggacagagtgttcnaggaggaggtttgagctgagctcaggcacaggtctctctctctctctctctctctgacacaagcgcac

SEQ ID NO: 13223 - DNA, 302 bp, Homo sapiens
attctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaacagaa

SEQ ID NO: 13224 - DNA, 392 bp, Homo sapiens
  misc_feature 59: n=a, g, c or t
  misc_feature 344: n=a, g, c or t
  misc_feature 345: n=a, g, c or t
gcgcatgctcgccaggatacccctcgttaagggcaaggcggcttctggctcttccgcangctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcacgttggcgatggtctccggagacggcttcctcgtttccaggcctgaagcgattcatctaggacctcnngcaggcggtgcgaccaagcgttcgggccgagagccgtcgagtggatg

SEQ ID NO: 13225 - DNA, 216 bp, Homo sapiens
  misc_feature 17: s=g or c
  misc_feature 197: n=a, g, c or t
  misc_feature 199: s=g or c
gcgcatgcgcgctcgcstcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcggcgtaccatggcggangsggggagaagggtcgggg

SEQ ID NO: 13226 - DNA, 256 bp, Homo sapiens
  misc_feature 115: k=g or t
  misc_feature 187: n=a, g, c or t
  misc_feature 188: s=g or c
  misc_feature 219: k=g or t
  misc_feature 238: k=g or t
  misc_feature 239: r=a or g
cttttttttttctgatagcaggcagccatcttgcctggagcctgagaaagggaggagagacagaaggaaccggcgacagtggtctcagggccgctccggggggcctcaagaacckgaggcagccccggaggtggtccccgatcccgggctatgctcttggatctgagaagggaaggcggagggcggnsgggacaagatgggtggagaatgtcaagcaakgaatgctaggcgggggagkrgcgttgctatggcgacc

SEQ ID NO: 13227 - DNA, 251 bp, Homo sapiens
  misc_feature 118: k=g or t
cttttttttttctgatagcaggcagccatcttgcctggagcctgagaaagggaggagagacagaaggaaccggcgacagtggtctcagggccgctccggggggcctcaagaaccggakgcagccccggaggctgccgcgggcggacacgccagaggaggaggccggggaatggccgcggtgtggcagcaagtcttagcagtggacgcgaggtacaacgcgtaccgcacaccaacgtttccacagtttcgga

SEQ ID NO: 13228 - DNA, 367 bp, Homo sapiens
  misc_feature 278: r=a or g
  misc_feature 283: s=g or c
  misc_feature 300: r=a or g
  misc_feature 330: s=g or c
  misc_feature 335: s=g or c
ggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcarccctsggaggcttctggcagtrgtggccagagggctggactgtgcgggcagsttagsagggacagtggacgtgcacctgacgctgacct

SEQ ID NO: 13229 - DNA, 148 bp, Homo sapiens
aaattgccgttggggacgcccggccgtgcgctttcgccggctaacgtcgcctgtgctccgagcctggtttgctcacctttgaactgcaaagggatcaagttcagcttgagttccctgcattgggaaggagagagagcgtgcaagagag

SEQ ID NO: 13230 - DNA, 685 bp, Homo sapiens
  misc_feature 140: n=a, g, c or t
  misc_feature 459: w=a or t
gaggatttttggaataaataatctattttagagtttatttgctgatttgctttttacacactttcatgtgaaagagtgatagggagagggagcgaggctggtgccgcttattttgaagctggtgccctcccctcgccgtngccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccawataccacatttcctgttggcacagtttcacagaagtaaacataagcatgttttaacaggtttttcttttcttttttcttttttaaaatgttttatttatttaacccgccattgtgtgttttaagtattttctttttttaaggaaaggaaaagcttgtcacaatctaactggctatgttattattattaaatttatgttttgcaacttagaaaccagctacagtatg

SEQ ID NO: 13231 - DNA, 261 bp, Homo sapiens
  misc_feature 156: w=a or t
  misc_feature 158: r=a or g
agtcacagaagggggtgagaagtgggaagaggggatttgcatagaacctccaattttccttatttcctagggagttgatgatttcagccaaatataagtcttaacgttacatctgcaatggaaaaacaagtcaaactcagcaaaaaggagccctgwaragacagagttaagtgcttccgtgatgagagtagagttggcctatgctgtccctcccaggactcctttacccaagagaaagagagagtgtgcatccaaagggga

SEQ ID NO: 13232 - DNA, 526 bp, Homo sapiens
  misc_feature 260: r=a or g
cacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccctccaccctgaagtggggaggaaggggtggcaggaggcaaaggtgtctggggtacacctggacaggtgtatgatgtggaggaggtggatgtgaaagatcctaactatgatratgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcaca

SEQ ID NO: 13233 - DNA, 228 bp, Homo sapiens
  misc_feature 205: k=g or t
  misc_feature 206: n=a, g, c or t
agaaaggcgcaggcgcaacgggcggcggaagtaggagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggccckncgagatggcgctcgaccccgca

SEQ ID NO: 13234 - DNA, 170 bp, Homo sapiens
  misc_feature 90: s=g or c
  misc_feature 92: w=a or t
ctctcgctcgcgttgctgggagactacaaggccgggaggagggcggcgaaagggccctacgtgctgacgctaattgtatatgagcgcgasgwcgggctcttgggtcttttttagcgccatctgctcgcggcgccgcctcctgctcctcccgctgctgctgccgctgccgc

SEQ ID NO: 13235 - DNA, 176 bp, Homo sapiens
ataaatcaatgtggagtggctcagacaaagggccggcatgcacaactggcaagaacagggtggagccgccaggaattggcgctttatacacctagggaacccagccccatcagcggatatataaaagcccttgtgttcaactgtgaagggggcaaccaacaacctgcttttaggac

SEQ ID NO: 13236 - DNA, 273 bp, Homo sapiens
  misc_feature 108: r=a or g
  misc_feature 109: n=a, g, c or t
  misc_feature 114: n=a, g, c or t
agagtcaggtgcggacgactttgtctgtaggagcagcggcggcttgaggacccggggaggtgagatccgccttattccggcgcccctcttcggagaggagggagaagrncttgnttgctaaggagaccaaagggcgggcttgttgctacggaggcggagcagtgagaccctcaagaatcgacccatcaggacgccagagctgcttcagcggtgaccaccttctccctctaacacattcttcccttcttcacaaacggcccatgtcagacgaag

SEQ ID NO: 13237 - DNA, 302 bp, Homo sapiens
  misc_feature 237: n=a, g, c or t
  misc_feature 243: n=a, g, c or t
gcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtaganaaaatnggagtccatctgataagaaccggcagccagccactaagagtaattgcccatgacacagg

SEQ ID NO: 13238 - DNA, 475 bp, Homo sapiens
  misc_feature 339: n=a, g, c or t
tcacaattaatgaaataatatcgatccattagtattaactaaagtctatagtttattcagattgccttagttttgcctaatgtattttactgttccaggatctcatatgacattatgttatcaaatttgataacattctggctccagacatttatattgacaagtaaggagttgtcgtgtctccttaggttcctcttggctagggcagttgctcagactttctttggttttgatgcctactttgatagtttcgaagagttctggtcagacatattatgggatgcccctcagctgggatttgtctgatatttttctcatgattacactggagttacgtgntttttggaggaagacctcaaaggggaagtgtcatttcatcacatatcaaggggacacactgaccacatgattcaccactgtttttgttcatcctgatcactgtttgtcagtttctccactttgtaagctactcttc

SEQ ID NO: 13239 - DNA, 245 bp, Homo sapiens
aagtgtttccggtggattcccagggactgtcggaggtgtggactctgcctgcctacctggtctgggaagatgttctaccatgtgagcagggctcagggtggcggcaagggctgggtggaaaggaagagcaaggccaggcgccggcgcgagactccccttgtcgtccaataacctgccagcgcctggcctggtcgccatcccacttttctccgcagatctccctagagcacgaaatcctgctgcac

SEQ ID NO: 13240 - DNA, 394 bp, Homo sapiens
  misc_feature 121: w=a or t
  misc_feature 278: v=a or c or g
  misc_feature 317: h=a or c or t
  misc_feature 363: h=a or c or t
  misc_feature 364: w=a or t
ctaagtgtttccggtggattcccagggactgtcggaggtgtggactctgcctgcctacctggtctgggaagatgttctaccatatctccctagagcacgaaatcctgctgcaacccgcgcwacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcvtcaaagactccagccttcttggacatttattgtgaaathaccagaacagcatttggtcttacacatactgatctctgttctgtchwcttttggtcattaagctctctgggagcaga

SEQ ID NO: 13241 - DNA, 220 bp, Homo sapiens
gctgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccaccc

SEQ ID NO: 13242 - DNA, 454 bp, Homo sapiens
  misc_feature 259: r=a or g
  misc_feature 262: y=c or t
  misc_feature 337: r=a or g
  misc_feature 416: w=a or t
aaagtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagrcaygatccgccactacgtgtccatcctgctggagagcgacaagaagctcacccaggaacaagtatctgacaggggacraggcacccacagtccctctcccataagcctgccaagaagattgatgtggcccgtgtaacctttgacctgtacaagctgwacccacaggacttcattggctgcctgaacatgaaggcg

SEQ ID NO: 13243 - DNA, 237 bp, Homo sapiens
ttctatggctgagatagctaaccatcagtggattttttttttcatacctccaatgatacttttcttcccaccctgattgttgtgttctccttagaatcttagaaaaacaagtgtagggcatctgtctttttatgttcagggtgtctttctaggctcaatcaattcccatgatgaagtaaacaattgtcagttacataaactattagcttagtaagcgaaatgctaaggtagagatat

SEQ ID NO: 13244 - DNA, 271 bp, Homo sapiens
gtcgccatgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatcgtgagtgtcaccccggtccccgtcacccaatcccagagccccgcccctcccctgaggggtccgtagtcccattccgagaccccagtaccgcggcgaccc

SEQ ID NO: 13245 - DNA, 207 bp, Homo sapiens
  misc_feature 109: s=g or c
agacaggacaagaacagcaaagggtagagcagacctgcgccaggggccacaacggccgtgtccacctcccggccccaagatggtgcttcccacaggcagccacgcgtasagccagagacagctccagacatgtggctcttcttcgggatcactggattgctgacggcagccctctcaggtcatccatctccagccccacctgaccag

SEQ ID NO: 13246 - DNA, 292 bp, Homo sapiens
  misc_feature 232: m=a or c
  misc_feature 235: r=a or g
  misc_feature 282: r=a or g
  misc_feature 287: k=g or t
ataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggmccraccacaagacgactcaataggaggaaggtcacatttagggcaggcaraacakaaggg

SEQ ID NO: 13247 - DNA, 353 bp, Homo sapiens
  misc_feature 110: s=g or c
ataagctcggtttcttcataatctttgttcactccatctctccgttccttggcacgaccccggtacttctctgctagctctctctctctctcaatttcttgttggcgtasttagcataataacttttctttttcctccttcgtgcagctgggtcttcatcctcattgtactcccttggcatctcatggtgacgtgacttagaaggtggtgcagaggtaggtgcagccctgggggtcatgagaagtttcctgaagtcttcattggtgagttttgattggtggaaggagtgaggatcatccacatcgtggccatcaggggccaaagggttggagaacggctcactatctcgctcc

SEQ ID NO: 13248 - DNA, 423 bp, Homo sapiens
  misc_feature 254: s=g or c
  misc_feature 302: n=a, g, c or t
agtgggccgccatgttgtcggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcascacaaccagctgcaaatcaggctcttgcagctgggactcactccagcnctgtcccaggatctataggagttgcaggccgttcccaggacgacgctatggtggactacttctttcagaggcagcatggtgagcagcttgggggaggaggaagtggaggaggcggctataa

SEQ ID NO: 13249 - DNA, 353 bp, Homo sapiens
  misc_feature 10: s=g or c
  misc_feature 32: r=a or g
  misc_feature 315: s=g or c
acgcccgtcsttaggctgtctctgtctccctragagcgagtctcttcgctgctctctaactcctagagctggctcagaaagagtttcacattgccataggggagctcctaggagaggctgcacccattgcacgctctttctggcaaagggtaatgacatacgcatctgtgccagcatcccaagagtgaggctggtttctggaaatccattctgactctgtgacagcggggatggatgtgaccttgcccgtggttagaaaacaaatttaactgaagatctaatccaggatcatatgctgcctttaggtgacacatscctttagtctcctttaatcaggagcagtttctcagtgt

SEQ ID NO: 13250 - DNA, 222 bp, Homo sapiens
  misc_feature 69: s=g or c
acgggctatttaaaggtacgcgccgcggccaaggccgcaccgtactgggcgggggtctggggagcgcasagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtacca

SEQ ID NO: 13251 - DNA, 84 bp, Homo sapiens
tactagtattttttttcacttacacattgggattgtttttttaaaggtactcaaatatgacagtctatattattgtttctctat

SEQ ID NO: 13252 - DNA, 370 bp, Homo sapiens
  misc_feature 348: n=a, g, c or t
ataaatttctctatcctgctctgaggctaattggtaccatattttccctttgtgtcttgtgactctgccacatcccatctcatcctggcctctgagtcaagaacccagtgaactgactttctagttctagaagtttcctctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccncaggtccttccttctgcatctc

SEQ ID NO: 13253 - DNA, 129 bp, Homo sapiens
tagactacacatttgataactggttcttgaggtcctcttatacgccagacactattctaggttccaatggcacagttttaattaaaggtagatgatgtctctgccctcttggagcattttattctagtg

SEQ ID NO: 13254 - DNA, 347 bp, Homo sapiens
gaagcagaagcctgtgtggcttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggctggttgtggtgactcatgcccataatcccaacactttgcgaggctgaggcaggacgagtgcttgaggccagttcaagctgggagccaggcttggtgtctcacacctgcaatcccagcactttggatgttttagaagaatgtatgtctcttcccaa

SEQ ID NO: 13255 - DNA, 156 bp, Homo sapiens
  misc_feature 49: s=g or c
  misc_feature 149: s=g or c
cgcctttcgtgacaaataaaggtcgtagccgcagagtcaacgggcggastaaagtggtcgtgattcatgctgtcgcgggaaccccgaaggtggggccccacgtaacaagaagatgacccgaagttgctccgcagtgggctgcagcaccsgtgacaa

SEQ ID NO: 13256 - DNA, 425 bp, Homo sapiens
  misc_feature 313: s=g or c
  misc_feature 331: m=a or c
  misc_feature 386: n=a, g, c or t
  misc_feature 414: s=g or c
ctttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgsgcctggaggccccagagmttccagtaaaggtgaacccgacgaagccccggagggcaggcttcgaggtgacgcngctgcgcccggacggcagcagtgcggastctggactggg

SEQ ID NO: 13257 - DNA, 291 bp, Homo sapiens
  misc_feature 201: n=a, g, c or t
  misc_feature 202: n=a, g, c or t
agattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcanntgaaagggctgcagggagctctgggtaagacattttctgttgctgctgcttttgcggtagaagctgctgcgagtaagtcagaggaagga

SEQ ID NO: 13258 - DNA, 196 bp, Homo sapiens
tttcccctggtgaagtgacaagtacaattaaaggtggctctgaaatggcctctggtttcttgggagtcgggcagggataggcgtacggccagggctataggttgctgcaaatgccattatttcattccttcttatggcttagtattccatagtgcatatatatcacattttctttatccactcgttggctgatggg

SEQ ID NO: 13259 - DNA, 391 bp, Homo sapiens
  misc_feature 12: s=g or c
  misc_feature 15: n=a, g, c or t
  misc_feature 26: r=a or g
  misc_feature 27: k=g or t
  misc_feature 31: k=g or t
  misc_feature 42: k=g or t
  misc_feature 313: n=a, g, c or t
agcgaggcggasggncgcccggagtrkcaakaggaggaggakgatggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcattaagattagaagcctccattgaaagaataaaggtttcgaaggcatcagcgganctcatgtcctactgtgaggaacatgccaggagtgaccctttgctgataggaataccaacttcagaaaaccctttcaag

SEQ ID NO: 13260 - DNA, 208 bp, Homo sapiens
  misc_feature 91: s=g or c
  misc_feature 122: s=g or c
tgtttaattctctgccctggggaaggaggatggattgagagaatgtctttctcctctcctaagtctttgctttccctgatttcttgatttsatcttcaaaggtgggcaaagttccctctgastcttcccccactccccatcttactgatttaatttaatttttcactccccagagtctaatatggattctgactcttaagtgcttcca

SEQ ID NO: 13261 - DNA, 141 bp, Homo sapiens
acagcagacattgcaggcctgaagaaaggtggtcacaagaggggtggaacattcctgcaaatggtttcaatatatgcagatgtctcgatataggaatgaaattacgtctttggaacaacttaaataagtcaaatatacttg

SEQ ID NO: 13262 - DNA, 670 bp, Homo sapiens
  misc_feature 643: m=a or c
caaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagtcgcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccmacagttatctagaattccgtgtctact

SEQ ID NO: 13263 - DNA, 409 bp, Homo sapiens
  misc_feature 33: s=g or c
  misc_feature 176: s=g or c
  misc_feature 379: m=a or c
aggacgtaagtgacggcgaaggcggtgcgacasagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggastggagaaccggattgataggcagcagtttgaagaaacagttcgaactctaaataacctttatgcagaagcagagaagctcggcggccagtcatatctcgaaggttgtttggcttgtttaacagcatataccatcttcctaatgcatggaaactcattaatgagaaaggttctgaagaaagtctccaaaatacattcaagagcmgaaatgagaagatctatgctccacaaggcc

SEQ ID NO: 13264 - DNA, 308 bp, Homo sapiens
  misc_feature 184: r=a or g
  misc_feature 185: y=c or t
actttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagryaagaactcctattgcttcctctccagctctgaagtacctcagctcagggacgtggagcctataacgttgtggcaaggatgggaaggaatttataagtcagttcattttcttaaaaatgaccag

SEQ ID NO: 13265 - DNA, 405 bp, Homo sapiens
  misc_feature 404: k=g or t
cttttttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtkg

SEQ ID NO: 13266 - DNA, 241 bp, Homo sapiens
cttttttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtttcgtcgcgagccggctgc

SEQ ID NO: 13267 - DNA, 187 bp, Homo sapiens
  misc_feature 5: k=g or t
  misc_feature 132: y=c or t
  misc_feature 136: y=c or t
agtgktctacagcagttacacacaggcagtggtatctgtgagcagctctgtggactcaaaggttttctccctgagaggcatgacccaggccagctgattcatcagaatcaggatggacgtggtagaggtcgygggyagttggtgggcacaagagcgagaggacatcattatgaaatacgaaaaggga

SEQ ID NO: 13268 - DNA, 290 bp, Homo sapiens
tatgtgaaatgtaagtccttaaagtaaattttaataacgctgttaactggcatttctttattttttataatagtattttgagagttcccaattagtagaagagtcttgggtctctttcaacttccaagaggccctagtcctaagagacaagggtgaaggagttctagagggtctcactccagtggttcctagtacgtccttgtgcaacgaataaatggatggttggtgaacagtccgacagcagagaagaaccaaagggcaagtgcaaaccagagttgggaattaggagg

SEQ ID NO: 13269 - DNA, 628 bp, Homo sapiens
ttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctatttttcacaattattgacctgtat

SEQ ID NO: 13270 - DNA, 98 bp, Homo sapiens
ccaagactccaacattgcactctgtaaagtaacacactgtgatctagtattatttatcagtagataatactgttctgactgtatatacagtctagaac

SEQ ID NO: 13271 - DNA, 545 bp, Homo sapiens
  misc_feature 387: w=a or t
  misc_feature 533: y=c or t
tgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactttgaccacggcagaacaatgtcttctagactatatctatgtaaagttattagaatggtatctgttcattttagtgatatgaagatcacaactaacaactgacaaatcagagtttgccagtwcaaattcagcatggctgcagctgattaagaaattgatatgattattctttgctagcctctcttactaatggaattatatactggccagtaaaatgggcctcccaattgctgtttcagcaggttttaaaccttcaggaacaccagtyaggaaaatagct

SEQ ID NO: 13272 - DNA, 152 bp, Homo sapiens
tcctcgtggcctcagctgacctttccactgtgagcgctccattttcccacaatgcagcctctaggaggctgcagcggcactatggccagtgtctactctgttttgtggtgtcctggccatgctggtttagggaggtaaagtaacttgtccaa

SEQ ID NO: 13273 - DNA, 316 bp, Homo sapiens
  misc_feature 10: k=g or t
ctactgatakgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatca

SEQ ID NO: 13274 - DNA, 126 bp, Homo sapiens
gaaagtaaggttcctacaggcttggagaagggaggaatggagaagtgctccctaaagtgtggtccatggaactgctctgccaaccatttgttgtcagtcagtaatgaggagcacagaaatagaaag

SEQ ID NO: 13275 - DNA, 149 bp, Homo sapiens
  misc_feature 104: n=a, g, c or t
ttaatttcttggtaacagctttttaatcccacaaagtaagtttttacaacgtttaaattgtctgtgtctagtgattgcagcattaagatcttggacatagggcngaagggctcctcaagtacggccaaagtgggagcccaggcagagga

SEQ ID NO: 13276 - DNA, 234 bp, Homo sapiens
  misc_feature 10: n=a, g, c or t
  misc_feature 11: k=g or t
aagaaacggnkggctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgag

SEQ ID NO: 13277 - DNA, 347 bp, Homo sapiens
  misc_feature 11: y=c or t
  misc_feature 93: n=a, g, c or t
  misc_feature 101: m=a or c
  misc_feature 223: k=g or t
  misc_feature 289: n=a, g, c or t
  misc_feature 290: n=a, g, c or t
  misc_feature 330: m=a or c
agttcctaggycagcctgtcacgtgggagggaggctcggcgctcaggaagcatggcactctggcgggcataccagcgggccctggccgctcancccgtggmaagtacaggtcctgacagctggtgagtgtccctctaggacttgagtgggaccagggcagactgatttggaagccagaggcttgccccactgcaccaccctcacttcctgtttctattcggckctcttgaagggttggctgtctttcatcctacactgtccccagtctgttttggagggtggtccccanngctgtttttaaggggtatgcgtagttggccaagctgtgcmgtagggttttaggattc

SEQ ID NO: 13278 - DNA, 244 bp, Homo sapiens
ttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacttattatttctcagtattgttttatagcatcacaccaaagtacagttcagta

SEQ ID NO: 13279 - DNA, 320 bp, Homo sapiens
  misc_feature 207: n=a, g, c or t
aaagtacctccgactgaatcccacagacagcgctttgagcagaacgcacggctcaactcattcatatggccttgaacccacagtgaattgaagagagaaagaaatggatatgtctgaccccaattttttggactgtgctctcaaactttactttgcctcatttgaggagtgggaacaggcttcggcgaacacaaagttgccgaacangcaaccggaaaagcttaataggcaatgggcagtcaccagcattgcctcgaccacactcacctctctctgctcatgcaggaaatagccctcaagatagtccaagaaatttctcc

SEQ ID NO: 13280 - DNA, 131 bp, Homo sapiens
aattactgagggcttatacattggtgttataaaagtgacttgattcagaaatcaatccattcagtaaagtactccttctctaaatttgctgttatgtctataaggaacagtttgacctgcccttctcctca

SEQ ID NO: 13281 - DNA, 377 bp, Homo sapiens
ttcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttct

SEQ ID NO: 13282 - DNA, 341 bp, Homo sapiens
aaacagtgctacccacagagtgaacaagagagagtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctagggga

SEQ ID NO: 13283 - DNA, 220 bp, Homo sapiens
aaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcaggga

SEQ ID NO: 13284 - DNA, 442 bp, Homo sapiens
  misc_feature 370: s=g or c
  misc_feature 375: r=a or g
ccctttcgagaggtgaattttacaacccaagaagcattactcagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcsacctrtacatttaaggactttctcctcagaccaagaagtcataagtctcgagttaagggatttttgcgattg

SEQ ID NO: 13285 - DNA, 175 bp, Homo sapiens
  misc_feature 169: y=c or t
taatcctgttttaaatttttccattgataagactcgcatacagtttggttttgtgatatttctggtctctttgtttcttgtgttttagagaacacccagggactgtaaagtatactcagcaatatgttttagaacagactgttttcttttgcatcactaatcttttccyaacatg

SEQ ID NO: 13286 - DNA, 162 bp, Homo sapiens
tgactgactgatttgactgagaacctagtgtgtgataacgtgtcactgtttctgtcaacttatataattgaggtctttttaattgttcttaccttagaccactatatacttgtggtcttataaagtatatttgaaaattatagcattttcatgttttgtctg

SEQ ID NO: 13287 - DNA, 199 bp, Homo sapiens
ttgtttcaaactgctcttcttttgacaagtgacttccaggggatttaaagggctggtactgtttcctttttcttttttgttttcaaattcttctcagttacacatggaacattttccaggatagatcgtgttttaggacacaaatttttgcctcaaatttaagaagagataccatacaaagtatcttctctgaccacaa

SEQ ID NO: 13288 - DNA, 207 bp, Homo sapiens
tttaatgcataaaccgaattagggtccagttggcctgttaatggtaaatttacattttaaatgactcagtttgtttttcctgggcgagtttgcaatgtgataatcagattttttaaaactgattaattgctttcttgtgtgggtgtactcacattttaaagtatgaaccacagttaactagtggtctcaggggtagtgaaacactca

SEQ ID NO: 13289 - DNA, 140 bp, Homo sapiens
  misc_feature 111: r=a or g
ctcctcttgctaccctcccggcgcagagaaccccggctgctcagcgcgctccgggtcatggagatccccgggagcttgtgcaagaaagtcaagctgagcaataacgcgcaraactgggtaagctggggacgaaggcgaga

SEQ ID NO: 13290 - DNA, 162 bp, Homo sapiens
ctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgt

SEQ ID NO: 13291 - DNA, 409 bp, Homo sapiens
  misc_feature 405: r=a or g
agtcacagaggaagccatttccagagaggaacaaccgtgtagactgctttcctgggagtcaagttaaaactctctcctgtgaccttgtcaccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcgggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagrcact

SEQ ID NO: 13292 - DNA, 115 bp, Homo sapiens
  misc_feature 84: n=a, g, c or t
atctctgacggttgtctcggttactcattgggttgtcttctggcctcagagtatcccttatcagaaccttgggcccctgggccnttcactcagtacttggtggaccaccatcaca

SEQ ID NO: 13293 - DNA, 280 bp, Homo sapiens
aatctgacggttgtctcggttactcatgtaagcggaaattcggtgggctcttaggatagtttctgctttctagtgttcctgtctttgggtcctcacctctgcatggttactaacgggttatccgagcctaagcctctcacgaagcggaaagtcaagttaacagactgccataggcctgccaagtcagaatagggcttccgaagcagaatgtttgagccaataggaattgtttggaaaacggggataaatctaaaggatgggtaggatttaagtggtaagg

SEQ ID NO: 13294 - DNA, 129 bp, Homo sapiens
aacaacacaagatggcgcaaataagcccaagggtcagaataatttggccttacacaaagtcatcacggtgggcagtgccggtgtgggcaaggcagctctgactctacagttcatgtacgatcaaagaag

SEQ ID NO: 13295 - DNA, 373 bp, Homo sapiens
ctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtc

SEQ ID NO: 13296 - DNA, 128 bp, Homo sapiens
tgatcctatccctaaagtcattaacacagatttggaaatagtgggatttattgatatagctgatatttcaagtcccccagttctgtccagacatctggccttacctatagcacttaacaaagaaggtg

SEQ ID NO: 13297 - DNA, 212 bp, Homo sapiens
tcagtaaggtgaggtatggagggcaggcaaaggcagcagaggtaaggaggcaggtgtggccctcagctgatactccactccccacaaagtccaggaagaccctgccaccatcctttgtatttacagtgttttgtctggcagggctgccctttccaattgagttctgaagacacagtttaggaggtgtgaggagggaatgctaaaggaaatag

SEQ ID NO: 13298 - DNA, 213 bp, Homo sapiens
  misc_feature 175: n=a, g, c or t
atgcgtcctcaaagttcaaagtcctcgatacgcctgaggcgcctcaggcctcgtggctgccagcatttttctgctttaagatcctttccatgacttccttgtttaggccagcctccacgatccagctgccaaccatctagcctaccctgatctctgagcaggggtcgtcgtcagntactccagaggagactgaagccaaaagactccccatcc

SEQ ID NO: 13299 - DNA, 285 bp, Homo sapiens
  misc_feature 4: n=a, g, c or t
  misc_feature 42: r=a or g
  misc_feature 148: k=g or t
acanggacttgtgagtctgcgcagaaggcgggatgcctttgractacaattccaagaatccttcctgggtctcttcgggcgcagacttttcgccaaagtcctgaagatctcagggcttgaaggagggggcatccttcttctccattgkagtagtgtgtcttgctaaataacagaagggactcctgaaaagaaaatgacgttggccgggcgcggtggctcacgcctgcaagtcccagcactttgggaggccgagacgggcggatcacgaggtcaggagatcgagac

SEQ ID NO: 13300 - DNA, 171 bp, Homo sapiens
cgaaattccacgttcttaactgttccattttccgtatctgcttcgggcttccacctcatttttttcgctttgcccattctgtttcagccagtcgccaagaatcatgaaagtcgccagtggcagcaccgccaccgccgccgcggccccagctgcgcgctgaaggccggcaag

SEQ ID NO: 13301 - DNA, 167 bp, Homo sapiens
aaagtcgcgaggtgcatccgcttcggctgcagctatttactgaggacccactggatgtcaagcattgtgcatagttttcttcgattgttgcaacatcccttgcgagagtttcactcctgttgcccaggctggagtgcaatggcatgatctcagctcaccgcaacctc

SEQ ID NO: 13302 - DNA, 353 bp, Homo sapiens
  misc_feature 263: k=g or t
tactgagtcaggattgatgctcatgaacttccagccatggctttaactctactcctttgggtgacatttgagcatattggatctgctatgcgtggaaagtcactttacttttatttgcccccactccattgaaaaaaaaaaattagatgatagcagcatttcttaaagaacagaatgcatatccctgatcatgctcacaattaggcgtaattcttttttacatgaccatttttaagttttcaaaaacaattgtcaagcctgtkgtagtcttatctttccaaagctaaccatcattcttccggacttttttgtggatgtttttaatgtcttcattgctctccttgcaatcggtc

SEQ ID NO: 13303 - DNA, 144 bp, Homo sapiens
gtggcccggatgttcggtgcagctgccagatccgctgatctagtgcttctcgaaaaaaaccttcaggcggcccatggcatgccttggactttattgtgggaagaccctattatttaaaaatggctcaactgaaatatatggaag

SEQ ID NO: 13304 - DNA, 442 bp, Homo sapiens
  misc_feature 36: r=a or g
  misc_feature 114: r=a or g
  misc_feature 116: h=a or c or t
  misc_feature 124: m=a or c
  misc_feature 128: r=a or g
  misc_feature 132: r=a or g
  misc_feature 136: k=g or t
  misc_feature 137: r=a or g
  misc_feature 152: m=a or c
  misc_feature 153: w=a or t
  misc_feature 177: r=a or g
  misc_feature 198: r=a or g
  misc_feature 330: r=a or g
  misc_feature 331: m=a or c
  misc_feature 392: r=a or g
  misc_feature 394: b=c or g or t
  misc_feature 421: m=a or c
gaggaagtctaacctttgggagactccaagacagcrgctccgaggtcggcgggggtctgggtggccatggaggagccccctgtgcgagaagaggaagaggaggagggagaggarghcgaggagmgggrcgarggtkrggcccgagggggcgmwggggcaagagccccttccagctgrccgccgaggacgtgtatgacrtctcctacctgttgggccgcgagcttatggccctaggcagcgacccccgggtgacgcagctgcagttcaaagtcgtccgcgtcctggagatgctggaggcgctggtgaatgagggcagcctggcgctggagrmgctgaagatggagctttctcaggacaaacagaaagttagggaaacacactacatttgacarcbaagcattaatttgtagttggtcctaamccttcctggcacagctatcaa

SEQ ID NO: 13305 - DNA, 243 bp, Homo sapiens
aaataagaatagcatttacatagacttcctgtgtcccacactggtctaagagtttagggtttttgttgtttgtttttagctcattttatcttcccagcgcccctgtgcagtggttatcatttcccttgttttatagaggagacaactgaggctcaacaagattaaataactagcccaaagtctatcccaggacttgaagcagagtccctgttcttaaccactgccccagctgctcagtgagta

SEQ ID NO: 13306 - DNA, 541 bp, Homo sapiens
ttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagca

SEQ ID NO: 13307 - DNA, 180 bp, Homo sapiens
agggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattgg

SEQ ID NO: 13308 - DNA, 128 bp, Homo sapiens
agagaggggaagccgggtgtcccaagggaggagggttgcttttgtttgtgggggcaagagggaaagtctggaaggttcgggtgttggaagatgtctactccggatgagtagtgggaagggctgactca

SEQ ID NO: 13309 - DNA, 116 bp, Homo sapiens
ccaaataaagtcttatatggaagtctatcatgtaaaatagatcaaagagcagctgctctggttgaagcaggtttgtgccgctgaagaatatgctgtttcctccctttaccttacct

SEQ ID NO: 13310 - DNA, 262 bp, Homo sapiens
tcttgtttccagaattacttttgaaagtcttgaagccattcttaatcttttatgtgtggcctgactttcctaccctgtggaagcttgtaaagtcatctttgttctcattgtttaaaattcactaagatataccttggtgtgaactcaggacttgtgttgaacactctgggcccttttagtctggcacctcatgttcttaacttctgggaagttattttattaataatttatttttgttttctctctctctctcttctttttt

SEQ ID NO: 13311 - DNA, 247 bp, Homo sapiens
gacataatcttgaactaactgtgtggtgttttggaagcatagagaagagaagctcccaagaaaaacacaaactaacctgcctaagaagagaggaaaactgttgatgtagtgggaacgctccctcctcgagcattaaccgggttgaccccacccctctgtcctcgctgtcttcagtccaatcaagatcggaaagcaggatcaagagaaagatgatcagaccggaacaggtaaacgttccatatagaga

SEQ ID NO: 13312 - DNA, 151 bp, Homo sapiens
ttgtggcgcggctttagagagtgtctgtgcaggctgcctctgatccctcagtcagtgtgcagagctgagctgatgaggaaagtcttggtatgtaaccaaccaggtctcaccttcagccacactcctagggacagagtgcgtccatggaggg

SEQ ID NO: 13313 - DNA, 318 bp, Homo sapiens
tttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaagggga

SEQ ID NO: 13314 - DNA, 231 bp, Homo sapiens
  misc_feature 151: y=c or t
  misc_feature 152: y=c or t
agacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatyytgtaaatacgaatctttccaaaggagatgcccggtgagttaagaaacagtgctgtgctcaatggatgtttaagtaactg

SEQ ID NO: 13315 - DNA, 185 bp, Homo sapiens
cttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacac

SEQ ID NO: 13316 - DNA, 352 bp, Homo sapiens
  misc_feature 298: k=g or t
  misc_feature 330: r=a or g
attggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatckcctaaagaaattgatcatatttacacacagarattaattgacgccatgaaacca

SEQ ID NO: 13317 - DNA, 120 bp, Homo sapiens
aaagtgagtggggccccgaaatctgagggtgatcgtagtcactagttgtggcccccatgcaggagcggagagcgggttctggtttctgaaacctcgagggatggagagtatctgggccgg

SEQ ID NO: 13318 - DNA, 172 bp, Homo sapiens
  misc_feature 131: r=a or g
  misc_feature 136: m=a or c
  misc_feature 137: r=a or g
cctgccctcttctaatgtatttttcataccacttccaaagtgataatacattcctcttttgaaattttagatttggttactaaagcaatacaggtgtatggttaccaaaaattcaaacagtgtaaaagagratacmrgcctgggcaatgtagagagaccctgtctccataaa

SEQ ID NO: 13319 - DNA, 245 bp, Homo sapiens
taattggaggctattactggcatcctttatcagatgttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgcc

SEQ ID NO: 13320 - DNA, 148 bp, Homo sapiens
aagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgag

SEQ ID NO: 13321 - DNA, 292 bp, Homo sapiens
  misc_feature 125: n=a, g, c or t
  misc_feature 126: n=a, g, c or t
  misc_feature 132: s=g or c
ccggttgactttgcggaccatggagggcggcttcggctccgatttcgggggctccggcagcgggaagctggacccagggctcataatggagcaggtgaaagtgcagatcgccgtggccaacggcnnaggagstgctgcaggaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcggg

SEQ ID NO: 13322 - DNA, 456 bp, Homo sapiens
ctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggag

SEQ ID NO: 13323 - DNA, 538 bp, Homo sapiens
  misc_feature 463: y=c or t
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtggatggggtgttatcaggatggaggggggattttatggagaaatggggatagtcttcatgaccacaaataaataaaggaaaactaagctgcattgtgggttttgaaaaggttattatacttcttaacaattctttttttcagggacttttctagctgtatgactgttacttgaccttyctttgaaaagcattcccaaaatgctctattttagatagattaacattaaccaacataattttttttagatcgagt

SEQ ID NO: 13324 - DNA, 487 bp, Homo sapiens
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctgtaagtgagggggtagcagtctctgtttcctttcaggaaggcacgaggcggtagggatccgtttttctggggagtattctcagattgcagaccgcgcattccactcagagcgctgggcgagtgcagttccattcgcttggcagtcagggcggcctggctctcctgtaggccgggcacattggcgt

SEQ ID NO: 13325 - DNA, 421 bp, Homo sapiens
  misc_feature 6: n=a, g, c or t
  misc_feature 238: w=a or t
tttganaaccattgttctgaggaagggggtccaatctggctcctctgcactaaagctgcaactcatggaaaagagggcaacggtggggtagacaagccatgctgtctccagacccactagggtggaaggaaggttcctgtgggcctgtggacttaggctaatatttgctgtcagcagggcacttaagaatccagggggttttatgtaatgttgccaccacatggttcttttaaaaacwcataaggaaatgtgagggtgtagcgcagatgaggagagagatgacacagagggagcagccttctctttagcaagatgtaagggaaatataattcacttacataaaaaagaaacaacacacacgcaaacccttcaccagaagcttcacactacatcctcctcctcctcctgctccccaccttca

SEQ ID NO: 13326 - DNA, 192 bp, Homo sapiens
gccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatgg

SEQ ID NO: 13327 - DNA, 367 bp, Homo sapiens
acccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatccaccttcaacacc

SEQ ID NO: 13328 - DNA, 423 bp, Homo sapiens
  misc_feature 304: y=c or t
  misc_feature 410: r=a or g
aaacacatccaagcttaagacggtgaggtcagcttcacattctcaggaactctccttctttggccaggattgctacagttgtgattggaggagttgtggccctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgcyattgcggctgtcattgcgaggttctactagctccctgcccctcgccctgcagagaagagaaccatgccaggggagaaggcacccagccatcctgacccagcgaggrgcaactatcccaa

SEQ ID NO: 13329 - DNA, 301 bp, Homo sapiens
  misc_feature 185: n=a, g, c or t
  misc_feature 221: n=a, g, c or t
  misc_feature 288: r=a or g
aaacacatccaagcttaagacggtgaggtcagcttcacattctcaggcaactctccttctttgggccacggaattaacccgagcaggcatggaggcctctgctctcacctcatctgcagtcactgggagcaactggactctccggattgaccaagttcatcctgggctccattgggtctgccatngcggctgtcattgcgaggttctactagctccctgcncctcgccctgcagagaagagaaccatgccaggggagaaggcacccagccatcctgacccagcgaggrgcaactatcccaa

SEQ ID NO: 13330 - DNA, 388 bp, Homo sapiens
agagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctaca

SEQ ID NO: 13331 - DNA, 160 bp, Homo sapiens
  misc_feature 134: s=g or c
caatcagaaatgtcaatgagactaaagtggttttgtaaatctcagctatatttagcaacactccatgtagctaatattttttggtagcatctggtagaccttagaatgttacatagccagtaggttctttatcsaaatttaagtatcttaagaatagtag

SEQ ID NO: 13332 - DNA, 365 bp, Homo sapiens
aggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattattggctaaaataagacaatattcaaaggtcagagatatctagccagaatctgatggaggctggatttcagattttgttacagaattagacagaggaacacagagg

SEQ ID NO: 13333 - DNA, 477 bp, Homo sapiens
  misc_feature 8: y=c or t
catttttyagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcgg

SEQ ID NO: 13334 - DNA, 293 bp, Homo sapiens
  misc_feature 189: m=a or c
catttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatgcccatgttccagaggcgamggaggcgagacacccacttccccatctgcattttctgctgcggctgctgtcatcgatcaaagtgtgggatgtgctgcaagacgtagaacctacctgccctgccc

SEQ ID NO: 13335 - DNA, 175 bp, Homo sapiens
atctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgca

SEQ ID NO: 13336 - DNA, 129 bp, Homo sapiens
  misc_feature 10: k=g or t
cagggacttkgtgggcctcccgttgaccctatgtagctgctataaagttaagtgtccctcaggcagggagagggctcacagagtctcctctgtacgtggccatggccagacaccccagtcccttcacca

SEQ ID NO: 13337 - DNA, 404 bp, Homo sapiens
  misc_feature 226: y=c or t
agggaagggctctttgctagtatctccatatctagacgatggttttagatgatgaaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcyttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataag

SEQ ID NO: 13338 - DNA, 166 bp, Homo sapiens
aatatgaacttgtacattcacttttggaaagttcagctgatttggggattagcaagcaggagtggagtttttaacaattaattaaggcatgttttattaactcagaactagataatcagatagccatgtcagtaaaatatatcagtatgtaaatctcacttatagt

SEQ ID NO: 13339 - DNA, 169 bp, Homo sapiens
acgaatattacatattatctttcctaaggttgtgagaacctagaagaactgcctttgattaatgctagaaaacagctcttatgagacataaagttcatttaataatcccacaaatgcttacgagcaactattctataccaggcagttttctagctttttggaaatagag

SEQ ID NO: 13340 - DNA, 249 bp, Homo sapiens
tttctccagtcgcgtctttctcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttgacaagcatacacaatggggaattgacttcttggaaa

SEQ ID NO: 13341 - DNA, 253 bp, Homo sapiens
catgttgcatgttcttttaaattagtgattttgtgtcttaagtctttaacttccaatacttcatcatgtatgtaaccttccatgtttgcttctgataaaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccg

SEQ ID NO: 13342 - DNA, 225 bp, Homo sapiens
aagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcag

SEQ ID NO: 13343 - DNA, 177 bp, Homo sapiens
  misc_feature 127: n=a, g, c or t
  misc_feature 131: n=a, g, c or t
attcatttatctgcaggaatgattgctgctatcagtctcgcgctcaccgcccggctgaggaggtgaaagtttctccccaggaagataaaccgcaaaagacaatattgtgcatgatttgcgccttttncttnggctttttctttctttcttcacccccccacccactttttttttttt

SEQ ID NO: 13344 - DNA, 220 bp, Homo sapiens
taataaataatgtattaaagtttctgtacccaggtctcattttagatgaggtttcacaaagtcttagctttgtttgctatatatttttttaagctggaccaaggaataattgctgataaaaggtatttttggtagcctcaggaaggaaatctgatctgtataatttactgttaaatttttatctgttgtatagatttacttatttttcctaatttcccta

SEQ ID NO: 13345 - DNA, 174 bp, Homo sapiens
taaagtttggaagatgggtcaatctgactctacatcaatagactgctctgtggaataaatagaaatatctctacttgctttctggggtgagtgagggtttctttcttttgctcatttttgcccaggctggagtgcaaggcaccgtctcggctcaccacaacctctgcctcccag

SEQ ID NO: 13346 - DNA, 365 bp, Homo sapiens
  misc_feature 119: s=g or c
  misc_feature 121: y=c or t
  misc_feature 136: k=g or t
  misc_feature 319: n=a, g, c or t
aaaaaagtttgtgtctggagccgtagcggcaagtgggcttgcggctaagggattttcctgggatgagagcgggtcttctgccttcattttggatgcacatcccgctttagccccggcascytttggtccggctcgkgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcntgcgcttagcatcctcggcccagcgcggcccgcaccgccatggagg

SEQ ID NO: 13347 - DNA, 393 bp, Homo sapiens
  misc_feature 160: y=c or t
  misc_feature 278: n=a, g, c or t
  misc_feature 279: n=a, g, c or t
  misc_feature 324: s=g or c
  misc_feature 344: k=g or t
aatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaatyatgaggctttgctttttgtttgcttttaagtagaaaaacatgttggcaacattgagttttggagttgattgagataatatgacttaactagttttgtcattccatttgttaaagatanngtcaccaagaatgttttgagttttttgaaagaccccaatttaagscttgcttatttttaaattakgtccattcagtgatgttggatgtatatcaattatttagtaaataatctc

SEQ ID NO: 13348 - DNA, 429 bp, Homo sapiens
  misc_feature 312: r=a or g
  misc_feature 354: w=a or t
  misc_feature 415: w=a or t
ctataagtagatttacaggaacatatataggagtatatgatgtgcagggagagaagggaagaattaactttgagagctacttatttaatctggttaaaggcaaagactggtttctccttttagaataagtcattgatagcttcctcaaggagttaaaaattcagtgcatcctatagtgaaataaagggatctggaagtgtagaataaaatttatttttgataataaatgatgattgaagccctgaaagttattcaaatgtttttgaaatgattggataaaaagcacattgaatgatctgaaaaatataagaragtacaggttaagtatttaaaaaggggggagagccccgaggwcgtcaggggagttcagtgtaaggcgacggccagctctgcaggtctgtgatgtagaagtttwagcacaggagatgc

SEQ ID NO: 13349 - DNA, 328 bp, Homo sapiens
  misc_feature 196: y=c or t
tttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgyatatgtagtagtttgatgaataatttaaagaaaaacacctaaaatttgaaaaatgattgtaggatcaaaaaaggcagatgaaattacttaatactcagtgttttggagagtattccttttagtttgttggtt

SEQ ID NO: 13350 - DNA, 419 bp, Homo sapiens
  misc_feature 248: n=a, g, c or t
aagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggnaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaa

SEQ ID NO: 13351 - DNA, 198 bp, Homo sapiens
  misc_feature 160: m=a or c
gcccctgagaggatactgataagggtataccttagtaactttcgctcctgaagttactaaggaaataaatggggatgcccctgtgccttaatttttgtacactcattacatggcactaagggatttaaacatctgcggcctttagttaaaaacagctacmaacctctgtaaagttagtgccatgtaatgagtgtacaa

SEQ ID NO: 13352 - DNA, 175 bp, Homo sapiens
tgtcttaggcattgttttagacatacgtaagaggagctcagtgattaccgaacaaataaatgtgtatcacctgaagcctttagaggtggcatttctccacttcccaccccttggacttctttctaaaatttttcacattttagttttttttaaactgccacttgcacctccaggc

SEQ ID NO: 13353 - DNA, 125 bp, Homo sapiens
atgcaggaactgtgtgatttgggggaaattacatcatagctttcgtactttcattggtttcattttcacatttcttaagtgggggaaataacatacattatgcctctcataccaggttgataagg

SEQ ID NO: 13354 - DNA, 188 bp, Homo sapiens
aacaaactgcgataatctacaacagacagcgggctctggaaggtttgacctgctttagagagagatttccgataagaggaacggagtttttggcacttttcggtttggtgattcccctaaataaccttacaaaagtttcgttgaacaaaaaacctggctggagctccaagatcttttttttttttttt

SEQ ID NO: 13355 - DNA, 176 bp, Homo sapiens
tgcatttatcttatgctttaaaaagtagagacgcttagctagtgtccatgcacacttctcatttccaaggtcagagctctatgatgtctgcaaataacgaatacaaggctattgtcagtccttataaataagaaaatattatttgtccctaattctgtagttttcactctcaaatg

SEQ ID NO: 13356 - DNA, 307 bp, Homo sapiens
agtgggacatccaggctattttttcattcagtgattcagggaactgggctgggaggagtgcagagtatatggatattttgcccccagaagattggacgatgactgcctgcattggtgagcaatcttactgtctattgacttaaattctaatcttctggaagcgctctcacagacagaaataacgttttaccaactatctaggatgccccttggaagaactggaaatttaaaatctgtggtcacaaaggagagtaaagagaaaagacatgctaccctctaaaattacataatttgttaaaagaagaca

SEQ ID NO: 13357 - DNA, 331 bp, Homo sapiens
taaataacttcatcccagacaggggtgagggaaggtgttgtggctgttttgtttaaattggagctgtaagagggatcatgtcatattttatgcctttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcct

SEQ ID NO: 13358 - DNA, 334 bp, Homo sapiens
  misc_feature 242: n=a, g, c or t
  misc_feature 243: n=a, g, c or t
  misc_feature 287: n=a, g, c or t
taattgtgtcatgtagtgaggataaaactattaaaatttgggcataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatcnntcgggtaactatctcatcacagcttcttcagatggtaccttaangattctggacctcttaagaaggaaggctcatctatacacttcaagga

SEQ ID NO: 13359 - DNA, 348 bp, Homo sapiens
  misc_feature 117: w=a or t
  misc_feature 139: n=a, g, c or t
cacagtatctagatagtattacaaaacgatatctcaataaataagcttcgcaggaaacaaaagcgctacttggtggcataaggtgtggttagtccccccaccagcattggctttttwaaaaaagtggataaaacataanttcagttgaaaacatccaggttgcagtgaactatgctatattcactttgtcttctggtcaagtacttagtttctgctttacacaggacaccaacacgaataaagttttaagttattattttattttgagacggggtctcgctctgtcgcccagactggattgcagtggtgtaatcactgttcactgcagccttgacctccctccccggc

SEQ ID NO: 13360 - DNA, 218 bp, Homo sapiens
tcagtttgatgtacctgcgtgacactcagatggggatatcctattgtcatttgaatgattgatctggtgctcagaggagatgaacaggctgcaaataaggatttgagagccattggaggatggatgataatggagcacatggaagcagatgtggcccttcagagagaaggtgcagagtcagagtgaagggttgcaaaagaactgtaagggactatggg

SEQ ID NO: 13361 - DNA, 161 bp, Homo sapiens
tatgacttattagtatgtaatattacttctgacactgacatttgtgaacaaggaataatcagtttgctttcttgttcattattatgttttaacaagaaataagtgttacagtgttagagtctctactagaactgaatttgaacaacaaccagtgaatgcag

SEQ ID NO: 13362 - DNA, 362 bp, Homo sapiens
  misc_feature 291: r=a or g
tttccgtttggatccttatgccaacgtgttaggaaggccccctctggtgcacaaagcagggtcatcagaagcctcttgattcaaaagatgataataccgaaaaacactgcccagtgacagtgaatccttggcatatgaagaaagctttcaaagtcatgaacgaattaagaaggtgagatgagtgagagccgagcaaagagagttagaataaaagaggtagatggctggaccctgaggatgctaattgattacgtttacactgcagaaattcaggttacagaagaaaatgtrcaggtaagagtaaacacttcacaccatctagctttttatgcatacagttttttttaataaaaaaagcacac

SEQ ID NO: 13363 - DNA, 141 bp, Homo sapiens
tttacatttatttatggtgacatatttacgcttgtgatcaaataatgatgttaaattcttaaatcatatttgctatgcagctgaagatgatattttgatttgtattttgggggtacctgtgttgagttgataaacatttcc

SEQ ID NO: 13364 - DNA, 417 bp, Homo sapiens
  misc_feature 92: w=a or t
  misc_feature 95: k=g or t
  misc_feature 243: r=a or g
  misc_feature 258: r=a or g
ttgggctgttaaatcctaggaaatctcgaatcatagtgattaaaatagttggggtaaagttgtagcttatatgcaatactacttggaggaawtckttctactaatttgtatttaatgtggaaattgtatagtttcattgatttaatcataaataatggaaatggtctccaagaagttttatttttcatttttttgcttatacactctgattcctataatacagtgctataagctatgcacagraaataaaatgtttgraatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaa

SEQ ID NO: 13365 - DNA, 400 bp, Homo sapiens
  misc_feature 335: s=g or c
tacacaataaatgttagctatttttactaatatatgaattcccccagccaagtagcaaataatgtaattaacaatttgctttaaggtatatagaaaatgtgctataagaacatctcttggccgggcgtggtggctcacgcctgtaatcccagcactttgggaggctgaggcaggcagatcacgaggtcaggagatcaagaccatcctggctaacatggtgaaaccccgtctctactaaaaatacaaaaaattaaccagacgtagtggcaggtgtctgtagtcccagctacttgggaggctaaggtaggagaatggcgtgaacctgggaggcggasttgtagtgagtcaagatcgtgccactgcactcctgcctgggcgacagagcgagactctgtctcca

SEQ ID NO: 13366 - DNA, 197 bp, Homo sapiens
  misc_feature 146: s=g or c
  misc_feature 161: n=a, g, c or t
  misc_feature 163: k=g or t
atagaaagtgctcaataaacctttgttgaatgattaaatgaataaataaatgaatgaatagaatgtcactgtcattgaaaccaaaaagggttgagaggagggaacgaaggatgaaataatgtagaattatttcatgactgcatggscccctctggtgtatnaktaaaataattaattagctttgtctgataagttgg

SEQ ID NO: 13367 - DNA, 159 bp, Homo sapiens
ctgtttactctttgttgttactttaaataatgtcctatctctccccatcttccagtagggctaattataatatatggtcattgttggtaatgggaaaatataaagaagaattaaataaccataatataattgcctaattgaggcaatcctttttttttt

SEQ ID NO: 13368 - DNA, 349 bp, Homo sapiens
  misc_feature 270: n=a, g, c or t
ccagaaaattttatgtaatttatttttttaaagaacctgttgtacatctttctcaaatacaaacttgggctttagctgccccctccactaaaccgatgacttacttttttgactagaatgagaaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagatagnggtgttgggatcttgattgtggccgccccccccagctttacctgcccactttgtccttcttggcaagcctgttcacatg

SEQ ID NO: 13369 - DNA, 231 bp, Homo sapiens
cactacagaaagaatgagaaaattgtgtgttaaagaaaaggggacataatttaaaaatagaaatatccaggtaaataaacttatgaatggcagattcattgagtgggaataagggaaatacaaggtgggtgaggggtatgttttctgccttgaggttgaaataatcgttatcttcccctagttaccatactgagtatatttacattgtccaccctttttttttgagacgga

SEQ ID NO: 13370 - DNA, 55 bp, Homo sapiens
taaatctctgctgtcagggttcagcagggctgatgaaatacactcctttatccgg

SEQ ID NO: 13371 - DNA, 441 bp, Homo sapiens
  misc_feature 300: n=a, g, c or t
  misc_feature 302: r=a or g
  misc_feature 303: n=a, g, c or t
  misc_feature 359: n=a, g, c or t
  misc_feature 363: r=a or g
  misc_feature 364: k=g or t
  misc_feature 405: m=a or c
  misc_feature 406: n=a, g, c or t
  misc_feature 412: r=a or g
  misc_feature 421: w=a or t
tcaagttaattcctaaatacagaagtcctttttaacaaaataaagatgtggttctctttacctatttattttcaaaaatctctttatctcttccttttatattctatgaaaaaatgtgtttaaaaaaccaattttattccttcagatctttgggaaatcacctaccataagaatcttaggggtcgatgttgggattagtggtattccagccctggatcagtccatcagtaccaccactgtaacactgctcaccattgctgctcattaccacacaaagcactggacctctgggagattaanarnaataaatcaactgctattctcaaaaaccaacctgataatatgacttgttaaaaatnagarkgtttaattacccaaatggctatttttctgctttttataaamnatgaaracacaggtwctatcaaagcactgttcatt

SEQ ID NO: 13372 - DNA, 199 bp, Homo sapiens
  misc_feature 11: n=a, g, c or t
  misc_feature 47: r=a or g
atagagatganaaaggtaacagagtctttgcccatggagccttgcgrtagggtataaatacaggtgctctgttgttctgttggattcatacatcttcaagcacagctctgattaattagctacgtttttattgatggcccgtttaggccatcctcaggcagattaactcctcagctttaatatttcatttgatagcatc

SEQ ID NO: 13373 - DNA, 168 bp, Homo sapiens
taagtgtgagccacagcatgtggccccaataggttttattaagcaactactgtatcagcaaataccaatgattctcaaactttgtgacaaaaatcatctggaggatattttaaaacagatcactgggtcctaccaccagaagctgctgattcagtacatctggggtga

SEQ ID NO: 13374 - DNA, 557 bp, Homo sapiens
  misc_feature 15: n=a, g, c or t
  misc_feature 16: n=a, g, c or t
  misc_feature 125: r=a or g
  misc_feature 139: r=a or g
  misc_feature 275: s=g or c
ttatcgacattatannagaaacagcaagcaaatcatttggttttggcagtttgtgaaagagacagacaatgaagtaagaatgcgactattgcagttcgtcactggaacctgccgtttacctctargaggatttgctgarctcatgggaagtaatgggcctcaaaagttttgcattgaaaaagttggcaaagacacttggttaccaagaagccatacatgttttaatcgcttggatctaccaccatataagagttatgaacaactaaaggaaaaasttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgag

SEQ ID NO: 13375 - DNA, 149 bp, Homo sapiens
agcagcggtgatgacaggggtgatgtgcctggagaggcctggggtggggaggtaactcagttctgttcctgtgacagacatcctggactattatgaggcttccctctcagagagtcagaaataccgctaccaagatgaagacacgcccc

SEQ ID NO: 13376 - DNA, 450 bp, Homo sapiens
tcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtat

SEQ ID NO: 13377 - DNA, 128 bp, Homo sapiens
ctctctgccaaatacctaagtccgaacaaccataatttgtctttcagttattctttcaagtaaaaatggcgttctaggcttggcacagtggcttacgcatgtaatcccagcactttgggaggcagaga

SEQ ID NO: 13378 - DNA, 172 bp, Homo sapiens
  misc_feature 2: r=a or g
  misc_feature 20: s=g or c
araaaccgggtgccggcagsgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccggg

SEQ ID NO: 13379 - DNA, 483 bp, Homo sapiens
  misc_feature 338: r=a or g
  misc_feature 401: m=a or c
  misc_feature 405: m=a or c
  misc_feature 463: r=a or g
tttttttcatttaggaagcaaaatgtggattcagcaaacaaattctggaaatactaaatagtactgggtatgtaaatgttgttttcaaatggtgtattaaaaaaattccaacctggccaggcgtagtggctcacgtctataatcctagcactttgggaggctaagacaggaatattgcttgagcccaggtgttcgagaccagcctggacaacatagtgagaccccatcgccacaaaaaataaaaaaattagccaggcatggtcacatacatctatggtcctagctacttgagagactgaggtgggaggatcactggagtcttggaaggtgaggctgtrgtgagccgtgattgcaccactgcactcagcctgggtgacagagcaagaccctgtctcaaaaamaagmaaaaaatatttcaacttttcagttctgccactgatacttttcagttgtaatgtctatrtcatacatatctgtatcttt

SEQ ID NO: 13380 - DNA, 460 bp, Homo sapiens
  misc_feature 252: w=a or t
  misc_feature 275: w=a or t
caagacctccactgcagggcagagaaatataattttgcatcactgcaaagggagaaataagatcactataaatttcactgtagaacattttctgtaaggaaaaattccctaatggagtcaaagaacagaggaggcatacaatgacttcaggcaaagcagaaccttttgactcacacaacattatattattttgtcagctttatattttatgaaacatttttactatgagtgaggcaagagaaagaaaaaggwagagacagcatttggttatattwcatcatttctaaaatctaatttcctggagtgagaatgacactaagggtactacgagaacattccttcccatgtaaactaatagtgtaataaatactcatatagttactagttttagttgccaaacctagtttgtaaatggtaaatttgagaccagaactatattcttatgctatcagaccactga

SEQ ID NO: 13381 - DNA, 503 bp, Homo sapiens
  misc_feature 200: m=a or c
tttttgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaamaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggca

SEQ ID NO: 13382 - DNA, 146 bp, Homo sapiens
cacatttgtatgcttttgagaatggttcagtggagagtagaaatactgacgagggagagaattattggagtcatagccttgggtaagtgagagggggtagtttctagtacatacttagagagtttggccaagagcatatagcatag

SEQ ID NO: 13383 - DNA, 241 bp, Homo sapiens
  misc_feature 200: n=a, g, c or t
aattcttgtaccttgtgggaaatactgactcgtgtattagataaattctgatggtagtttataaattttgcttccaatctaagtgttttttttggatcccaactactcgacctccagtttgcaatgtcacatttttctatacatcagtatttgttttcagtaatacattttttattaaataaattttgaaaaatcaaganaaagaagcaaaaaaatgaaattacttgttatcctactccac

SEQ ID NO: 13384 - DNA, 165 bp, Homo sapiens
taatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactac

SEQ ID NO: 13385 - DNA, 198 bp, Homo sapiens
aagtctaactttggagattctctaccagtcatcttgggtgaacctgaggtagccacatgaaatggccagatttgacatcatccctcttctgtgccagaaggaacaattagtccttccataaatagatcaatatttgctcatgctgtagactatggaatccaacctgtagtatcctttctgcatgttggcaccaagccc

SEQ ID NO: 13386 - DNA, 187 bp, Homo sapiens
gcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccc

SEQ ID NO: 13387 - DNA, 247 bp, Homo sapiens
taatatcttcacctattgagttacccaagccagcaatcacagtgatttctacctccttgttcctcctcctccacattgattaaatcaacaaattctgctgaaattgcctcctcaattagtccctctggccctgcattatccaatatggtagctactagccagtgggtctgttgagcacttgaaatgtggctgaccaaattgagatgtgctgtgtgaaatagccctccatatttgtgggttcccctcg

SEQ ID NO: 13388 - DNA, 231 bp, Homo sapiens
caaatccagtaatcatattgctttagaaatagcctgagtttgttaggatacaatgccacatatttttgggcatcacgtccaagcattatgtgagaactttacaatgtgaaagataattctgaataatgtgttatgtaacatttaataagacctaggtgtgtgtatgtgtgtgtacatgtttcagcaaattacttgaaatccaagattatctttaatgaaaacccaccatag

SEQ ID NO: 13389 - DNA, 624 bp, Homo sapiens
  misc_feature 310: n=a, g, c or t
  misc_feature 394: s=g or c
tggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttccnaggtttcacactcaatttgatatccattaccatgtcttttctacttccttgtaaataggtatgatctttattcccactgtacastctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaact

SEQ ID NO: 13390 - DNA, 387 bp, Homo sapiens
  misc_feature 81: k=g or t
agcgaagataccgtaataaatagtaacctaacggtccagtcatcgttctgtggtcctttcttttatgattcacaaggaatkcctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaag

SEQ ID NO: 13391 - DNA, 208 bp, Homo sapiens
tttagtagagacagggtttcaccatgttggccaggctggttttgaacccctgacctcaggtgatccacccgcctcggcctcccaaagtgctgggattacaggtgtgagccactgcacctggcccaagctatgcttttctaatgatcaaaaacataccaatttgtcccaaaatttcaaatagtgcatctggttctcccctgcatcctac

SEQ ID NO: 13392 - DNA, 215 bp, Homo sapiens
  misc_feature 164: r=a or g
  misc_feature 173: n=a, g, c or t
  misc_feature 174: n=a, g, c or t
ctctgtcggccccgacgctcccgcagtctctgcgcgagccgagatcagcgattgtcagttcggaacgtggcttttaaaaatgcgtttttaaatagtgtcttgaagaagtgtaggagagatctacacaacttaagtggggcgtccccatcccatcttcctgcgcrccctccttnncccccaactccatctctgcgacacttccccacccccactcc

SEQ ID NO: 13393 - DNA, 490 bp, Homo sapiens
  misc_feature 266: r=a or g
agaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagraaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaag

SEQ ID NO: 13394 - DNA, 357 bp, Homo sapiens
  misc_feature 262: n=a, g, c or t
tggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtagntagtagtcatcaagtcttttgacagaagtatatttttaaagaatttatatgtgatgaatccataatgtctggaactttgctgagacatgagtggg

SEQ ID NO: 13395 - DNA, 179 bp, Homo sapiens
  misc_feature 10: n=a, g, c or t
agagatagantaaaaacagaaaaatggcgacggtcacgttgtggcgagccttgctgcgtcattagataatcctcatgcaaatagcgggaagaacaaaggaaggggagcccgggacccccgggggcgcaggatccggcgggaggagtctaagaggaggaggcggcggtgccggaggaaga

SEQ ID NO: 13396 - DNA, 182 bp, Homo sapiens
ccttattccttaaatggatacagagtgagagtatatagacaagactctgccacccagtggtttactggcataattactcatcatgatctcttcacccgcaccatgatcgttatgaatgatcaggtaaatagttccactaatatttttatagagattttaaaagttcaaatcatccatgcccc

SEQ ID NO: 13397 - DNA, 179 bp, Homo sapiens
  misc_feature 140: n=a, g, c or t
  misc_feature 141: y=c or t
gaaatatacaataccttatgttgtatattacattatgttgtatagtacgttgaaacatacactacaatacgttatcattaattgtggtcaccatgctgtgcaaaagatctctaaaacgtattcctcctgtctgactgaanytttgtatcctttgcctaatatctccccaatccctccac

SEQ ID NO: 13398 - DNA, 180 bp, Homo sapiens
  misc_feature 134: r=a or g
  misc_feature 153: n=a, g, c or t
tccagaaatatatagaccttttcaagttactaaattactgtacattgcctcactggtcaagtgaggttattgatgtaaagaaacttactgatgtagcagaaacattttatccttctgtgtgttgagcatttatrattacttcaactgagaccnaaatagaaacacacacacacacacaca

SEQ ID NO: 13399 - DNA, 129 bp, Homo sapiens
  misc_feature 108: w=a or t
atgattcccccaagtattctgggcatttaaatatatctctatgctttctacttgatgctgtctcaaccccatcacccttttctccacctgaggaaattaatcatcccwaggagtcctccccgcaaccca

SEQ ID NO: 13400 - DNA, 250 bp, Homo sapiens
  misc_feature 135: w=a or t
aataacttttaaaaagttgtcttgtagcttgaagggatcctaaatatcaaaagcccatcacaaacttacaagccttactgctacgtaaatatccctttgaactagtttctggttctatttaaaaagtcgaaaacwgttgaaattaatttacgaataagaacagatacacactttgtggggaggctgaggtggtaggatctcctgagcccaggagttttaagtccagcctgggcaacataacagcaagacc

SEQ ID NO: 13401 - DNA, 244 bp, Homo sapiens
  misc_feature 69: m=a or c
  misc_feature 75: r=a or g
  misc_feature 224: y=c or t
cagaagagacagaagtgaacctgcacatctaacctttgacgtttttccaatgatttaaagatgtttttmacccaraatctcagtaggtgttatcttctacccttaatagtcacagatcagtcaacatctaaaaggccccgtctggagcaaatcactctgccattctagtttccacctaatttctaagtcctatagttctgcttaaatatctcttaaaccatttyttctctccatcttcattgtt

SEQ ID NO: 13402 - DNA, 400 bp, Homo sapiens
ccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagctttttttgcatatcacacaaacac

SEQ ID NO: 13403 - DNA, 64 bp, Homo sapiens
ggcactgaataaatatctgttgtgtgaaggaatgattggggagtttatttttaaacaaggaaac

SEQ ID NO: 13404 - DNA, 126 bp, Homo sapiens
caggtttggaaatatcttgggatggagacagtttgtagaagtcatggctgcgccgcatctcaagggcaagctctgtggtctttgtggcaactacaatggacataaacgtgatgacttaattggtgg

SEQ ID NO: 13405 - DNA, 312 bp, Homo sapiens
  misc_feature 132: m=a or c
  misc_feature 143: m=a or c
  misc_feature 145: y=c or t
  misc_feature 147: s=g or c
  misc_feature 309: y=c or t
agtcggagccagcgcgagcgccgccgccatcactgccgctgccaagtcctccacccgctgcccccgccatgtctgctaccgctgccacggccccccctgctgccccggctggggagggtggtccccctgcamcccctccaaamcytsaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagygca

SEQ ID NO: 13406 - DNA, 247 bp, Homo sapiens
ccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggacccatgggccagcccttgcaggaggcccttttgcaaggcttagggtgtggccagccctgaaagctacttg

SEQ ID NO: 13407 - DNA, 262 bp, Homo sapiens
ttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattacaggtgcatgcccc

SEQ ID NO: 13408 - DNA, 446 bp, Homo sapiens
  misc_feature 123: y=c or t
  misc_feature 130: k=g or t
  misc_feature 425: w=a or t
  misc_feature 428: r=a or g
tagaaaacacaataaaaacaaactgttcggctactggacaggttgtatattaccagatcatcactagcagatgtcagttgcacattgagtcctttatgaaattcataaataaagaattgttcyttccttkgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacatawaaraaaataaaactgttaaca

SEQ ID NO: 13409 - DNA, 154 bp, Homo sapiens
aaaattccttctattcttactggaaggaaccatatgcactctttggagtctgaaatatggaggatgcagctgcacttgactgaccgattaaaagatttcccttgactttgagaaacgatatttaatcagaacaaaatactgtgcactaaagatg

SEQ ID NO: 13410 - DNA, 150 bp, Homo sapiens
agatacaaatatggcgttttggacgggctcgatagtttgcttggcctctactcaaggaatgctgatggtatagcaagaaggtattctgagcattatatcaatggggaagttatagatcttttgcaaagcaggaggtaagctcacaaacca

SEQ ID NO: 13411 - DNA, 394 bp, Homo sapiens
  misc_feature 119: y=c or t
  misc_feature 386: r=a or g
agatacaaatatggcgttttggacgggctcgatagtttgcttggcctctactcaaggaatgctgatggtatagcaagaaggtattctgagcattatatcaatggggaagttatagatcytttgcaaagcaggaggctggagtgcaatggcatgatctcggctcactacagcctccgcctcccaggttcaagtgattctcctgcctcagcctcccgagtagctgggactacagagtcatcctagggcatccagaggccttcagggtggcctgaagtctcccaccgcaccacctttgggttaacctagcctgtcccacagaagatgatgaagttgggtctggaggcaagctgactcagatggattctcgattttatgatgctggactrgagatggg

SEQ ID NO: 13412 - DNA, 393 bp, Homo sapiens
  misc_feature 86: r=a or g
tctcattgcagagaagaggagaaaggcattctgtgcagtggaaattgtcagtgtagacgcctcggggcttaagagaacgtgacatrgaagagacaggaaatatgtactcttgtacaggtatgcggcacacatgtggccccctccctcccagcctcctcactaaagattattaacctgcttattctcctggttcacctgaggctgttttgagagaatctcagtatctcagtcttcatttcatacgacattcttcgggctcctcttgttcatctttgcagactgaagtatttatgaaggaccttcagaaatctgattcctcctgatgaatcaaagagtaaagaagaatcaaacatgattaaccaggtcaacggcagagacttatccagagcaact

SEQ ID NO: 13413 - DNA, 282 bp, Homo sapiens
  misc_feature 90: r=a or g
ttgtgatccgcccgcctcggcctcccaaagtgctgggattgcaggtgtgagccaccacgcctggcctcaagcctggtctgaatatctatrtgcaaatatgggacactgacttcagagctattcatttagctccagtcatagcaattctgtagtttcctcacatttactgtgtctttgtcacaaatgaaatatgttgtaaggtcagtgttaatttcgtgagacgatatagatgaacacacttgctcattttttgaaataaatatgcagatttaaaatgagtgg

SEQ ID NO: 13414 - DNA, 261 bp, Homo sapiens
gtcttccacaatggttgaactaatttaccttcccaccaacagtgtaaaagcgttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccc

SEQ ID NO: 13415 - DNA, 230 bp, Homo sapiens
ttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacac

SEQ ID NO: 13416 - DNA, 277 bp, Homo sapiens
caccaaggacttttagcaggcgtgtcttcctctctgagccttggatttcccatctgtgaagtgaggataagtccctcccaggaagactgcaaatattcagtgagaggagcagcactcagagcatgcatggtgcatatctggtgctagactccaagaattggatggcactaatattgtaacagtgttgacacatgtcccaattgtttctctttccatagctgttcttagaaacttacttcaccatccgcccaccccacccccatcctgtgttcccgca

SEQ ID NO: 13417 - DNA, 120 bp, Homo sapiens
tccttccagtattttatacttcctgggatagcactaccttgcagaaatgtacagcaaatggctgatcgctcttccatagatagtccttcaaatatttaagtgagctatcttattatcccc

SEQ ID NO: 13418 - DNA, 172 bp, Homo sapiens
cctaggattaacattttggccaatggttttggcattcttttggatttggcccagtcttattttcaatgcagagtcatgactatagataccagaagattagagaataaaattcattcatacctttcttggctgttggttgttaccaataaatatttcagcaaaggttcagacc

SEQ ID NO: 13419 - DNA, 196 bp, Homo sapiens
tgaaatattttactaagcgttcagtctgtgcctcctgcatgggtgggagtgaggggaacgagacccccagcctctgcaaatgctacccccaggctcctgggagacctggcgatgcactcctgggctcagggcccatcaggcagcctcttaccctagagctctctccactctgaggttcagaaggaccccaacccag

SEQ ID NO: 13420 - DNA, 158 bp, Homo sapiens
  misc_feature 32: n=a, g, c or t
acacgaatgtgtttctaaatgagagaggcagngtatcatgctcgctgagataaaaacagaagctgccagacactgcactgtggctttattctgagaatcctttgcctgaaacccgctctcttttcttgatgttctctgtctctctctctctctctctc

SEQ ID NO: 13421 - DNA, 223 bp, Homo sapiens
  misc_feature 129: y=c or t
  misc_feature 130: m=a or c
  misc_feature 170: n=a, g, c or t
tttgtattatataaatcaccattaaattagaattttggggggacttatatgaggaactcaccatataactttggagttatatgaggaagctgtgagtgtagatcataataaaagcatatcattctagaymattttaaaaaataccgtgttccgatggaaagacccagttncctctcgtgatatgattttccagagacatacatgaagtctcccaatttgaagg

SEQ ID NO: 13422 - DNA, 571 bp, Homo sapiens
  misc_feature 44: n=a, g, c or t
  misc_feature 45: n=a, g, c or t
  misc_feature 237: m=a or c
  misc_feature 269: m=a or c
  misc_feature 271: n=a, g, c or t
ttaaaaatcagttttgatgaaaggagggaaaagcagatggactnnaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccmccagagatagtgggggaaatgccagatgaaamcnaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttgtcccataatatgctttttactccctgatcccagtttctgctgttgactcttccattcagttttatttattgtgtgttctcacagtgacaccatttgtccttttctgcaacaacctttccag

SEQ ID NO: 13423 - DNA, 296 bp, Homo sapiens
  misc_feature 255: m=a or c
gttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccamcttcagcaggatcctgattgccaaagtagcttgtgaaactg

SEQ ID NO: 13424 - DNA, 113 bp, Homo sapiens
tttttgatagttaatagaaattgaaccagagttttcttatgtttgcttgaacagttgtgtaaatcatacaggattttgtgggtattggttgaatatttgtaaaccattcccca

SEQ ID NO: 13425 - DNA, 394 bp, Homo sapiens
  misc_feature 20: r=a or g
tgttaatgatgaatttgctraaaaataaattgaggccaaattaaatacaaacaagataactctaaaagattgaggagaaagtcaaaaatctaggcagattctgtggtcagatggcttttcagttgcctttgggtttttttttctcttctttaaagaaagagaacctgaaaatcatagcaaatttcctggtttatacaggaaagataattaggaattccagacagtggacccatcttcaaagataaggcatggcccctgtacttctaccaagtttgagatgagtatacacttatagtttggattaaggatgtcttttgtaggggcggcagcggctgcgttgtataaagtatacctgtctaatgagcatataaagatgctgtcactcaacaggtta

SEQ ID NO: 13426 - DNA, 180 bp, Homo sapiens
atttggacagaaatgttgaaggcaggtgcctgatccaaaatgcatttagtcaggactgaacacaagctgcctggatagttcctgcagttgcagtggtgcagaatggctgacctcagtcttgcagatgcattaacagaaccatctccagacattgagggagagataaagcgggacttcatt

SEQ ID NO: 13427 - DNA, 477 bp, Homo sapiens
  misc_feature 30: k=g or t
atagctttaagaatgtgctaatgataaatkattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagta

SEQ ID NO: 13428 - DNA, 94 bp, Homo sapiens
atccaaatctcacttgaattataatctccataatcctcacatgttgagagaggccaggtggaggtaattaaatcataggggtggttttccccag

SEQ ID NO: 13429 - DNA, 179 bp, Homo sapiens
  misc_feature 168: s=g or c
  misc_feature 169: w=a or t
gtttatatattctgaatattaaatcatatccatgtgatttgcatacattttcatccatttcctaagagacattttcactgtattgaacgttttctctgatgtgcagaaattttttagtgcagttaaatttttcattttctttcttgctcatacatttaatgttgtatswaagaaaatgc

SEQ ID NO: 13430 - DNA, 537 bp, Homo sapiens
  misc_feature 24: m=a or c
  misc_feature 92: m=a or c
  misc_feature 99: k=g or t
  misc_feature 136: n=a, g, c or t
  misc_feature 138: n=a, g, c or t
  misc_feature 139: n=a, g, c or t
  misc_feature 226: k=g or t
gagatgaattgatagagtatatamaagaacagaaaaggtcatccgccaaagaagcctgtccagtttggaactgttcctttcctgtgcacagmaacagtkaagtgctttaatagctacggaaccagttgacattgantnnaaagaacatgacaaacccacactggcattggataaatcatattacaccttcaaaatacacactctgaattataaagatgtgtttgtkttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatt

SEQ ID NO: 13431 - DNA, 312 bp, Homo sapiens
  misc_feature 3: n=a, g, c or t
  misc_feature 133: n=a, g, c or t
  misc_feature 136: m=a or c
  misc_feature 191: r=a or g
  misc_feature 309: m=a or c
ccntctctgccctgctccaggcaccaggctctttccccttcagtgtctcagaggaggggcacggcagcaccatggacccccgcttgtccactgtccgccagacctgctgctgcttcaatgtccgcatcgcaancamcgccctggccatctaccatgtgatcatgagcgtcttgttgttcatcgagcactcrgtagaggtggcccatggcaaggcgtcccgcgggtcatgtgtctgatgctgctgagcgtggcgcgagcattcttgttgatggtggtccgcacataggaggtggcaggcttccgctggcmgga

SEQ ID NO: 13432 - DNA, 429 bp, Homo sapiens
  misc_feature 294: s=g or c
  misc_feature 296: s=g or c
attcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatscstcaatatgatggctagtctgtttcatagtgaataaaaagtgatcctggatgaatgaataaagtgaaattcagataatttttctcaaaactgaaattgtttaaatcttcctttagttctcttttttctgcctgc

SEQ ID NO: 13433 - DNA, 200 bp, Homo sapiens
caatgtaaatgctatgcaaatatttgttacattgtgttgtttaggaaatcataaccaaaaaaatgtctgttcatattcagtacagacacaacaaatccatttttatgaatattttcaatccttggattgaatccacagattgaaaacccgcagatatggagggctgactgtgttcagtacttccttttttttttttcctt

SEQ ID NO: 13434 - DNA, 197 bp, Homo sapiens
acctgctttctgcccttaggctccagtagattgcaaatgacctgcttactttctgttcccgggctgcgttctgacacctgtcggatagtaaatcccaagtaaggtaccagccgtcggcagatttgagctttcttcttggacacctatacccacagtcctccagtgttttagacgcccagctgcagcccccagccctc

SEQ ID NO: 13435 - DNA, 254 bp, Homo sapiens
aggactgcatttgctccggagcgtccagagtcctggccctgagcgggaatcgcagtggccgaggctgagcggcaggtagaaggggcgtctccggggcttcacagggaacacaggggcttcggcccaaccacaagtacgcagttgcacatgccctacttttgcccattctttgcaaatcccctaaggaacgaacgcgcctcgcgtgcgggcctttctaatcttcgcttgtcccttcacttccacagctggaggtc

SEQ ID NO: 13436 - DNA, 323 bp, Homo sapiens
aactcttagttcctccttgaattgttgcgtttcatcttttcagacgaccctgggttccagtgttggctgtcatttaatagcggggttactttgggcatgtcacttaacttacttgagcctcgtattccttcccttactcgcagtgtgggcagtacaatagcaacttcctggaagttgctgtaggaagaccaataatgtgtgtaaggtacttggtccttacatacattattaaatctgttggtttcttcctcccattcttccgttataatctaaatcccgatttctttttggttgtgaagccagttttcctgtccttctggttt

SEQ ID NO: 13437 - DNA, 166 bp, Homo sapiens
gacgtgggcagaagcaggagactgaagggggctcgcggcctggcaagaatgtacagctgacagagaacgagatcgcgtctgtgcctgaaatcccgggagatttttctgagccagcccattcttctggagctggaggcacccctcaagatctgcggtgacatacacg

SEQ ID NO: 13438 - DNA, 159 bp, Homo sapiens
acacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaacggagagggggaggc

SEQ ID NO: 13439 - DNA, 118 bp, Homo sapiens
  misc_feature 112: m=a or c
tcacactgagtgtccagtccctccaaatccggctacactctactggcaaggagcacctgggccatgttttagagatcatccgaggactaaccccaaaagtttatgaagagamagcaga

SEQ ID NO: 13440 - DNA, 303 bp, Homo sapiens
tatcttgcatcttgggctggactcctacaacagccacaacctccctgctggtctcccagcttctagccttcccccatctcctgtcgttttcgacacagcagccagaaggatcctttaaaaacagaggttgatcctgtcgttcctcaaaatcctccaatggttttcctactgcactcagagtaaaagccagtctctgccttagatgctctgggatcctgtaccctctttggtctcatgtcctacaatctgcattctggccataatggtcttctctgctgttccttgaacattccaggaacattc

SEQ ID NO: 13441 - DNA, 439 bp, Homo sapiens
  misc_feature 389: w=a or t
  misc_feature 392: k=g or t
  misc_feature 424: y=c or t
gctggaactataggcacgcaccaccacgcccagctaattaaaaaatttttttattagtagagttggtggtctcactatgttgcccaggctgatctcgaacttctgggctcaaacagtcctcccaccccagcctcccaaagtgctgggattacaggcatgagccaccatgcctagctaaggcatgcttctctaagggtcctaactctgggtacttcctctgcctggcagcatcttcttccagataaatcctatctgccaacttctccggtttttcctttctaaatgtggtcttttcagtgggcaccactctcaccaacctatttaaattacaatccaccaccttcccagcagtcttgaccccctttctcaagctgttttttttttcctgwagkgcttaccaatttttttaacatataatttattyatttgtaaagaaagc

SEQ ID NO: 13442 - DNA, 144 bp, Homo sapiens
cacatttccagggcagcagccgggatcgatggtggcgctttctcctgtgcccacccgtcttcaatctctgttctgctcccagatgccttctagattcactgtcttttgattcttgattttcaagctttcaaatcctccctactt

SEQ ID NO: 13443 - DNA, 332 bp, Homo sapiens
  misc_feature 193: r=a or g
tgtctacaggtgaatttgtatgtgtgtatattacacgtaaattcacgcactcctgcgtcattaacactccattacagttccagtgggcgagtggcgggaaatcctcgtcaagttgtcttgctgtttcctgccatgatggcgatgagcacctgataggagaagggggaagactttagatagtgtttactttgaraacctaattaagcatagcctgaagagaagcccccaggagcctagaggcccgggaggggtcccagctccttgacccactgtttctgtgaatttgaacctctgatgggctcgatcctcttatccatagagcaaggttccac

SEQ ID NO: 13444 - DNA, 253 bp, Homo sapiens
  misc_feature 39: s=g or c
agagtggaacatggcgacttgcgccgaaatcctgcggasgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaa

SEQ ID NO: 13445 - DNA, 216 bp, Homo sapiens
ctgtctctttctaactcctatgtctccaccagactcagggtacccactgggtggtgtggggctggtttccctaacattccccaccaaataaagcagctccaaccttctagatggttgctcagctcagaagtcttagagaaattctgatgcctctcctcacatttgctctgtcggcaaatcctggtgtcacaagagggctcaggagggtttctggat

SEQ ID NO: 13446 - DNA, 232 bp, Homo sapiens
  misc_feature 94: s=g or c
  misc_feature 102: s=g or c
  misc_feature 106: s=g or c
gggtttgggcctggctctgtgactgaggcggcggcggtggcggccaagcgggatacgggcggcgggagctggggaacaggcatggacgtttccsggcaagasaccsactggcggagcaccgccttccggcagaagctggtcagtcaaatcgaggatgccatgaggaaagctggtgtggcacacagtaaatccagcaaggatatggagagccatgttttcctgaaggccaaga

SEQ ID NO: 13447 - DNA, 199 bp, Homo sapiens
  misc_feature 136: n=a, g, c or t
attgaggagctgcctcgcgcagggggtgtgcgaggctgagtccaagagatagcaaatcgagtcttaaataatccggggagaaagacgcccgggtagatttgaggtgcagccttggagggagggattagaagccgcnagactttttttcctcccctctcagtagcacggagtccgaattaattggatttcattcaccggg

SEQ ID NO: 13448 - DNA, 221 bp, Homo sapiens
  misc_feature 15: k=g or t
  misc_feature 127: s=g or c
ggatgcttattatakatcgacgcgacaccagcgcccggtgccaggttctcccctgaggcttttcggagcgagctcctcaaatcgcatccagattttcgggtccgagggaaggaggaccctgcgaaastgcgacgactatcttcccctggggccatggactcggacgccagcctggtgtccagccgcccgtcgtcgccagagcccgatgacctttttctgcc

SEQ ID NO: 13449 - DNA, 261 bp, Homo sapiens
atatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctc

SEQ ID NO: 13450 - DNA, 383 bp, Homo sapiens
  misc_feature 132: r=a or g
  misc_feature 148: m=a or c
  misc_feature 157: y=c or t
  misc_feature 160: y=c or t
  misc_feature 182: m=a or c
  misc_feature 193: y=c or t
  misc_feature 224: s=g or c
  misc_feature 227: y=c or t
  misc_feature 254: y=c or t
  misc_feature 347: n=a, g, c or t
  misc_feature 348: n=a, g, c or t
  misc_feature 349: n=a, g, c or t
aaaccacaatggccaggcgttcctccaggacctcctgccccaggatcttgcttcaagtgctggaaatctggccgctgggccaaagaatgcttgcagccggggattcctcctaagccatgtcccatctgtgcrggccccactggaaatmggactgtcyaaytcacctggcagccactcccagmgcccctggaaytctggcccaaggctctctgactgcttcccasatyttcttggcttagcggctgaagactgaygctgcccgatcgcctcggaagccccctacaagaccatcacggatgccgagcttcgcgtaactctcacagtggagggtacacatccagatggcnnnttcctgccttaactgatgacattctaccacaaaa

SEQ ID NO: 13451 - DNA, 211 bp, Homo sapiens
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcagtaagtacaacatcttg

SEQ ID NO: 13452 - DNA, 158 bp, Homo sapiens
attatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctacccc

SEQ ID NO: 13453 - DNA, 420 bp, Homo sapiens
aatcgaccctgtgacattcttctggacaatgagtcccatcatctctccaccatgcaccttgtgactccctcctctgctgacaacagataaccacctttaactcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtactcttacggtggagggatctgcaatcagaactattgaacttctccattcagaccgcca

SEQ ID NO: 13454 - DNA, 155 bp, Homo sapiens
  misc_feature 126: y=c or t
cttctcccagagaaaggaaaatcttggaaaagatttaaaaacacaaatctaagccttgacggtttttttttcccttttgacccccttcccatctcttcagaatttattcccatggctttttttttycttgtgcgtgtataaaatcaaaaggaagg

SEQ ID NO: 13455 - DNA, 443 bp, Homo sapiens
  misc_feature 90: r=a or g
  misc_feature 99: k=g or t
  misc_feature 100: k=g or t
  misc_feature 184: n=a, g, c or t
ggggcgcgcacctcggggcgatctcggtgctccttacctgggaggtctcccggcttagtttcggcctcgttgggtcggaatctccaaagrcagtgggtkkcagccagaaacgcgaagacgaacgcctagccggcgcgggcagaaccgaggacacaatgagatttgtgggaccgggcgcccagangctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaaccca

SEQ ID NO: 13456 - DNA, 220 bp, Homo sapiens
  misc_feature 36: w=a or t
gccattttgaatgtgcagctgcagcgggcgtgagtwgggggaggacgggttgccgactcgcctacctagcggtctcttgattgtcgatattttgttggcataggtttatgtagagacgtatacatatatatagacacactgtctttaaatctaggcctgtatccggtgtccgaggcgaactcagtaagatgatgttaagaggaaacctgaagcaagtgcg

SEQ ID NO: 13457 - DNA, 178 bp, Homo sapiens
gcatgccccatttttttgaggttccattcatttttcttcattcttttttctgtttttcagattagataatctctatcaatctatcttcaaattgctaactcttctgccagttcaaatctattgttacgcccttctagtgaatttttcattttagtaattttacttaattccagaattt

SEQ ID NO: 13458 - DNA, 409 bp, Homo sapiens
cagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaattttttttttctatcagctattctgttgtatttctaaaacattttttagatggctttttaaagtatatttagcagtaaccttatgaggttcaaattggtaaatctcttgtaatttagccttcatcgaataataggtaccagtgtattaaaaatgtgtattttttgcagccc

SEQ ID NO: 13459 - DNA, 252 bp, Homo sapiens
aatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacaga

SEQ ID NO: 13460 - DNA, 170 bp, Homo sapiens
atttcagcttttggattcaatttgttaagtagaaatgtaccatttgagtcgctttctaaaatttttacatttgctataaaatttctgtttactgtcttaaatctcgagatcaaaacagtactttggtaactaatgttgagatattatatattccccttcctccctcccct

SEQ ID NO: 13461 - DNA, 483 bp, Homo sapiens
gtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaagggttagatgaa

SEQ ID NO: 13462 - DNA, 537 bp, Homo sapiens
gtcgacgtgctgacgccatgacgccccggctggtgtgtgtcggtgtgtatgtgtgtgtgtgagtgtgcgcgctccgagtgtgtgtggtaatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaagggttagatgaa

SEQ ID NO: 13463 - DNA, 356 bp, Homo sapiens
tctaggctttgctacagggtgctttttgacatacttttgcactgatcacccatgtgatgtagctcatctaagttctgcctacaggacctttgtgacatatctcttcactgataacttaggtgatgtaacacttttataagcactgcctacagggaattttgacaaatctctacactgatcacctaggtgatgtcactattgtctaccctctgcccaaagtgggcattgtgaaatatgtctgcactgatcacccaggtgattctactcttgtcttggatctgcctacagggggttttgtgaaatatctctgcactgatcaactaggtgatgtactagtgtctaggctgtgctacagg

SEQ ID NO: 13464 - DNA, 307 bp, Homo sapiens
  misc_feature 93: w=a or t
attaatgctccctgggttcctgcaaacctttggttagtttccaaaatccataagaagttgatactgacaatttttgccaactttttggttgcwtttatggaggagagctttttggaggcctgtagtaaccaccattttcactgacatcctttggatcaggaatctcttaaatcttttttgttttcctgagggttcttgctgcccttcttttttatcttgttatcaaaaatagtatacttcatcataacctcagaattacccagattcattaatactgagtattgtctagaaatctctttctgcctga

SEQ ID NO: 13465 - DNA, 425 bp, Homo sapiens
  misc_feature 234: w=a or t
agtcttgaatgagggagccccactgtgggagcaccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctwttcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacga

SEQ ID NO: 13466 - DNA, 184 bp, Homo sapiens
  misc_feature 70: k=g or t
  misc_feature 71: n=a, g, c or t
caacaatatttattaaaatacaaaaatacacttttctcacattacaatcagtgttcttttgttggcaatknccctcccccacccataccaccccctttcaaatctgaaccccttatttccttttaaagctaaaataataactgaaagaagttacatcattagatggaccagaataacagagatc

SEQ ID NO: 13467 - DNA, 476 bp, Homo sapiens
  misc_feature 150: y=c or t
  misc_feature 365: w=a or t
  misc_feature 378: w=a or t
  misc_feature 429: w=a or t
  misc_feature 430: w=a or t
ttttattgttttgttttggtagtgtcatgtttccttgattattcataatccatttggccatatgttgaaatctgaacgtttgaagaagtaggcacgtattctagtttttacagactgattttgacagggaaagccctttatcagttagcytttccagagattctaggcaggctttctagcaggatttgtgggggcaggcttgctattgaagtccttgaaaaggctctcctggacctaaatgttttttcccattctgtgacttgttttctattttcttgatagtgtcttttgaagtataatactaaagtttttttattttgatgaagtgtattttatctattttttgttattactgttgctatgcwttcagggtcatawctaaggccattatctaatccagtgccatgaatatttatgcctatattttcwwctagtaatgttatagttacagttcttagatttaggcctttgatcca

SEQ ID NO: 13468 - DNA, 136 bp, Homo sapiens
  misc_feature 136: m=a or c
aactcaactgtcaaggtgtccattgtaccagctgggccatggatccctcctgcctgaaatctgactccacctgccaagagtctgagcctgcaggcctagatttcgactctgctggccaagattatttctctgcagm

SEQ ID NO: 13469 - DNA, 212 bp, Homo sapiens
  misc_feature 170: r=a or g
cagacagtagaaaataccagggcagctgcaggtcacagccctgaaatctggccatggggttcatatcctgcttccacttgtgctagctgtgtggccttggggaacatactcaacctctggcggcttcagtttctgcatctgaaaaacaatgataataatagagttcctcrcaggataaatgtgcgtaacacacataatgtagtgcctggccc

SEQ ID NO: 13470 - DNA, 473 bp, Homo sapiens
  misc_feature 91: w=a or t
caagtcctgtcaaacatttctcaaacttctgattttatcaaaggtttgccagccaataaagtgcatcccaagtatacaggggagaaagccwagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttg

SEQ ID NO: 13471 - DNA, 315 bp, Homo sapiens
  misc_feature 133: r=a or g
  misc_feature 290: y=c or t
aaaatttttagtttatagaattgactttaacagttatttttgtaattgtgctatatagctgaatcatggtgttccagctttgagaggcatagacgaatggagagagacccatttaagatagggtatgtttaaractatttgtatcagatacttcctgtctcattactttctgcaacaacttcctggctggtctccctacctactgtctcacctccaccaaatctgtcctccctactgcttcttcctgagctttgttgaatacagattgtactcttctctgctttaaaacyttccagaggttttttcataacttgg

SEQ ID NO: 13472 - DNA, 288 bp, Homo sapiens
ataataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacc

SEQ ID NO: 13473 - DNA, 274 bp, Homo sapiens
caataataataccgtggccatcagaaatagtttatactcttttccaaattcctgacatgtaagaaacgcagtaatactaaaagcttctggtacctcattgtgttggcattgaccttaccttctctctgtggctttccctttccctaatgtaggtagagctgctgtatttcaggcaagcactcaggtattgggctattttagttgggtttttgctttttattgatttggagttttaaaatcttcttctaccacgaactctacccctgacaaacgg

SEQ ID NO: 13474 - DNA, 470 bp, Homo sapiens
aaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggactggtctgctctctcgctgagtacatccgcacaacgacatgcccatctacgaag

SEQ ID NO: 13475 - DNA, 112 bp, Homo sapiens
attgggtcggtgctgcgtctaattctctgcttttcttaaatcttgtcgctgcctctgattttaattcctagcttttgggaacctgtcatcctacgtttttggtactagctgg

SEQ ID NO: 13476 - DNA, 272 bp, Homo sapiens
  misc_feature 221: r=a or g
cctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtartatagttttgtgaatttattgcactgatgttgtaccttgtggtatatctgt

SEQ ID NO: 13477 - DNA, 168 bp, Homo sapiens
acttcagccagagagcggggttagggcttcattgccttgtgtcctctgctccgggagacttcggtgattctgccactccctccgtcgctctgtgacctgctggcattgaatgatttatagctaagactccaggacacccctgaagccgagaaatgaaatcccaagttg

SEQ ID NO: 13478 - DNA, 227 bp, Homo sapiens
aacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttgga

SEQ ID NO: 13479 - DNA, 110 bp, Homo sapiens
caaatgaacagcaggattatgaattatcaaaggaaaaagtatttgcgaggtgaaaaaatctgatgtttgaggaagtttttatttttatttatttgttttgtttttttttt

SEQ ID NO: 13480 - DNA, 74 bp, Homo sapiens
aaatgaaccctgttaacagtactttaattgagccgtctggttctagttctgtccagagcccccgccgttttccc

SEQ ID NO: 13481 - DNA, 403 bp, Homo sapiens
  misc_feature 355: s=g or c
agtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttasagctagtgcagtaacacaagtagccaaggtttttgaccaatatctcaa

SEQ ID NO: 13482 - DNA, 134 bp, Homo sapiens
gatggcggcggcggcggcacgacagagcagcagcagccagtattcgggaaaggcagacagtggctttgaagcgtatgttgaatttcaatgtgcctcatattaaaaacagcacaggagaaccagtatggaaggta

SEQ ID NO: 13483 - DNA, 93 bp, Homo sapiens
gaagtgactctttacccttgaatccttccccactcctgaccacctttcctactttttttcccccaaatgaatagtgactttgaatagctcgcc

SEQ ID NO: 13484 - DNA, 167 bp, Homo sapiens
  misc_feature 10: n=a, g, c or t
aaaaaatganaataaaaataaaaataaaaatatgttactcatgttaacatataattggtttactattgttgttttaaatgaattaatgaataattaaacttttttcagctttaatttctaatatggcaaatattaatagatatatccacttaactaaagttcctggg

SEQ ID NO: 13485 - DNA, 297 bp, Homo sapiens
agtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaaccc

SEQ ID NO: 13486 - DNA, 169 bp, Homo sapiens
actttcggtctctggctgtcacccggcttggccccttccacacccaactggggcaagcctgacccggcgacaggaggcatgaggggcccccggccgaaatgacagtgctggcgccagctggagcccaacagtgcgtaaaccccagggacaagatcaggggagaggggag

SEQ ID NO: 13487 - DNA, 140 bp, Homo sapiens
  misc_feature 123: w=a or t
actttcggtctctggctgtcacccggcttggccccttccacacccaactggggcaagcctgacccggcgacaggaggcatgaggggcccccggccgaaatgacagtgctggcgccagcctggwgcccaacaacctatctc

SEQ ID NO: 13488 - DNA, 479 bp, Homo sapiens
  misc_feature 118: k=g or t
  misc_feature 120: w=a or t
  misc_feature 124: m=a or c
  misc_feature 135: s=g or c
  misc_feature 136: k=g or t
catgtctttgagtgtcctattggactacagattagaggataataaagaacattcatttgaggtttcattgtttgcggaacttttcaacgaaatgcttcaaagagattttggtgtccgkawaatmcaaatcattaskgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggag

SEQ ID NO: 13489 - DNA, 314 bp, Homo sapiens
  misc_feature 154: n=a, g, c or t
  misc_feature 155: n=a, g, c or t
  misc_feature 156: k=g or t
attcgaggcgacgggctccgggccctgatagatggggtgcggggacggagacaaatgacggcctttgggctcggaatacccacctttctggtaatgcagcccagcgggtcccagcctcgttttccagccctcactcaaaatggagtcgctctgnnkcgaacgcctctgacaagtgtgtacctacgtgtcagggagcctgctcacatgaccgtgtggagaaagttctttccctgaggaccatctggagtggacgcgtgcactacccctctctgaatacaccctccccacgaggccctctggagcatcctgtagag

SEQ ID NO: 13490 - DNA, 249 bp, Homo sapiens
  misc_feature 186: w=a or t
  misc_feature 245: k=g or t
attttttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcawaagcttctggaagcaatcagttcccttgatggaaagaataggtaacgttcccgtcagtkaggg

SEQ ID NO: 13491 - DNA, 192 bp, Homo sapiens
  misc_feature 41: r=a or g
gcatttatcttcactctgatgagggctcagacttgataacrcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccgg

SEQ ID NO: 13492 - DNA, 160 bp, Homo sapiens
ctatgttgtcacaccccacaccccatactcctgtaagggcgtgcttgtgcacgcgcacacgcgcacactcacacgcacgcgcacactcgcacacaccctacttttgaaatgagctcatttgtattagtgcagctcctgagtgcactggacgattagggta

SEQ ID NO: 13493 - DNA, 401 bp, Homo sapiens
  misc_feature 318: n=a, g, c or t
  misc_feature 326: s=g or c
  misc_feature 339: n=a, g, c or t
  misc_feature 353: n=a, g, c or t
  misc_feature 365: n=a, g, c or t
  misc_feature 387: n=a, g, c or t
gcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcntgtcggtsagcactgaaaccncgtccctgctccanggcctccttctntggggtccaaggtcccatacanggcctctgcctcgg

SEQ ID NO: 13494 - DNA, 293 bp, Homo sapiens
  misc_feature 260: s=g or c
ttccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcasactcgacaggtgcccagcaagcccattgaccac

SEQ ID NO: 13495 - DNA, 332 bp, Homo sapiens
atgagataaccatattagtacctccaccaagcctcctgcttgatcataccaagattccttttaatgtgaaggttctcctactttcagtaactaagaaaccctcacagaagatatatattcctttctccttacagcttctttagaactgcagagtctttcatggtgtggcaggcaaataaaattgtcggaaatagaatataaaaataaaactgtacatatccgaaagtatgtatgacagtgtgtaataaatgaggagttactgagcaggccgtagggccaagtttatttgttttgctgaccctttagcttactacggacagttgatggctggg

SEQ ID NO: 13496 - DNA, 581 bp, Homo sapiens
  misc_feature 379: s=g or c
  misc_feature 381: y=c or t
caaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattaagscytcccagattaatctgaatgattgacttattttttcttaggcaagtcagtaagccacccactagacagccatatccagcaaaataagagaagtttccagatgccaaatgataagccaccatcaacccagaggggaagccttctggttggtttggctgtatgagattcaggaaggccagaatacccaaaattattcacaaga

SEQ ID NO: 13497 - DNA, 412 bp, Homo sapiens
  misc_feature 321: s=g or c
tctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtggggscgggggctggcttgctgaagtcttcaacttgcactcggagctcctttgatacctcaggaagctggctgtcaggtggcagctcacaccagac

SEQ ID NO: 13498 - DNA, 285 bp, Homo sapiens
tattttggtagagacagggtttcactgtgttgcccaggctggtctcgaacttctgagctcaggcaatcttcccgccttggcctcccaaagtgctaggattacaggcgtgaggcaccgcacctggccaagaaatggtttttcatataatctccattggtctgtcatgacaacaatagcccttttcctttttggagggaatgttgttattttatgattactctcctttttaggaaatgatacatgatctactttctcatgcctgctccctctgtcacatttatacgc

SEQ ID NO: 13499 - DNA, 184 bp, Homo sapiens
tctatgtggtgggaactcttactgtctccattttatagatgaggaacctgaggcacagagagatcaagtaatatacctgcagctattaaatgatggaactaggattcagaccctgacaggctggctctagagagtgtgctgtcaacaccatgtctcttcagaaggcatttctttttcttttttt

SEQ ID NO: 13500 - DNA, 191 bp, Homo sapiens
  misc_feature 124: m=a or c
aatttaaatgattgtataactcaagaagattacttttctatgttgctcaagctgtgcctgccaacttgtaacttaataaatacaggaaatcctcagagaaggtgatattttcaggaaaaagacmaatgccctcatagtagtgggaagtgtgaaggtgaccgtgaacatccttcctcatcgggtctgtcccc

SEQ ID NO: 13501 - DNA, 317 bp, Homo sapiens
tcatgaacttgattctattaatttatatgctgatattgtactttagacatacgcttgtctcctgaatgtcctctgaatattttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctag

SEQ ID NO: 13502 - DNA, 228 bp, Homo sapiens
  misc_feature 215: w=a or t
tttaatttgttgaattattagttaccactgtcatttcttcagctatggatatgtggctgatgttggggagacggacctcagtgtgttttatattgtctggtgttaagatgataaattactttgtgattacaagcaaattttctatttgacaaagcccttggtggagtccaaatgatttttctgtaccatattgttctcttacacatacgtatgtwaggaaaataggca

SEQ ID NO: 13503 - DNA, 345 bp, Homo sapiens
catggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctatcccctggagttagaatggccatcctgaagtgaaaagtaatgtcac

SEQ ID NO: 13504 - DNA, 428 bp, Homo sapiens
ttaggaggttaattccccctcccacaattgggaaatgcattttctagctttttcttgtgaagtttgtgtattctgagcttcacatagactgggtgttagtgtttttcagtcctttgatagactcttttagctattttatgtgctttatattaaaattatgttaaacacttatttgttcgacacctattctgtgtctagcaccgcagtgtaggcacttgaaatgcaatggcaaagaaagcagatgttgctctcctcatgggacttgtaatctagtcaagaagacaaaggtgaatgaagtaaataattataaactataatatgtgtagaatctggtctggttccctgtgagaactcaaggaagatttcccagaggaagtggtgttaaaactgagacctaaagattgcatctgaattaaataaaaagaagt

SEQ ID NO: 13505 - DNA, 307 bp, Homo sapiens
  misc_feature 40: y=c or t
tgttggtgtttgtaatattcattattgtttgtatatacayggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggg

SEQ ID NO: 13506 - DNA, 342 bp, Homo sapiens
ttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactg

SEQ ID NO: 13507 - DNA, 369 bp, Homo sapiens
  misc_feature 108: y=c or t
  misc_feature 117: r=a or g
  misc_feature 183: s=g or c
  misc_feature 271: w=a or t
aatataaggagatacataggaagatcgaattagaccatctcggaccaccaggtttacaattccacctgcagatacatgcaagaagtagtgtcacaatacttatgtcaygttattccrttgaggtcatcaccaactaagcttataattaatgtgtggtcaatttggtcaatgtcaccagcgtasatactaacaaaaacaagggttgcaaagtcaaatgcctataaggcagaacgtaagacggtaggaagcaaagtctatagggagctatatwataaggggctgcagattcatggcagattctaaagcacagcagtccccaacatttttggcaccagggaccggctttgtggaagacaatttttccacagg

SEQ ID NO: 13508 - DNA, 409 bp, Homo sapiens
  misc_feature 100: w=a or t
  misc_feature 267: w=a or t
catagccataagcctgttagtatcatatgaagagagaacagttatcttagtacctatggattttctttatttgctgtttgaatggattgaccttggttawgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagtgttgawaggcttctgctgaacatatgccaacccacctgcataatatatttttgttgcttttataaatcatgcattacataaagtgtgacaacttcaaaatgtattctctgttcttggaatacagtgccctaaaatggtgttcttatga

SEQ ID NO: 13509 - DNA, 347 bp, Homo sapiens
aaggcaacttctgttctgttgctaggactgttctagcaacacccatcaaaagctgtgatcccaatacttctcctacagtcattgaggaaatgctttttcagcctgtactctttcctactgactgtcaaatgcgtgtacgaaatggatcctcttttattcactatttagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttgggg

SEQ ID NO: 13510 - DNA, 220 bp, Homo sapiens
aatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgc

SEQ ID NO: 13511 - DNA, 168 bp, Homo sapiens
aaacctatgtgggggtgggagagtttttaaattactcagatttttaaggaggatttcaatagtcctttttatctttgtgaaaattttatttgaaagttcttattttaaaatatcaaacctgtcagaacagctacacttttaaatgctcctttaatatgaaaagatact

SEQ ID NO: 13512 - DNA, 188 bp, Homo sapiens
gttgtgtttgagttggattgcttgcttgtatggccaccaagtggacactgggctacatggagacccagtaatgttcaggcgacactggtctgttctatctggggcatagaacagaggatggtgaggcagtagaatgtgagaagcacactctggaaggtgagtgatgggggaaatgctctgtggcaggg

SEQ ID NO: 13513 - DNA, 436 bp, Homo sapiens
tgtacccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggcgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaat

SEQ ID NO: 13514 - DNA, 222 bp, Homo sapiens
aagtaatccagaaaagcgaaacagtatgacctcacgggcaatgaagaacaagcatgtccaccaaaacaatggcagattaatttccatagaggttgtgaagctgatataactccagaagacttgaatatattttttgggggtggatttccttcaggtagtgtacattctttttcaaatggaagagctggttatagccaacaacatcagcatcgacatagtgga

SEQ ID NO: 13515 - DNA, 443 bp, Homo sapiens
  misc_feature 149: k=g or t
ttgtatttagttctgctgtaagcagaaagtaactcttgtattcaccactgcaagagatttgatatcattcttcccaagagttggaaaattttaaaagaacatgtttgtagagagggaaggattatgttaacttgagtaacgatactgakaatcagatcaagaaatggaaggagaaattgtaggtcccaaatgggagttgaggtgttaatttcagttttttattacagaggtgaccacctattcacctttgcttaaggtgtcttagccaaaagccactttccctgttggaaacaaagtcagttgaagcttcagagcatgaatgaataaaggttcaaagtttaaccttttggtagcatgagggaagtactgttcagtttactcatatctcagcctcatttaggatgttgttcatggtatgtttttctgaccaaataatagactga

SEQ ID NO: 13516 - DNA, 284 bp, Homo sapiens
  misc_feature 124: n=a, g, c or t
atggctgcccccagggagagacgaggctaccatgaaggagccgagcgcagaccctgagtccgtcacccatggatcgcagcgcggagttcaggaaatggaaggcgcaatgtttgagcaaagcggnacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctg

SEQ ID NO: 13517 - DNA, 97 bp, Homo sapiens
caaatggcacttaactgtgaaggaccacctaggagcaagatcttggaccattctgctcaacctaacagtgcagaatgctaagtaaggggaaaaccag

SEQ ID NO: 13518 - DNA, 268 bp, Homo sapiens
atcagacacgaaggagaggccaacagatgagggaagccatttttctgcaatggaattaaatggccaagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggccatagcac

SEQ ID NO: 13519 - DNA, 167 bp, Homo sapiens
attgtaagtagcatttacatttattcaataatattaccacatgctgggtttctgtaccagaaatggccagttgatgtacaaatgtatgttatttttgcttaaattcatttaaattttttttaaaataaaggcagcatcttctaaataagttttatcagctttttttt

SEQ ID NO: 13520 - DNA, 300 bp, Homo sapiens
gcatgcgcgagaggacccgccgggggttcagcgtctctgctccccagtctgtgtggtttccccctggtgggcctgcgctccaccctcacctcctatccgctcggggaggaagaggggatggaaatgggagggatggcgacgagaatgctggggaggggtctgtgggagggtgttctggggctgcgggtagtctgcaggtcgggcggagacgaagggaggtgaagagagggtctgggggcaggggccagtggggcagcaaaggccccttggggtagcaaaggtgggatgtggaaggccagg

SEQ ID NO: 13521 - DNA, 205 bp, Homo sapiens
tctaagctcctatttctctagtattttttcttgaatttaaccctccagagtctgtgactgttcagggtggtaaatgggccagccctgggctaagcatgctttgttagaatgagaacttcagtctgttgggtttaatgggaagatgaacattaaggcaaaacaaccaattgctcctgtgctttctctaatggaagctgcctcaccc

SEQ ID NO: 13522 - DNA, 234 bp, Homo sapiens
aacgagacatctagtacggggctcacaggtaacagaactctgatcagatccgccccggctcccacacagctataaggttgcctgcctgcctgcacagaaatgacgaaggacaaaaacagcccagggctgaagaaaaagtcccagtcggtggatattaatgctccagggttcaaccctttggctggtgcaggaaagcaaacaccacaagccagtaagcccccggcacccaagacc

SEQ ID NO: 13523 - DNA, 104 bp, Homo sapiens
accccgcgcgcgcgcaccccgcgcgcgcctctctgtcgtggcgcggcttcccgcggtcttctctgcaaatgggctccgtggcctagcgcccccgtccccgccac

SEQ ID NO: 13524 - DNA, 200 bp, Homo sapiens
cagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctgg

SEQ ID NO: 13525 - DNA, 276 bp, Homo sapiens
  misc_feature 20: k=g or t
agagcaggcctggtggtgakcagggacggtgcaccggacggcgggatcgagcaaatgggtctggccatggagcacggagggtcctacgctcgggcgggtcagctggtccgtgtgctcacttcatagaacatggaggccatgaccttccccttcaggatgtcgaggctccgctccttctgcaccatcatacgcagtgtgtgtgccacattgaacaggtgagacatctgatccttggtgaactgctggacggacaggctcgtggcacggaagacagac

SEQ ID NO: 13526 - DNA, 188 bp, Homo sapiens
agaaaatttaatccatattgtcccagaatgagaaatgggtttctaattttctcagactgctaatcatcttcctgaatcagttgcagccttatcacttgctctcacatgaaagcattcccatacgtatttgtccacactatcattctataacatattagcttggatttatttttctttttttttttttt

SEQ ID NO: 13527 - DNA, 168 bp, Homo sapiens
taaatggtctttgccaacagttcatatttctcttttactcccaaaaggaaatttattattatatttatgattattattaaatcaatgtctctcatgaggccaggaagcccatttgctccagattcgctgccctgaagttgccctgacttcactgggagctcgtcaatg

SEQ ID NO: 13528 - DNA, 257 bp, Homo sapiens
attaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagataacttaccgtcaccttttgacaagaaaaagcgtttatatattttgaaaatacaatcaaaataagaaacctggg

SEQ ID NO: 13529 - DNA, 412 bp, Homo sapiens
ttggggaacctgatagtgaaaagtcacagatggagaaaattgctctcagaaaaatgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagaataactgcaaccaatcagtgttattcagtgctatgcctccttgtaatgggtagttattaattattttcagagctttccggaaatactgtcctaactggctatgttta

SEQ ID NO: 13530 - DNA, 199 bp, Homo sapiens
gagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccgagacccgccccggcccggtccacattctccccaggaagccg

SEQ ID NO: 13531 - DNA, 112 bp, Homo sapiens
aaatttgacttgttagtttctgtgtttgaaatcatggttctagaaatgtagaaattgtgtatatcagatactcatctaggctgtgtgaaccagcccaagatgaccaacatcc

SEQ ID NO: 13532 - DNA, 178 bp, Homo sapiens
  misc_feature 125: k=g or t
  misc_feature 128: k=g or t
aacatatgaatattgcggggacacagacattcaatccataatagcaagtttcagtggatttcagaagcccctaaggcagaaaagcaaaagcaccttattttttgtccacttgacctatgtcttakgtkggactgaaatgtaggtctcctaattttagtgtagttttgtatatttctcc

SEQ ID NO: 13533 - DNA, 183 bp, Homo sapiens
attctgggaaatgtagtccagacgctctgtggagtcgcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcgg

SEQ ID NO: 13534 - DNA, 646 bp, Homo sapiens
  misc_feature 52: m=a or c
  misc_feature 121: w=a or t
ttgagtcgtattctgtcacataatattttgaagaaaacttggctgtcgaaamatttttctctctgactgctgcttgaatgttcttggaggctgtttcttatgtatgggttttttttaatgwgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaact

SEQ ID NO: 13535 - DNA, 361 bp, Homo sapiens
  misc_feature 7: y=c or t
  misc_feature 183: n=a, g, c or t
  misc_feature 248: s=g or c
  misc_feature 249: r=a or g
  misc_feature 271: m=a or c
  misc_feature 277: s=g or c
  misc_feature 286: s=g or c
  misc_feature 287: s=g or c
  misc_feature 299: s=g or c
  misc_feature 301: s=g or c
  misc_feature 324: m=a or c
  misc_feature 331: n=a, g, c or t
  misc_feature 332: n=a, g, c or t
  misc_feature 335: k=g or t
  misc_feature 337: n=a, g, c or t
cactgcyacacgttgatgtttaggaggttgagaggtttgcctttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcncctgggggactatggcgtgggctccaagaacagcaagcgtgcccgggagaagctttagtgtccasrggatgaaatgtccgagtcaggmcagtgsctcggcggssgccacacccagsascacgggcacaagtccaacacgcmcacatcnngakgnggccctcggccgccgtcacacccc

SEQ ID NO: 13536 - DNA, 354 bp, Homo sapiens
  misc_feature 264: r=a or g
  misc_feature 305: r=a or g
tataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaragacaccttttcccccctgacccagaacagcctttaaatcrcaagcaaaataggaaagttaaccacggaggcaccgagttccaggtagtg

SEQ ID NO: 13537 - DNA, 410 bp, Homo sapiens
  misc_feature 104: m=a or c
  misc_feature 342: n=a, g, c or t
  misc_feature 343: n=a, g, c or t
  misc_feature 344: n=a, g, c or t
  misc_feature 345: m=a or c
  misc_feature 366: n=a, g, c or t
  misc_feature 367: n=a, g, c or t
  misc_feature 368: k=g or t
  misc_feature 369: n=a, g, c or t
aataccttaattaatctgaccagttttcaaatgtctggagccttatcaccagctgtttcttcctcaaggaatacataaccaccacttacaagctggctgttgamatgagagcggtttcttacagtctacccggcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctgaatctagtgagactgcagaatttatgccagcctgacctgtcactgtcatttcttccctnnnmctctgtttgctggctacacannknccctggtgcgagtgtggcaggtgaccattggcacacgctag

SEQ ID NO: 13538 - DNA, 351 bp, Homo sapiens
  misc_feature 44: w=a or t
gcctttccggagcgcgggcgccgatggcgggaatttcgcctgtwtgcggtttagaccccaaagattcctgttggtggtctgggtcacaggaggcaggtttcgggagctggaaatgtgagcgggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggc

SEQ ID NO: 13539 - DNA, 201 bp, Homo sapiens
gcttcctctgttgtccattggtctagagccatccttcgagaccagagccagaccatgagcgagccaaatgtgcatgaggacagcatgaattatccttggagaccagggggccctgttcatccagacattgtctttctttttaaagaagctaaatgcctctttttccctctttcttcttgcatgacctctgggagcttgggc

SEQ ID NO: 13540 - DNA, 287 bp, Homo sapiens
aggcaggtctcacccacaccctatgcagtgactctctgcaatcttttaaatgtgctggtggtttcacacaaggtatccaatctgccccgaatgcccctcagtttgtatgtcattttcttttcttataaaccattctgtcttttttctctccccccccaacactctgtatatacatatacctatattgtacacatgtatgcatatgtatacatgcatagatgtaatcacaccttttaagctatatttttccctttttttcttagctcaccctttcttctttcttcccc

SEQ ID NO: 13541 - DNA, 246 bp, Homo sapiens
  misc_feature 216: n=a, g, c or t
  misc_feature 218: r=a or g
ggaaatgtggcactggggttatgtggttcaggcttcagccttctgtgctcacttcttggattgtaaggagaaggatgttcaggccattatttctggcatagggatattccttctctctgaactgggtgagcctgggcaagacaagttgattcctgggaaaagagtaattctccttttactaaacgtgatttttaaataaaaaatacgacgtaaganaraataagtcttagttaaaacacacacaca

SEQ ID NO: 13542 - DNA, 133 bp, Homo sapiens
aataattacctgtcaggagaaatactgtgattatggaggtggtttttccctgtgtgtggcttattcgttgcactttgtgctgatccctacgatttccccaaatgtgggtaactacagtgtataatttgtggta

SEQ ID NO: 13543 - DNA, 273 bp, Homo sapiens
aaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgag

SEQ ID NO: 13544 - DNA, 178 bp, Homo sapiens
aagaaggagaaagaatcaccaaaagcagggaagagtggaaaaagttcaaaagaaggacaagacacagtagaatcagagcaaatttccgtcagaaaaacagccttgttgctgtcccgtctacagtatctgctaaaataaaagtaccagtctctcagcccatagtgaagaaagacaaacg

SEQ ID NO: 13545 - DNA, 387 bp, Homo sapiens
  misc_feature 58: m=a or c
gcacaggtaaggccggggtgggggtgggtcgcgacgggggctctgggcagcctgggamctgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctg

SEQ ID NO: 13546 - DNA, 165 bp, Homo sapiens
  misc_feature 10: k=g or t
cttgcatctkacgtttattgttctgaacaagaaatttcttacctttcagaaaaattgcaaatgtgttttgtttcatcataatcttataaatttaccatgttagtagtgtccactatcttcctttatcttttctctatgcacatataatattttccagatataact

SEQ ID NO: 13547 - DNA, 271 bp, Homo sapiens
  misc_feature 135: m=a or c
caattgggaggtcaagtttggttccaaccctgcctttatcactaattacctgcatggtgttggggaagccagttagcctatctttgcctcagtttcctcacctgtaaagtgggggtgacagaggattctcagagmatttttttttttaagattgtgagataaggtgtaaaacccataacacagggtctggcacgcagaactttattaaatgttagcagaagcagccgtcaagctcccttagggaagcatgagattagcgagcccagagctg

SEQ ID NO: 13548 - DNA, 331 bp, Homo sapiens
  misc_feature 74: m=a or c
  misc_feature 325: m=a or c
cttttgactcaatttcacttcaattgatacatgcagaaatgttcaaaaagttccttttctaatctgacatcaamtatctagtttgtaatcacttacctgggtctgccatgcaatgaaccaaccatctactattgagtcttggggttcagaatgccattatcgcagtgaacatctactggggactgactgtgccaattattatgctgtgtatatatcatttaaccctcatacctggcaccttcactcctacaccctgagtcccagccaccttcctctctcaccttcattataggcagaatcagttacctggtccctctgccttcamctctgc

SEQ ID NO: 13549 - DNA, 197 bp, Homo sapiens
tgttcaggtgtagtatatccttgttgattgtgtgcccacttgtatcaattgtgggggagaggggattgaaatctgctgcagttgtggttctgtttctctttgcaattttaccactttttgctttatgtgttatgttagatacataaatgttcaaggttattacgtcctgttgattaattaaccactttgtaaaatgg

SEQ ID NO: 13550 - DNA, 172 bp, Homo sapiens
gtctcttgctggttcttcctcctcctctgctcaactatgaaatgttggaagttatcatagcccaactctccatctacaatctttgcttagataatatcgtatagtccaagactaggtttcatctataaattcataactgccaagtttatttcttcaccctgaactatacccc

SEQ ID NO: 13551 - DNA, 182 bp, Homo sapiens
  misc_feature 18: r=a or g
  misc_feature 146: r=a or g
agagctataatctccgaraggaagatttgtaatgcactgcgagttagaaatgtttttctcactgcagcttccttgtttcaaaaagagaatttttgacagcactgcaaaggcacaagaaaccaggcacagtataaaatatacaaatraaacaggtaccaaggaacttaaaacattcaacccat

SEQ ID NO: 13552 - DNA, 145 bp, Homo sapiens
aacgacttttgttagtgaatgcatttgacatttcaattggtgtcctggttaatattgaagtgaaattaacactttatggatagcagagtcctgtgttaagattttggaataataatattaatatttctgtttttgtaatggaact

SEQ ID NO: 13553 - DNA, 131 bp, Homo sapiens
  misc_feature 103: k=g or t
  misc_feature 105: w=a or t
tgttcgatatttccagttaaccacggaaattaacaggtagacttactattttgcattcttctgttcccggagcactgcataacagaaatctgtatttattttktwattggttagtcaattaaacttgcctg

SEQ ID NO: 13554 - DNA, 262 bp, Homo sapiens
gagtgtaacgcgtggcagcctgagggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggta

SEQ ID NO: 13555 - DNA, 195 bp, Homo sapiens
  misc_feature 98: w=a or t
agtgtcaagtttctgctgacctcttcagctattctggttgtcatttttttttctggcatcaataagcattttttccctttggataaatatcaagtttwttctgattctcaattcacattggcttgcaaattcagatgacactgaagaccaaattactgcctgtgggacaatggactttgtttagttgctaatagg

SEQ ID NO: 13556 - DNA, 149 bp, Homo sapiens
ttacctttacggaggtccagagatttaaattacttgactagtccctcagcgagtcaggagaagaggggttaaaacctgattcctccagttatatagtcatttaatgttcttggacttaccagtacttttgagtttttgtgttttttttt

SEQ ID NO: 13557 - DNA, 424 bp, Homo sapiens
  misc_feature 401: w=a or t
  misc_feature 402: n=a, g, c or t
  misc_feature 403: w=a or t
gcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattgcaaattgaagatgtccgtcagtatcctcttcctgaaaaagtaaacaggattataaaaaaactaaacctattttacgagcaaccaaattaaaagcagaagcaaagaaaacagcaataggcataaagttggccttgtacttgcagctatattggcactactactggctttctatgctttcwnwtatctcagactcaccacggat

SEQ ID NO: 13558 - DNA, 428 bp, Homo sapiens
  misc_feature 405: w=a or t
  misc_feature 406: n=a, g, c or t
  misc_feature 407: w=a or t
gcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattgcaaattgaagatgtccgtcagtatcctcttcctgaaaaagtaaacaggattataaaaaaactaaacctattttacgagcaaccaaattaaaagcagaagcaaagaaaacagcaataggcataaaggaagttggccttgtacttgcagctatattggcactactactggctttctatgctttcwnwtatctcagactcaccacggat

SEQ ID NO: 13559 - DNA, 271 bp, Homo sapiens
catatgcccttggctttctttgttgtcaagtctctgggagattgagggtacatattatttccttctgctttgtgtgcccttgcactgggacttggggaggggagtaagaagtattgtgttaaaatgttaatccctttcattggttgcccagttgtgagtactagccctctcagactgttggcatttggtatgcagggattagcattttatgttctcaagtatgctggtgtgatgcttattgtctattatttggccaaattagtcactaaag

SEQ ID NO: 13560 - DNA, 184 bp, Homo sapiens
catatatttcataaattatctgggtcccatgtggagagtggacaaagggagaggactgcaagcaaggtgccctgtgaggaggcctgcacaaaagtgaagaggcctgagctgaagtgagaaggtctgcgtgaaagtgatttgtgtgaaagatggtggtgtatccaactagagcaggagcagtggg

SEQ ID NO: 13561 - DNA, 357 bp, Homo sapiens
  misc_feature 143: n=a, g, c or t
agttatgcatcgtgagcgttacgctgtgaccggtggtatgtgtgcaacagagagaaattatgcgaatcactccaggctgtctttgttcagagttaccttgatcaaggaacacagatcttcttaaacaacagcattgagaaatncgggctggctatttatccaattatatcattcttttgtgtcatctgtttttagcctgtttatgtctagaacatctatcaatgggttgctaggaagaggctcaatgtttgtgttcaccagatcagtttcagagactgcttaaaattaatccagactggaaaacccacagacttcttgatttaggtgctggagatggagaagtcacaaaaatcatga

SEQ ID NO: 13562 - DNA, 577 bp, Homo sapiens
  misc_feature 364: w=a or t
  misc_feature 371: k=g or t
  misc_feature 372: k=g or t
  misc_feature 380: r=a or g
  misc_feature 382: r=a or g
  misc_feature 383: r=a or g
  misc_feature 402: w=a or t
  misc_feature 403: n=a, g, c or t
  misc_feature 404: w=a or t
  misc_feature 429: k=g or t
  misc_feature 430: s=g or c
  misc_feature 470: k=g or t
  misc_feature 471: k=g or t
  misc_feature 500: w=a or t
  misc_feature 501: k=g or t
ttttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattattwgtccttkkctcagtartrrttttaaagagcattttgtwnwattgtcacaatttggtaccactagksccaggtaaccattgggccaaaggatcagttgagaaacagkkaaggatgaattagcataagttatggaacwktgttagaaaacaactcaaaagtatattctttattaatgaggtggtcattattacatttgtgtcaatgaagggcagt

SEQ ID NO: 13563 - DNA, 269 bp, Homo sapiens
gtctgtgatagatatgaattaagaatcacctaaattatttttcagtcattttctctgttttaacacaatcttctttggcactccttctttaaagaaaaaaaaattgcgtttttgaagtaccttgcatttgtttcagctgtcacttggatgatcacattcatgagatctctaggaactccatcctgtatgtgtgtgacacatatagttgaggtatgctgccaggatttagtgaaggcctaactaaatgtggtttcctcaaattgacagga

SEQ ID NO: 13564 - DNA, 242 bp, Homo sapiens
gacccaggagtctgaggacaacgaggagcatgagatggaggaggacgaggctgattccgattatctggaggagctggaagacgacgacgacgccagttactgcacagaaagcagcttcaggagccatagtacctacagcagcactccagatgcaaataatacggcactccgaacagacactaaaaacagctctcatctcaaagaacccagtgcttgtatcacagtatgagaaattagatgct

SEQ ID NO: 13565 - DNA, 293 bp, Homo sapiens
  misc_feature 148: s=g or c
  misc_feature 262: s=g or c
agagcgggccgacggcattttgtgaagcggcgaaggaggtggtggctgcgttgggctccgggaagccgttcgggctggggctgtcggccgcggggcggaggcactcgcgcggggggtaattcggggtctgggttctggtgccgcgcastttccccgtctaaaagttggttttaattggttgcccacaggattgacttgacctctacttcttgttaaggaaattcatctcttgttttatcaggtgtgtgtggtttcagcgcasatggctgtggtcatccgtttgcaaggtctcc

SEQ ID NO: 13566 - DNA, 222 bp, Homo sapiens
gatttttcgcatggctgtgctccggctgacattgagatgaacttaccatccgctcttcagaggccgctgaaattccaagaatacgagaagtgcatgagcggattaaggagagaaagggaaattctatttgtgttggggaatggggaggtggcttttaactttaatgttttgattaaggatttttgattactcacaggctttctttgtagcctaaaccagcgg

SEQ ID NO: 13567 - DNA, 719 bp, Homo sapiens
  misc_feature 291: n=a, g, c or t
gttagttcactgcaaaccactagccagtatcttatcaggaatgtggaaaccactgtagatgaagatgttttacctggcaagttacctgaaactcctctcagagcagagccgccatcttcatataaggtaaatcaagtatttggtgttatcataagcattcatggttaagatgaagaaaatcgaccctagcatttaaaatggagtggaaatcctgaagaatggaactgtagagcattggtgataatggactcatcttggtcttaatgtgatatttttagtattcctattttnctcttcgagctttgtttaataatattgtagtcagatcatgattatcaaggtgctggatttcatttggttggaattataaattccacagttatttctcatatccagatttctgtgtttattctgtacccgctacctcgcatacacacatatgcattgtgccccaggatctttgcccagtgattcagctcaggtggttgagaatatacttcctagagtcagcctgcccaggcttgaaacctggttctgccgctgactagttgtgtgatcttgaacaaattttttctttttctttgagatggagtctcactctgtcacttaggctggagtgcagtggtgtgatctcggcttactcctccacctcctgggttcaagtgattctcccacctcagcctcctgagtagctgggattacaggcacacgctaccacg

SEQ ID NO: 13568 - DNA, 88 bp, Homo sapiens
tactcattgctttgtgcttatttgtatttgtgagttacattctctaccagattttaaattccttgagggtaggtacatatgttgttca

SEQ ID NO: 13569 - DNA, 192 bp, Homo sapiens
gattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctg

SEQ ID NO: 13570 - DNA, 475 bp, Homo sapiens
  misc_feature 244: y=c or t
actaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctytgaagctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaacctcgggggcctcatccctgccatctacatgttggtcttcctcctgggcacacg

SEQ ID NO: 13571 - DNA, 136 bp, Homo sapiens
agcagcttgcatgtttctctaagatcaagcccagcctcctggagctgtagcttaatcatgggttcaatgactttacagaaaaatggatagaaaaattcttcaactcctttctttggacccagatggttttttttgg

SEQ ID NO: 13572 - DNA, 408 bp, Homo sapiens
  misc_feature 327: k=g or t
  misc_feature 328: n=a, g, c or t
atttctatacgagctgatatgaagtaacgtttgtcagtagagggcgctggggagacactatcagaagaaggggcatttctttggggttcttgtgcttttcttcttgctcctgtgtttcttcttgctcctatggtgcacaccttttggtgagttttactggcaccccagcaagttgcttccagagagtttcaccagcattctagtgggaatgaagcacctcggtgaaattcttcaccatccagtgggccatggcacatctcgaatgcagcctgaatctcatcttcacagggtgtcctctttcaagtgagttccttccttgagtactcknctcagctttgaagatagtagttgctctctacacctgctattccaatgttctttagagatctccttacccttcttagtagt

SEQ ID NO: 13573 - DNA, 384 bp, Homo sapiens
cttcttccgacagcttgctgccctagaccagagttggtggctggacctcctgcgacttccgagttgcgatgctgtacttctctttgttttgggcggctcggatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctccaa

SEQ ID NO: 13574 - DNA, 366 bp, Homo sapiens
  misc_feature 119: k=g or t
gtggcgcagtgcgaagggacgcggtgcgcatgcgcgtgagggctgccgcggccaggcccagacatgtccgtccttgtaagttaaaagcttccatgggagccttccttcctaatcaagakgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctct

SEQ ID NO: 13575 - DNA, 441 bp, Homo sapiens
  misc_feature 134: r=a or g
  misc_feature 137: w=a or t
  misc_feature 399: n=a, g, c or t
caatgcaaggaaaggaaataaccccagcgaggtactcttcagggacacaggtctagtacgagagaactcttgacggctactaagttcagccagtcttaaaaaactgtgctgtttctacaaaactttaactaccrgtwagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaaatnattttggttgtttttccctttttttccttcttttcccacccc

SEQ ID NO: 13576 - DNA, 287 bp, Homo sapiens
tacaggttgtacctactgtgcttttatttcaaggtttttgtgtgactttagatattcacaagtttctctcctgttaattttctggttgtaaattgatgagatatctgcctggctacttcatgatattgaatgataatcaagtaaaataatttaattaaggctgggggccatggctcacgcctgtattccagcgctttgggaggctgaggagggcagatcacctgaggtcaggagtttgagaccaacttggccaacatggtaaaaccccatctcgactaaaaacacaa

SEQ ID NO: 13577 - DNA, 156 bp, Homo sapiens
aagcaactcgtgttcttccttcagacctcaaattgcagaagacctcttagggaggaaccgtcctcacttgttccgtactaaggctagatctgttgcttttgccacatttactatttaatgtttgttaagggatgatttgtctaagaatttgatgag

SEQ ID NO: 13578 - DNA, 415 bp, Homo sapiens
  misc_feature 109: s=g or c
  misc_feature 342: k=g or t
  misc_feature 360: y=c or t
  misc_feature 361: m=a or c
  misc_feature 375: y=c or t
agtctgcagaagtgagctgagcgtgtgcgcggtacggggctctcctgccttctgggctccaacgcagctctgtggctgaactgggtgctcatcacgggaactgctgggstatggaatacagatgtggcagctcaggtagccccaaattgcctggaagaatacatcatgtttttcgataagaagaaattgtaggatccagttttttttttaaccgccccgacggctggaaacccaaataactgtaaaagtacttttccttagacaaccacagtacttcaatatataacagaagtgttttttgagtacttcccattttatcacacaaaatattcaaaagccaaktactaaaaggtcaagatymaataaaattaattyttactgcttcatcaagaacattcttaaatgaaactttttt

SEQ ID NO: 13579 - DNA, 265 bp, Homo sapiens
  misc_feature 73: m=a or c
catggatgctggagtggagcacgatgacgtagcagagctgctgcaggagctacaaagcctggcccagtgctamcagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatg

SEQ ID NO: 13580 - DNA, 372 bp, Homo sapiens
  misc_feature 33: r=a or g
  misc_feature 257: s=g or c
  misc_feature 258: k=g or t
gcctgggcggcgcagacgaggcctgaggcggcrgcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccskgggggatggtgaggctgtgggtgccgacagcggcaccagcagcgctgtctccctgaagaaccgagcggccaggtgagcaccgctgcacttcctctccatctgatctctaacacc

SEQ ID NO: 13581 - DNA, 144 bp, Homo sapiens
  misc_feature 22: s=g or c
aacttttcagcggcaggcgaasggggctgaggaaaggagtgggtctaggcaggggaaattggggtgccaccagacggagacagcttggactaccagaatcaagcactcttttggaagagggtaatctctctccaaaaactgaga

SEQ ID NO: 13582 - DNA, 96 bp, Homo sapiens
aattcctcccagcgcacgccgccgcccgggccgcgctattccgaaattgggtccgccctagcgtggcccccggcctgctcctgcgctcttcgcgag

SEQ ID NO: 13583 - DNA, 178 bp, Homo sapiens
tttcaccatgttggccaggctggtctcaaactcctgacctcaagtgatccacttacttcagcctcccaaagtgctgggattacaggcatgagccaccgtgcccagctgggcaataaagattaacgggcgattttactccttatttgtagggtaaattgggtctgttagcaggagccgg

SEQ ID NO: 13584 - DNA, 272 bp, Homo sapiens
  misc_feature 14: r=a or g
tttttcctgtactrtttgtgtgtggattgcattcatcatgctcctctaccccataatacttttgtatttcctaagaacaaagataggtagatggccttagttggtattcgtattatagcagtggcatccaagcgcctctgcctttgtgtatgtgtgaaattgtcctgaagaatgcatttctggtgtattgacaggcctgagacaccccaacacaccttcacagtcctggagctagctttctccatcttggccccaggtatctaagaaagtcc

SEQ ID NO: 13585 - DNA, 317 bp, Homo sapiens
aatacaaattgttacagtttatgcaggccataaattattttttactttttggcaaattgttacaatttatggggtctacaatttatttttttattttctggcttaagttatctaggatttgtttctgtggtttacagtcaaagaacccaaagaccagatcactcttgactaccataaaaatgattaattataaagggatctacctgcctcggcctcccaaaatgctgggattacagacgtgggccaccgcacccagcctagatgtttatttccgattgttaccttatctactctgatcaaaacagtctcaccagcac

SEQ ID NO: 13586 - DNA, 127 bp, Homo sapiens
agaggagagcagaagtggcgttggtctggccggagcccttgggtgaaattgttaggcgtggagagggagtgatgtcttccagactcggtgctgtacccgccacttcgggacccacaacctttaagca

SEQ ID NO: 13587 - DNA, 164 bp, Homo sapiens
  misc_feature 130: w=a or t
cctgtggggttagaacatatcacattgcaacaccctaaattgtttttaatacattagcaatctattgggtcaactgacatccattgtatatactagtttctttcatgctatttttattttgttttttgcwtttttatcaaatgcagggcccctttctgatctca

SEQ ID NO: 13588 - DNA, 380 bp, Homo sapiens
  misc_feature 349: m=a or c
  misc_feature 352: n=a, g, c or t
  misc_feature 378: r=a or g
tctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaamgtngagataatttactgaagcgtctctgrca

SEQ ID NO: 13589 - DNA, 182 bp, Homo sapiens
acaaccctgaatccagaatctctgtttagtgggccaacattaataaatttagcctactccaactttgtgttacttccaccatggtgccacacacttaatatccattcccacatatattctccagatttctttctgtataaattgtgtgtgtgtgtgtgtgtgtgtgtgtgtagaaagagagc

SEQ ID NO: 13590 - DNA, 258 bp, Homo sapiens
gcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggt

SEQ ID NO: 13591 - DNA, 407 bp, Homo sapiens
ttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatatactattttcatagaatatatttctaatttacaaacactgaattattagcttgat

SEQ ID NO: 13592 - DNA, 111 bp, Homo sapiens
tttgtttttctgagttggtggggagggagggagggggagggctgaattgttttgcagaggaagatggcatctgtgctttaaatttctcattactgggttagaaaacaaagg

SEQ ID NO: 13593 - DNA, 168 bp, Homo sapiens
aaatgtatgcatttagtgctataaatttcccttcagcattgccttagctatgttccatatatttgcatatattgtagtttcatttttcattcagttcaatgtatttttttattttccttgagacttcctgtttggctcttaggtagtgtaaatttctgtttattcctg

SEQ ID NO: 13594 - DNA, 381 bp, Homo sapiens
aggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacctttcctaccatgaagatgtttgaatatgtcaggaatgaccgtgacggctggaatcctctgtgtgcatgaacttct

SEQ ID NO: 13595 - DNA, 169 bp, Homo sapiens
  misc_feature 138: w=a or t
  misc_feature 140: r=a or g
  misc_feature 147: r=a or g
  misc_feature 148: r=a or g
  misc_feature 151: r=a or g
cttgatatttttgcattagttaagacagaaatttgatagctcggttagaggggaggggaaatctgctgctagaaatgtctgaactaagtgccatactcgtctgggtaagatttgggaaacataacctctgtacataawaraaaaaarrtcrgttaaacatcacatagta

SEQ ID NO: 13596 - DNA, 201 bp, Homo sapiens
acattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactgg

SEQ ID NO: 13597 - DNA, 308 bp, Homo sapiens
  misc_feature 7: s=g or c
  misc_feature 9: s=g or c
  misc_feature 10: k=g or t
  misc_feature 35: w=a or t
  misc_feature 202: r=a or g
agcttcsaskcggctgcgggctggagcggcggcgwgcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccrgacatgagtggccccctagaaaggggctgatgggggaggggaccccaggcctggggaatcattttgtcctgggggcgtcccatcccctgggcccccacaagcaccg

SEQ ID NO: 13598 - DNA, 278 bp, Homo sapiens
  misc_feature 7: s=g or c
  misc_feature 57: k=g or t
  misc_feature 172: r=a or g
ctagaasaaatttggagtgtgcgtgcgcgccgagcggtactggctgtgatcgaactkctcaaccctcagagacttagatcttccacctcactccctcagccaagcctccaggccccctcgtgcatccgtggtggcctctctgccttctctgttctgttctccccatggcccrgacatgagtggccccctagaaaggggctgatgggggaggggaccccaggcctggggaatcattttgtcctgggggcgtcccatcccctgggcccccacaagcaccg

SEQ ID NO: 13599 - DNA, 257 bp, Homo sapiens
actgatcggtgaggcgcggccgaggggtcggctttcctcgcgagcctgcggctgggcttcttctcagaggaacgaggcggtctcctcacattactcaggcattctgctccatttctcttcttcagttatgttacagaagcaagggtattgcttctacatgggcaaatttgtctatgccctgaaagaaaccaagagtgaaactcaactgggaaagcatcagtttcactttattgtcactagcttcccaattttgccgg

SEQ ID NO: 13600 - DNA, 204 bp, Homo sapiens
actttcaattctagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctggg

SEQ ID NO: 13601 - DNA, 87 bp, Homo sapiens
aagaggaaaggaaaaaatcttgttgctctatagctaactttaacttcaattcttaaattttctgttacaattgtagcagaggttggc

SEQ ID NO: 13602 - DNA, 168 bp, Homo sapiens
ctcaatattctagttattcttgtttctcaatactgcatataatactactatgaatgtttttgcatagaaattttttctatattcttcttaggatagattcttagaaacatttttaagtctctgaaatgagagaactttccaaaagatttgcaccaattttcattccca

SEQ ID NO: 13603 - DNA, 86 bp, Homo sapiens
attagagtataatcatgtgtggtaggaagatggactagttaatcaagatttgttgtcacttaaattttttgtgatttttttccaag

SEQ ID NO: 13604 - DNA, 533 bp, Homo sapiens
  misc_feature 300: k=g or t
  misc_feature 483: n=a, g, c or t
  misc_feature 484: k=g or t
  misc_feature 485: k=g or t
gttgttttgggggattaaatataactgtaaacagtttacatgtttgatttttgagaacagaatggcttcatctttctttactctgcaaacatgccttcccttcccagctcccagccttcatgttatttgtgtcgatccacatccaactttctttaacggtaatgtggctaagccaaattttttttgtgctcccatactcatgcacttatgcccaagatttatataacaacatacccatgtttatatgtgtttgtataaaataagtctcataaaagtccccaagagaggaacctatttttkatctgaaaccatggctcaaaaaccatgcatttaacctatgctgtgctgcctttcaaagcgtgatgaagaaaacaacatcgggtaattgctgacgttatggacaccaggaattaaaaatattaccctagcttctgtctggctgagaaaagtgaagaagaacagtgggcatataaactgttgtankkcactaaaatgtttattccgccttcccaattcatttgtggaaatcctaa

SEQ ID NO: 13605 - DNA, 272 bp, Homo sapiens
  misc_feature 61: y=c or t
gtaacttccggttgctgtgctgagtcggaagtgggaacccttcggccgctgagattctgtygtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagccc

SEQ ID NO: 13606 - DNA, 407 bp, Homo sapiens
  misc_feature 195: r=a or g
ctccaaggcgctcttttggaggagggacttctctttcggtaaccagctcccttgcggatagtctatgttctccatataaacccagcacttcccttaattgagatacgtgggacttcactccgtccccagcccggaaccacaagtgagggcactgcgtttcctgattgacctctttggcgattacttccgcccagrggcctggaatactggaggcccttcgacggagaacaacaagaaaggcacttccggtgtctgttgccaggcgcgggcccagtgggcgtagggcgacattgttgccgtcgtctttccccccccagtcccggggatggagatgtcgggactcagcttttcagagatggaggctgccgtaacctacttggcctactggacaacgacgagatcatggc

SEQ ID NO: 13607 - DNA, 222 bp, Homo sapiens
aatatagccttgataacaacacagccacgcagactgaaggaggctgaagctgccatctgtaaaagatggagtctcgctctgtcgcccaggctggagtgcagtggcgcagtcacggctcactgcaacctccgcctcctggttcaagcgattctcgtgcctcagcctcctgagtagctgggattacaggcacgcatcaccacacctggctaatttttgtatttt

SEQ ID NO: 13608 - DNA, 448 bp, Homo sapiens
  misc_feature 326: w=a or t
ctaacttcaaatatgatgatacaggcaagttgaaatgaaaagggtgggaaaagatatatcatgcaaaccttagccaaaggaaagcaagactggctatattaatgccagatatagtatatttcagaacaaataaactaatcagagacagagagggagactatataatgtgcaaaggaccaatccaccaactcctcgcctgacaaattcataaatgtctacgcaagaacaactgaaagtacttaacagagaactagacaaatccacaaatacagctgtatgcttcaatgtccccctttctcaacaatttatacaacaaccagatagawaatcagcaagaatacagaagaacccaacaacacgatcaaccagcgggacttaaattggcaattttagaacacccaaccacaccagaatacacattgttatgggatgcaattgtgcccagcca

SEQ ID NO: 13609 - DNA, 275 bp, Homo sapiens
ctggatttcatatgatttctacatatcacaaaatagtcttattttgatttttttcaaccatttcaaaatgcaaatctattcttagcttgctctctgcacaaaaacaggcaatggactagaattggctcactgaccatagtcatgcctgtaagagttaaagaaagaagaaagaaacatgaaacgtggctttgtagtcaaagacaggttttctttacttaaaacctgagaggcttcccggctaatttcggttaggagcactttctcttacagaccca

SEQ ID NO: 13610 - DNA, 208 bp, Homo sapiens
tttttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagc

SEQ ID NO: 13611 - DNA, 321 bp, Homo sapiens
  misc_feature 14: k=g or t
ctcgggcggaagtkttccggcggctaccgggaagtcgctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagccca

SEQ ID NO: 13612 - DNA, 136 bp, Homo sapiens
  misc_feature 11: y=c or t
  misc_feature 120: w=a or t
  misc_feature 124: n=a, g, c or t
ttttttttttytgctaccgtgactaagatggaagcgtttttggggtcgcggtccggactttgggcggggggtccggccccaggacagttttaccgcattccccaaaaacgcttccatctwagtnacggtagcaaaa

SEQ ID NO: 13613 - DNA, 254 bp, Homo sapiens
tgatgtgagtattacaatatatatatgtgacttatagtcgattggtaacaacatttattactttgagtcaccttacttttatttaggtcactttacctttttcatttttaaatattgttgtcttaaatatcagacagtattatgatttttgttttaatcatcaagtatgatttgtaacactgattaataatgatgcttgaggagaagcataatttattatatgtagcccaaatttctactctattattcttccc

SEQ ID NO: 13614 - DNA, 375 bp, Homo sapiens
tttccgcggcggttggggtggtggggccccgggcggcgttgaccatgacccagcagggcgcggcgctgcagaactacaacaacgagctggtcaagtgcatagaggagctgtgccagaagcgggaggagctgtgccgggcagatccaggaggaggaggacgagaagcagcggctgcagaatgagatcctggagagctcccagactttgctcagcgttctcaagagggaagctgggaacctgaccaaggctacagccccagaccagaaaagtagcggcggcagggacagctgaccagaccacaggcagggcctgcctccgtgtgcccctcagctcagccccagcaagtgtgtgctcagagcatctttgttcttcacg

SEQ ID NO: 13615 - DNA, 180 bp, Homo sapiens
atgtaatacacttgacttaaaaagacaagccagcggcaattataaaataatgacacctaagaatgttttcaagaagtctggttcataatgcattcaaacttaaaaaaatattaaagacaactaaaaaaattttgctcatttttggagcaaaaaaactaccaaagaaggagcagcttgagg

SEQ ID NO: 13616 - DNA, 355 bp, Homo sapiens
ctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccc

SEQ ID NO: 13617 - DNA, 303 bp, Homo sapiens
  misc_feature 15: y=c or t
atcttgcggctgggyggggcccaggactgctgctgctgaccgccttgataggctacaccgtgaagaatgcgtggaagaacaacgtcttcttctcttggtcctatttttctgggtggctggccttacccttctcaattctcgcgggtaaactggacagcggggaagagggtggaggagactgcccagaagaccctcaccccagaggctccccagctgccctcccaggaaaccccggggacctctcggggactccccaacacactaacgactcccgcagacccggcagagacccccttggagccc

SEQ ID NO: 13618 - DNA, 290 bp, Homo sapiens
ttgggaccagaggctttatggggagggaagaactgttcttgactttcagtttttcgagcgggtttcaaggtaacaactttcttattatctagcttcataattgcagtaaggaatagctttttttgcttgcagctgagatgactttttcaagggagaaaaagggatttctataacgaagagagggagagagagatgaagagggagggagtaagggagagagggaagaagggagaaagagagagagatttgaatatacattgcttcaaggatgcaaaaaattacaacctgga

SEQ ID NO: 13619 - DNA, 277 bp, Homo sapiens
  misc_feature 16: y=c or t
acagagacctggagcyagggcagcaagaaggtgtctgttggagccagcagaacagaaccaatttgaacaagaacctccagaggaacgacgaaccctgagaacacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggat

SEQ ID NO: 13620 - DNA, 317 bp, Homo sapiens
aagcgcaaccgtcggtgggtcggggatcggtcgcctgagaggtatcacctcttctgggctcaagatggacaacaagaagcgcctggcctacgccatcatccagttcctgcatgaccagctccggcacggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgcgaggagg

SEQ ID NO: 13621 - DNA, 98 bp, Homo sapiens
aactcggctgctctgggggattcgtgcgcggtaccactgatgaaattatgaccaggtgggcccgagttagtaccacatataacaagagacccttgcct

SEQ ID NO: 13622 - DNA, 390 bp, Homo sapiens
attctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtgggcatcagggggttggagccttgtgaacagggaacctgccccccaacacttggaaggacctgggtttcagtgatgagacatggggtatgatgtaacccgtttccagggggatgttgacgaagatctta

SEQ ID NO: 13623 - DNA, 430 bp, Homo sapiens
  misc_feature 135: m=a or c
  misc_feature 142: s=g or c
  misc_feature 150: m=a or c
ggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaamtccttgscaaaagamcagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtcc

SEQ ID NO: 13624 - DNA, 368 bp, Homo sapiens
  misc_feature 9: r=a or g
  misc_feature 16: s=g or c
  misc_feature 27: s=g or c
gctgaccgrgcgcacsccgcccccggsgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtaagagcccacgtcctgggaggtctgttcctgccctggggggcttgggtgctccataggcagcaagagcaggcgtctgtcaggc

SEQ ID NO: 13625 - DNA, 130 bp, Homo sapiens
acccatccgctggctctcacccctcggagacgctcgcccgacagcatagtggtgatgggaaatgagacttgctctctggccttttcctattttcagcccatatttcatcgtgtaaaacgagaatccaccc

SEQ ID NO: 13626 - DNA, 169 bp, Homo sapiens
  misc_feature 32: r=a or g
  misc_feature 49: s=g or c
acccatccgctggctctcacccctcggagacrctcgcccgacagcatastacttgccgcccagccacgcccgcgcgccagccaccacaagagtttgggcaagaagggagaaaagtgacccagcaggaagaacttccaattcggttttgaatgctaaactggcgggaccc

SEQ ID NO: 13627 - DNA, 322 bp, Homo sapiens
  misc_feature 258: m=a or c
  misc_feature 289: k=g or t
  misc_feature 292: w=a or t
  misc_feature 308: m=a or c
gcaatcgcgtttccggagagacctggctgctgtgtcccgcggcttgcgctccgtagtggactccgcgggccttcggcagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacmccaaatttggcggaggggtggaaaatcagtkgtwaccattataaccctamagaggtggtgagca

SEQ ID NO: 13628 - DNA, 238 bp, Homo sapiens
ccaaggagccacatgtcacagtgccctgctgcctgaacaaggaccagaggcctgtggaacacatggctctcagatttctcccatttgatgactcatcagctgcccccacatggctttctagctcacagcagatctagccttctctgagcagtgaagatgggatgtttggtcattttccctggtgtggagagcccaagtggagttcttcagcacaccctacaccatcccctcactaaca

SEQ ID NO: 13629 - DNA, 314 bp, Homo sapiens
gcttgctgcgcgctgccggcgctccttcctcctcggctcgcgtctcactcagtgtaccttctagtcccgccatggccgctctcacccgggacccccagttccagcaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccg

SEQ ID NO: 13630 - DNA, 270 bp, Homo sapiens
  misc_feature 207: n=a, g, c or t
tgtgtgtactttgtcctgaggggaacaaggagccaaggaagaggctggactcttttggggagctagtctgcctctctgaacaaaccctgtgggagaaagacttgaaagcatcagttggagaaagggaaagtgaagagcaaatatctggctcaaaggaggggccaagaggccttagcacaatgacatttgtatcaagaactcctcaangatggccatggacacagtgggtactacttacccaaaggtggttttgaggggatggatacatgg

SEQ ID NO: 13631 - DNA, 283 bp, Homo sapiens
ggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagagggcctgaaggatggaactatcttatgcacactcatgaacaagctacagccgggctccgtccccaagatcaaccg

SEQ ID NO: 13632 - DNA, 193 bp, Homo sapiens
acatctttagtagagacgggcaatccacccgcctcggctcccagagtactgggatgacaggcgtgagcaccacgtccggccacaaaagagctttgatgcacacggtgacagccacatggtgcacccggaagaacaaggggcctgaagttagttagaccctccttgctggttctaccacagtcgcacgccccac

SEQ ID NO: 13633 - DNA, 286 bp, Homo sapiens
ctaatttttttcttctgttgtggatattcagttttcccaacattgtttattgaggagaccgtcctttctgcattgtgtgttcttggtacctttgtggaaaaccagttgactgtaaatgtgtggatttatttctgggctttctattctgttccattagtctatgtgtctttatggctttcaaatattgtgagacagaagaacacaggatacaccctcttcacacttgccattaatagcccagtgcagccagaatgaacaaggtgttacagaatgtgatgcaacaaca

SEQ ID NO: 13634 - DNA, 354 bp, Homo sapiens
  misc_feature 108: w=a or t
  misc_feature 113: n=a, g, c or t
  misc_feature 270: w=a or t
tagcttggaatgttctggcagggtaatgttgggcttaatagtgaggtggggagtggtaggttcagagtttatgtaaggcccaggccaggtgggattttatgctgtgcwggtcnttgtgtgattgacagcagcagggggctgaaggataagtgagggggaatcttccgaggtcataactgaataggtatttgtggcaacaagtggatgggggaaactgggaagtgaatgaaggggctgtgaggggagtgattgggcctctctggctcttgwtttgtttactatctgcttctcctcattaaagaggacatggaggttgtctgatttgttaattcattgctacacatctagtgccca

SEQ ID NO: 13635 - DNA, 193 bp, Homo sapiens
cgtgcctggcacacagggcatgctccatcctgaacataagacgtgtggatcttgtttgattctcacgtgaccccaataagtagatactataaggcccccacttttcagtgtggcccaagttgggccctgctgaaccctgttaccctccttaacaatcacccgtacacactgcttcctctgcctggaacccacc

SEQ ID NO: 13636 - DNA, 94 bp, Homo sapiens
  misc_feature 8: s=g or c
acattgastgagagtgacgtctccattgtctccaacaatcgcatgatatggagtggtcctcatgtgctttcatccttgtttgtctgttgctgcc

SEQ ID NO: 13637 - DNA, 357 bp, Homo sapiens
  misc_feature 178: s=g or c
  misc_feature 181: s=g or c
  misc_feature 189: r=a or g
  misc_feature 190: r=a or g
  misc_feature 220: r=a or g
  misc_feature 252: r=a or g
  misc_feature 274: k=g or t
  misc_feature 288: r=a or g
  misc_feature 298: s=g or c
  misc_feature 300: y=c or t
  misc_feature 312: y=c or t
  misc_feature 324: r=a or g
  misc_feature 350: n=a, g, c or t
ctcaacaatcttatcaggtaggaactatcatcatccccattttactgtaagaaatctaaggccccacttgggaggctgaggcagaagaatcgcttgaacctgggaggcagaggttgcagtgagctgagattgagccactgcactccagtctgggttacagatgacagagcaagactcsggstcaggggrraaaaaaagaaagaaaagaaaagaaatctgrgacccaaagagattaagtaatcttcccgaacraacggtggtaaagaggcaacaktggcccagaggttrggagcttgtscyctagagccacaytgccaggtttaratattgcctcagtaactccccatgtnacctcgg

SEQ ID NO: 13638 - DNA, 233 bp, Homo sapiens
  misc_feature 102: w=a or t
  misc_feature 190: w=a or t
  misc_feature 224: w=a or t
  misc_feature 225: r=a or g
aattgtccactaaggtctggcaggtctgattgcctcttttcaggcactgagtggtggggtatgccatcctcccctgctggaaccagccttggcctgccctgwtagtcatcaaaaatagatctcaccagggaacaatcttctcaggttgttgtgtaatttgagtgagccaaggaccagaggagcgagagcwgcaagaaccacacccagcagcaatgtcagcggawrtggaaacc

SEQ ID NO: 13639 - DNA, 196 bp, Homo sapiens
  misc_feature 96: k=g or t
ataacaatggttattgaaggaagaaaacctcaagctcaatgggagagagactatgattttatgcctttttatggtttgaattattgtgtctatgtktccatttttaaaaattcaggtattcacatataaaattcacacttctaaagtgtataattcagtggttttgaggttttcacaggatgtgcaactaacacct

SEQ ID NO: 13640 - DNA, 349 bp, Homo sapiens
  misc_feature 45: s=g or c
  misc_feature 149: m=a or c
taggggcccctacaagcggccacaaggatggcaggcttcgcggastcgggctgtcatcgtggctcgtggaacaatgtcggcagctgggtttgaagcagcccacgcccgtgcagctcggctgcatccccgccatcctggagggtcgaagmctgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggca

SEQ ID NO: 13641 - DNA, 352 bp, Homo sapiens
  misc_feature 35: s=g or c
  misc_feature 276: n=a, g, c or t
gtcgccttttggtgacgccagagagtgcgcgtcasagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcanggtaatcaaaatgttgggaaatggacgattggaagcattgtgttttgatggtgtaaagaggttatgccatatcaga

SEQ ID NO: 13642 - DNA, 422 bp, Homo sapiens
cacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaaca

SEQ ID NO: 13643 - DNA, 141 bp, Homo sapiens
aggactccgctccgcctacgctgcaggcggagagcaaccgccaagcttggtgggagtcaaggttttcacatcctttctatgagtttcgccatctatagcttttatcaacaattgtggtttaatcaattagagatattaacc

SEQ ID NO: 13644 - DNA, 173 bp, Homo sapiens
tagagatatagatgctagataaattttaaattatgaatataatattaaaatattattaaaaattgaagaaatagaaaacaagagcatccgtactcccactacatgaacacaataaacattgtttcctacattgacttatctgttctatacacagctgaaatacattttttttt

SEQ ID NO: 13645 - DNA, 439 bp, Homo sapiens
  misc_feature 155: k=g or t
  misc_feature 157: r=a or g
  misc_feature 192: n=a, g, c or t
  misc_feature 246: n=a, g, c or t
  misc_feature 247: n=a, g, c or t
  misc_feature 336: r=a or g
  misc_feature 337: r=a or g
  misc_feature 353: r=a or g
  misc_feature 371: n=a, g, c or t
  misc_feature 372: s=g or c
  misc_feature 399: n=a, g, c or t
  misc_feature 400: y=c or t
aaaccctgggcccaggcgggaaaggggggaggatgttgattgttggaacacacacctgtccaggtgcaggggagctggaggctctgtgagaggagggccagctcagccacagcaggaggactgacaggggcctgatggaggagtttgtggggctkcrtgaaggctcctcagggaaccctgtgactctgcagnagctgtggggcccctgtcccctcatccgccgaggcatccgaggtggcctggagnngctgaagcagaagctcttccgcctgggcgaggactggtacttcctgatgaccctcggggtgctcatggccctggtcagctgtgccatgrracttggctgttgagartgtggtccgagcgcaccnstggctgtacagggagattggggacagnyacctgctccggtatctctcctggactgtgtaccctgtgg

SEQ ID NO: 13646 - DNA, 391 bp, Homo sapiens
  misc_feature 265: s=g or c
aggtctccagccaccccgctcttcctgttctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggascaagatggggaatggaactgaggaagattataactttgtcttcaaggtggtgctgatcggcgaatcaggtgtggggaagaccaatctactctcccgattcacgcgcaatgagttcagccacgacag

SEQ ID NO: 13647 - DNA, 92 bp, Homo sapiens
tcacctgccccagggactcagaacacacatgactctccccacttgagctcaggatcccggcattacacggggcgcgctgagccccagatgtc

SEQ ID NO: 13648 - DNA, 209 bp, Homo sapiens
cttctgtttccctctgactaggccttcagctgacttctttgctggaattttctaatcttgtgacagcagggaaaagctggatgtggtccatctcttaacacagacactcctccctgtcttgaccagctacgtattccactgaccagcctcatcatctctgccctcaacagtggaaatgatctctttcccacagatgttctccctccctc

SEQ ID NO: 13649 - DNA, 220 bp, Homo sapiens
  misc_feature 33: s=g or c
aatctgtaaagtacagcgagaagaagaagtttsacctgcctgcacatctgtcgttgactctccatctgacttggagggactctgagggaccaacctgagcctgagaagaggcaagattccccttcaaggacacactgggaacttacggacctctttctccatggtgcagagcgcagaggtaattacataattgtctgttcaattactttactcaagagtc

SEQ ID NO: 13650 - DNA, 108 bp, Homo sapiens
cggtggtgctgtggtctgcccctggataacccagaagaacacagctgtgcgcgcccacaggctctgggggcgggagaagataagtcgcaaggagggggcgggacctac

SEQ ID NO: 13651 - DNA, 460 bp, Homo sapiens
ctgaaatctgtatcagctaagagtcctccaatcctggtcccattaactccaagtgcctttttgacagtgacaacagacagtccctcgctttttgttgttgttggtttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaa

SEQ ID NO: 13652 - DNA, 386 bp, Homo sapiens
caatataacacatattctccctgaacttggcataggtctatagaccctttaggaaagtaaatttggagctagactgtttttttagactttagagatgatacagactatgtaactatgtccttccttctttttaaaagtttaatttaacctaaagatagggtctcatgctgtcacccaggttggagtgcagtgatgagatcatagctcacttgtaaacctcgaactcctctactccagcagtcctcccactgtacccttttgagtagctgggactataggtgcatgccaccatgagcaactaattttttatgttttgtagaaatggagtctcgctttgttgcccaggctgatctcgaactcttgggcacaagtgatcctcccatagg

SEQ ID NO: 13653 - DNA, 524 bp, Homo sapiens
  misc_feature 142: r=a or g
  misc_feature 149: k=g or t
  misc_feature 152: m=a or c
  misc_feature 418: k=g or t
  misc_feature 427: w=a or t
  misc_feature 481: y=c or t
ccttgattacaaaaagaagaaacacgtattcaagctaagactaaatgatggcaatgagtacctcttccaagccaaagacgatgaggaaatgaacacatggatccaggctatctcttccgccatctcctctgataaacacgargtgtcckgcmagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgattttkttttttttwaatttatagagcatttcggggggggtgggggaaacacacctaaacactttatcyccaagttacaaaagtttgaggtgcagagggaaggccagatttt

SEQ ID NO: 13654 - DNA, 366 bp, Homo sapiens
ttttttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtatctctggaaccccttttggcttaggtttatgggctgtgagttggttggaataaggggaatgattgggctcttggattctcaacctcaggttgatagagaagaagagagaaagatgtcacagatgacagagac

SEQ ID NO: 13655 - DNA, 335 bp, Homo sapiens
  misc_feature 288: n=a, g, c or t
  misc_feature 289: n=a, g, c or t
  misc_feature 290: k=g or t
  misc_feature 291: r=a or g
  misc_feature 316: b=c or g or t
  misc_feature 317: n=a, g, c or t
  misc_feature 318: n=a, g, c or t
  misc_feature 319: s=g or c
ttttttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgannkragcaactgatggttcccccattcabnnsagtgtccagttccaag

SEQ ID NO: 13656 - DNA, 409 bp, Homo sapiens
  misc_feature 362: n=a, g, c or t
ttttttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaagccagctacctgcccaaaccaggagctcagctctaccagttccgatatgtgaaccgccaggccaggtgtgtgggcagagccccctttccagttccgagagccaaggcccatggatgaactggtgacctggangaggctgatgggggctctgacatcctgctggttgtccccaaggcaac

SEQ ID NO: 13657 - DNA, 220 bp, Homo sapiens
  misc_feature 103: w=a or t
  misc_feature 108: w=a or t
  misc_feature 109: w=a or t
  misc_feature 127: r=a or g
  misc_feature 128: w=a or t
  misc_feature 141: k=g or t
ttcgtggagcgcctccgggctcggatcgctgtctgccgccaacaccacctgagctgtgaaggacgatatgaacgaggtagggccgagagctcagaccgggaawgagawwgcaccttgcagctccttrwgcccttgttacakcattggccagggggcaaggaaagctggcaaacacaccaaggccaccgccactgctgccaccactacagcccctccaccg

SEQ ID NO: 13658 - DNA, 486 bp, Homo sapiens
  misc_feature 115: k=g or t
  misc_feature 118: r=a or g
ttttatttttatattatgagttgtcaatcttaaaaatatgagtaattctacatgtagtagaggtgtatgaagatcatataacaattaaacataagccagaaattaaaatgactakagrcagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaaggagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtact

SEQ ID NO: 13659 - DNA, 491 bp, Homo sapiens
aaccagaaaaacagggacatcaaccagcaaagatgcatcctcatttaatagagcttgaaattactataatctgtaaagtacagcgagaagaagaagtttcacctgcctgcacatctgtcgttgactctccatctgacttggagggactctgagggaccaacctgagcctgagaagaggcaagattccccttcaaggacacactgggaacttacggacctctttctccatggtgcagagcgcagaggtgaacaaacagacgcataatagctcttgagcttgccattgggaagtgaaaatcaactgcttgaataaatgtaaggactcaggtagacatcaccttgtgactcaacagcagccaataagatggaaataaaggccatgaagttatcggatggcatctacaaggaatacttagatgaggaggtgactctggtagcaatggttcttttgtctttctcaccttccttcttgtcctgtctgggatgctgaa

SEQ ID NO: 13660 - DNA, 418 bp, Homo sapiens
tggccaggatgatcttgatctcttgacctcatgatccacctgctttggcctcccaaaacgctgggattacaggggtgagccaccgtgcccagcctagactatttttttagagtagttttaggttcacagaaacattgaacagcaaagtatagagagtttccattacgcccaacacccacacactctcaggtttctccactatcaaagtcatataccaatgtggttcatttgttataaccaatgaacctacattgacacatcattatcacccaaagttcatagtttgcattagggtttgctcttggtgctgtacattcaatgggttttgacaaatgtataatgccatgtatccacccttatactgtagtgtcatacggactaatttcactgaccatctattcatcctttcccctccaca

SEQ ID NO: 13661 - DNA, 415 bp, Homo sapiens
  misc_feature 164: s=g or c
  misc_feature 324: n=a, g, c or t
  misc_feature 397: n=a, g, c or t
  misc_feature 398: n=a, g, c or t
aactctttatcaatcgtcttccggcgcagcccgtccctgttttttgtgctcctccgagctcgctgttcgtccgggttttttacgttttaatttccaggacttgaactgccatgtcctctgaagaaggaaagctcttcgtgggagggctcaactttaacaccgasgagcaggcactggaagaccacttcagcagtttcggacctatctctgaggtggtcgttgtcaaggaccgggagactcagcggtccagtacagcagtgatccaactgcccgggagagggaacgggaagcccgtgaacgagacctccgtgaccgcctcaagcntggctttgaggtgaagcctagtgagctggaacccctacatggggtccctgggccgggcttggatccctttccnngacatgggggcctggct

SEQ ID NO: 13662 - DNA, 364 bp, Homo sapiens
  misc_feature 29: s=g or c
  misc_feature 36: n=a, g, c or t
  misc_feature 37: n=a, g, c or t
  misc_feature 239: k=g or t
  misc_feature 252: n=a, g, c or t
  misc_feature 257: y=c or t
  misc_feature 270: w=a or t
  misc_feature 271: k=g or t
  misc_feature 292: k=g or t
  misc_feature 305: r=a or g
aactctttatcaatcgtcttccggcgcascccgtcnntgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtctctggatggtcgtcagatccgtgkggatcatgcaggnaagtytgctcggggaacwkaggaggtggctttggggccakgggcgtggtcgcrgctactctagaggtggtggggacagggctatgggagtggcaggtattatgacagtcgaa

SEQ ID NO: 13663 - DNA, 199 bp, Homo sapiens
  misc_feature 159: r=a or g
gtgtgtgtgtgtttgctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttgrtgaagaccttggactctcaactcgtacctttattgtggag

SEQ ID NO: 13664 - DNA, 205 bp, Homo sapiens
aatccccgcaccaagcgcttaacctcattggggtggaggagaaggcggcggctctctggtccgcagcggcaacagtaacgaaaaacagggctaatggactgctgaattattgaagtatttcagacccagtagtagaacatcactctgccactcactcctttatctcctactagttatttaaattggacttttaatatcctaccag

SEQ ID NO: 13665 - DNA, 121 bp, Homo sapiens
agagcctcagcttcgctgctgggcagttggctggaggggctgctgctgggaacacctggagtctccgcgggcagatctcatattttggattctggatatattataatgagtgacactttga

SEQ ID NO: 13666 - DNA, 369 bp, Homo sapiens
  misc_feature 29: k=g or t
  misc_feature 30: n=a, g, c or t
  misc_feature 32: k=g or t
  misc_feature 196: r=a or g
  misc_feature 300: n=a, g, c or t
aagagtcgagagtgggagaagagcggackngkgagcagtactgcggcctcctctcctctcctaacctcgctctcgcggcctacctttacccgcccgcctgctcggcgaccagaacaccttccaccatgaccacctcagcaagttcccacttaaataaaaggcatcaagcaggtgtacatgtccctgcctcagggtragaaagtccaggccatgtatatctggatcgatggtactggaagaaggactgcgctgcaagacccggaccctggacagtgagcccaagtgtgtggaagagttgcntgagtggaatttcgatggctccagtactttacagtctgagggttccaaacagtgacatgtatctcgtgc

SEQ ID NO: 13667 - DNA, 470 bp, Homo sapiens
  misc_feature 261: k=g or t
  misc_feature 351: w=a or t
  misc_feature 360: n=a, g, c or t
  misc_feature 378: s=g or c
  misc_feature 406: m=a or c
  misc_feature 407: k=g or t
  misc_feature 408: k=g or t
  misc_feature 430: m=a or c
  misc_feature 441: n=a, g, c or t
  misc_feature 442: n=a, g, c or t
  misc_feature 456: y=c or t
acaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagakgcaacgcaatgaactgttatttactgctgcgttttatgttgggaattcctctcctatggccttgtcttggagcaacagaaaactctcaawacaaagaangtcaaagcagccagtgcsatctcatttgagagtgaagcgtggcttmkktgtggaaccaattttttgtacmagaggaaatgnntacgactagtcatyacatcgcccagcgg

SEQ ID NO: 13668 - DNA, 422 bp, Homo sapiens
tagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggaagtttgtgtttttcaacatacctcagattcaatacaaaaacccttgggtgcagatcatgatgtttaagaacatgacgccgtcacccttcctgcgattctacttaagattctggggagcaggtcctggtggatgtggagaccaagagcaataaggagatcatggagcacat

SEQ ID NO: 13669 - DNA, 251 bp, Homo sapiens
ataacaagaagccacgcggaaggtgttaaagcacagagtgacactccctcttcctttctaccttcttggtgtttttctcaagaggaaacaaaggcagaataaggagtagcgcaaatcctctcctcgtcttacgcatcagcagtgaacacgtccttggcgtctcacctcctacctcctgaggcatagcaacaaacaccatgacacagcaacaaacatcatggcacatcattttccagtttttctcaatagtg

SEQ ID NO: 13670 - DNA, 138 bp, Homo sapiens
cataacactaaccttcgggctgggagccaagagttctgggccaacggtacccagagtcccatggggcttaactttgattcacaagaactgtatgattcctttcctgaccagaattttgaggtgatgcccaatggaccc

SEQ ID NO: 13671 - DNA, 228 bp, Homo sapiens
atttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagagaggagctctcagcatggcggctcctctacgtcacttgcgtc

SEQ ID NO: 13672 - DNA, 208 bp, Homo sapiens
tatggatcttttttactaacactatttcacatctgcttctccttaaatccaaagacttgattttatttattcatttaccataatgttcttatttcttattgttagacattgaggttgtttctaactttttaccattttattttactttattttattttattttattttattttattttatttttgaggcacggtctcgctctgtcacg

SEQ ID NO: 13673 - DNA, 225 bp, Homo sapiens
aacactctgggtccatcttcaagacactgggctgtggatcaacccaaccaccactcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagcc

SEQ ID NO: 13674 - DNA, 713 bp, Homo sapiens
  misc_feature 17: r=a or g
  misc_feature 18: r=a or g
  misc_feature 427: k=g or t
  misc_feature 435: n=a, g, c or t
  misc_feature 708: m=a or c
caacaaagaatatctarraattataaccgattctaagtatatactttaagaaattcaggtttgactgtatctacttcataaatttatcattatctttttataactattagaaccagagttagaaagaagcagtttggctaatataaaaattatgtggattctgttagagtagttcagcttccttaaaataagcatatatcaactaacaaactaaatataaaagctaaacaagtgaaactgaagcagatttattgtaagatttggaagagtgcaggatgtttatcatagcacattattaatatttattattcttcctatgtagataagtaatgtcctagatttataccatagaaaaacaggtagagacgtttagctgtgagtgtacaagtataaatcaattaagtgccagattttgatcatcaccagktgctcatncaagtcctatgttgcaaagttactcttacccttttttacattacttgataaaggcaatgtttaattacatatttcctgttaactagctggtagagtacatacgtaaagtcagtaaataatgttacaaattttttccagctgagtaagtgaatatgtatctagttgtaagaaatcaagaagaggataaaaaatataatcaggatgtggactctaaaacggaataaactctatgtcctgtaacttttctcacttgtaataatacagcattctcamcctgt

SEQ ID NO: 13675 - DNA, 233 bp, Homo sapiens
tcatttggggaggacgtgcagaaggagaacactgagagaggcgtctggacagaggcctagagctggggcgggtaaggctgcaggacaggatgggaacagggttactgctggcagggacagcctgcacttcctcagtaatgccaacttgatggagcattccactgtctaccacagctagccggccactgggcagagggctgccacccatggagaggagatgtagcagaggctgg

SEQ ID NO: 13676 - DNA, 129 bp, Homo sapiens
taacttgttaatttttatgaacattgttttgtgttatacgactgtaagagccactctttgtttaatgctaatttggggttaacactgaggcatgcactttccatatattatcccatttaatcctcacaa

SEQ ID NO: 13677 - DNA, 123 bp, Homo sapiens
cagttttggtaatttgtgtttttctagaaatttgtctacctcatctagcttttctatttgttggcatgtaattgttcatagtgttatattcctttttaacttctgtaacactgatagtaagtc

SEQ ID NO: 13678 - DNA, 187 bp, Homo sapiens
cctagtacgttaactcaggcattctgatgactaatacacctaacactgcattgtagcatatgaatctggtgaatgtggcataggagaatagattcattcagttaatatttgagtcaattcttgaagaccttctgtattttaagcatttgggttaggcactgtggatatgaagatgaaaaaaatcagg

SEQ ID NO: 13679 - DNA, 381 bp, Homo sapiens
  misc_feature 200: r=a or g
tgaatatcacctctgttctaggaacactggttctcaattaacttaactaccatgtttcattatacgggaacactacattttttatcagttttacaattaatggacattttgttttttcttgtgcgtttgctatttattttttattgaaaagttttttttagacacagtcttgctttgtcacccaggttggagcgcagtgrtgcgatctcggctcactgcagcctccgcctccccagttcaagtgattcttgtgcctcagcctccccagtagctgggattacaggtgcacgccaccatgcccaactaatttttgtatttttagtagaaatggggtttcaccttgttggccagactggcctctcaaactcctgacctcgagtg

SEQ ID NO: 13680 - DNA, 123 bp, Homo sapiens
aattaggctcatgaactaacaaatcgtttgcacaacttgtgaagaagcgaacacttccatggattgtccttggacttagggcgccctgcccgccttttgcagaggagaaaaaacttttttttt

SEQ ID NO: 13681 - DNA, 215 bp, Homo sapiens
tatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgt

SEQ ID NO: 13682 - DNA, 215 bp, Homo sapiens
cattatattcaaagattccaaggattaacgcatcacatatcttttagaaaaaaactattcggcctactaaactcgatgagtcttcatctactgagactcaggccgagtcagataaaaagctttacaatattccacacctctctctacacgtgttaaaaacaaggagaaagagtttctcttaaaattttaagttcactaaaaatagaacaaaagca

SEQ ID NO: 13683 - DNA, 294 bp, Homo sapiens
cagtctctttcgtgccatctaccttcgaaggaaggaacacttttagagttacaatgatgaggagaggagcgggacaatactcaatcctataccaagtcaattgagattagtttcctactgggagtaagtgcctggccctgctactcctatttgaatgctattaatattacctagccttttacaaaggatactttgtaaatgtctgctgttggaacttgatgttaatccattttggtcatagccatattagagagatttgcacagaatgtaaaggcaaaagcataggaaacacct

SEQ ID NO: 13684 - DNA, 540 bp, Homo sapiens
  misc_feature 122: r=a or g
  misc_feature 124: r=a or g
  misc_feature 126: m=a or c
  misc_feature 129: s=g or c
  misc_feature 133: s=g or c
  misc_feature 329: r=a or g
  misc_feature 330: s=g or c
  misc_feature 331: s=g or c
aagcgagatttgaagatcaccgatgtcatcatggccttccaggcgatgtgtcgtggctacttggccagaaaggcttttgccaagaggcagcagcagctgaccgccatgaaggtgattcagargramtgsggcsgcctacctcaagctgcggaactggcagtggtggaggcttttcaccaaagtgaagccactgctgcaggtgacacggcaggaggaggagatgcaggccaaggaggatgaactgcagaagaccaaggagcggcagagaaggcagagaatgagcttaaggagctggaacagaagcactcgcagctgaccgaggagaagarsstgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggag

SEQ ID NO: 13685 - DNA, 216 bp, Homo sapiens
  misc_feature 96: n=a, g, c or t
  misc_feature 156: n=a, g, c or t
  misc_feature 157: n=a, g, c or t
  misc_feature 160: w=a or t
  misc_feature 185: n=a, g, c or t
aggtaaggcctggggacatgtggagtcagccaagtcccctggctatgctggaaagtcagaccttatctgcacttctgactggtgtctgttctaggntccacacctgatgtcaaattccagcagaacagctgatgctaaccagtttgaagacccccnnagwggaacagaatcagcatgagaatacngcttcttcttcaacctgtcccatgacttcac

SEQ ID NO: 13686 - DNA, 151 bp, Homo sapiens
aatccgaggcctttgccggcctgtgggccaccagctgggggctccccgcttccatccacctaccacacccacattcctgacccctcccgccgtctgttgctgtggaacagactcacagagccgcacccacttcccaagacccagccccatc

SEQ ID NO: 13687 - DNA, 331 bp, Homo sapiens
  misc_feature 118: n=a, g, c or t
aattgatatcaggcaggacaggaactgactgcgtgaactgaactaacagactggagtgatctttttgatgttttgctcggaatattgttggtcctttgtttgcttttcagagtcaaangaggcttttcttttgagctatcaacagcttttgacagtttggtgtgctcccatgaacaaaatttgaggcatgcttatttctctctgcctggttttctcccgagtctggaaactacctctggagatcactaaaacctaagctgtgctttcttgaagccctgtgagctgaaaattagatgtttcagtgggcgctgcctctgggcctctgaggcag

SEQ ID NO: 13688 - DNA, 310 bp, Homo sapiens
  misc_feature 126: s=g or c
  misc_feature 127: s=g or c
  misc_feature 261: m=a or c
  misc_feature 264: y=c or t
  misc_feature 268: r=a or g
  misc_feature 270: r=a or g
  misc_feature 274: w=a or t
  misc_feature 294: m=a or c
tacttgcccttctcaaacatggccgccacggcgcctctggaagggaaccgctctgggccccgcctttgatctcgttggtggggctgggggatgagagctgcaccgcgcgggacaagtcgccggcgsscccgacggagcagaagagagagaaagagagagagctagctgtgggattctgtgtagttcttcactatctgttccagggctagtcggaggatcataagcaagctcagacctgcccccagttcagtacttgaccamatyccargrattwaatggtgtctgtctatggcmacagccaaccagaatg

SEQ ID NO: 13689 - DNA, 265 bp, Homo sapiens
  misc_feature 127: s=g or c
tacttgcccttctcaaacatggccgccacggcgcctctggaagggaaccgctctgggccccgcctttgatctcgttggtggggctgggggatgagagctgcaccgcgcgggacaagtcgccggcggscccgacggagcaggtaaaatgtggataatacggccgggcgcggtggttcatgcctgtaatcccagcactttgggagaccgaggcgggtggattgcctgaggtcaggagttcgagaccagtctggccaacatggtgaaa

SEQ ID NO: 13690 - DNA, 227 bp, Homo sapiens
ataaaaggaactagtctcggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagaga

SEQ ID NO: 13691 - DNA, 214 bp, Homo sapiens
  misc_feature 172: n=a, g, c or t
  misc_feature 173: n=a, g, c or t
gtttagcctgtggtgggcgctgcgggtgtttgcaggaggttgcagtactcgctgggctgaggtcgtctcgggtgaggaggtcgcgccggaagtggctctagccgtggcgcctcggcgtagtaaggagcctgcaacagagttttgttgtttagggggcgcggcaccgcaccgnncccttcaccttgcagcagccatggcgaaaggcagagtcgcc

SEQ ID NO: 13692 - DNA, 313 bp, Homo sapiens
  misc_feature 291: s=g or c
cgtgatccaccgcgcccggccggcttcttaaataagtcgactttgggtggactgaatctaactctgccgtctcttacaaggtcctagcacacccaggacagaccaagccctcagaacaggcccctttttggtgtttatagcatctgcactaatctagagaaatggtgggtcaggctaagctactgatgctgctgctaattgactcaattgctaattgagtcccggcttttcaacagatagaatgtgttttagctacactgtatagaaggtttcattttggttgtgtgtgtsttgattctctttgggctctggt

SEQ ID NO: 13693 - DNA, 164 bp, Homo sapiens
  misc_feature 159: n=a, g, c or t
atatcttttacatctggacttcagtaagccagtcttatttgcacagtgacccagaattcctaataaaatattatttatgtattatttaaaatactacagatttttaaactttgaaatgtgatatattggaaaaacagtaaatgggaagagctgtgatanaacca

SEQ ID NO: 13694 - DNA, 134 bp, Homo sapiens
  misc_feature 10: r=a or g
catattaggrgttctaagacatctttttaaatagattgatttttaaaggtggaaataaaggttcagggtctgacaatacaacagatatcagagattttgttggagttttcaccatgcactgataagtctaggtc

SEQ ID NO: 13695 - DNA, 355 bp, Homo sapiens
  misc_feature 37: n=a, g, c or t
  misc_feature 179: k=g or t
  misc_feature 201: s=g or c
  misc_feature 274: s=g or c
  misc_feature 275: n=a, g, c or t
  misc_feature 344: s=g or c
aacagatccaggctgtctcttgcggtgcgcatgcacntaccgtatcgttatcaacgtctccgaggcagattgcgtgcgggaagaggctcccgctgaactccagcgccacgcgtgcacgtagctaactgacctcatggcacctccaagagcagagggagcggagaggcccagtaaatatkccctgaacccccgtcgcgacasccgccagagcggaaggccacctaaggcagcaagttacgtcactgcctgaacctccaatctctgcctcttcctsntttaaccttacagaggaggcgggtcttccgggcttggaggcgggcttcccaacttctgatcaagacttsgtttgaaaaag

SEQ ID NO: 13696 - DNA, 190 bp, Homo sapiens
  misc_feature 13: s=g or c
  misc_feature 43: r=a or g
  misc_feature 45: s=g or c
  misc_feature 48: r=a or g
agaatctgcggasctgcgggacggcggtggtggcgccgtagarcsggracagtgttgtacagtgttttgggcatgcacgtgatactcacacagtggcttctgctcaccaacagatgaagacagatgcaccaacgaggctgatgggaaccatcctgtagaggtccatctgcgttcagacccagacgatgcc

SEQ ID NO: 13697 - DNA, 188 bp, Homo sapiens
attataattgatcctaagtgcaatcattatattgaatgtgctgtgtgtatttgtaggagctgtatttttcttaacagatgctgtctgttagccttttctttatcttacagtttaaatttcaagcatttattagagtaactgcatgaatgtttacacacacataccctggcctaagatttttttttttt

SEQ ID NO: 13698 - DNA, 117 bp, Homo sapiens
aaattgttttttgtcttttgttgttcagagaacgaccagagtattttctccccagtgtgtcccaacagattcttaggcaataatttttcttgttgatgatcccgtgctcagtagcac

SEQ ID NO: 13699 - DNA, 132 bp, Homo sapiens
  misc_feature 40: m=a or c
ctcttcgccggcgcgcgccctcgcagtcaccgccacccamcagctccggcaccaacagcagcgccgctgccaccgcccaccttctgccgccgccaccacagccaccttctcctcctccgctgtcctctccgt

SEQ ID NO: 13700 - DNA, 373 bp, Homo sapiens
aggtaagagatggcatggaacatgcgcaatgtccagaaaatgtatgcagagccacgaagctgcaggagtggggagaccggattgggctgacgcagcagagtagggatttccttgcagtggaaggattaagcaaagaaggagacccccagtgttcattcattctgttgcccttcagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcg

SEQ ID NO: 13701 - DNA, 143 bp, Homo sapiens
ctaatttttatcagtctggtataaagtattgatctaagagaactctccctgtgccccttggtctttattctcaattaagaaaaacagtcacatgtcacgacaaaccaatcaatctttatgagatattcctgtatccatacccc

SEQ ID NO: 13702 - DNA, 169 bp, Homo sapiens
cagctttggttacctcataaataaaacatgatatatacttaccttgtaaggtaggctgttgagaagattaaatgagaaaacatataggaaacagcattctgaaatgtaaagtgccatacaagcgtttattacaagaaattttaaactaacaaagataacaataggaggc

SEQ ID NO: 13703 - DNA, 299 bp, Homo sapiens
  misc_feature 190: m=a or c
  misc_feature 213: n=a, g, c or t
  misc_feature 219: m=a or c
  misc_feature 262: y=c or t
  misc_feature 279: y=c or t
aaaaattcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggatgcgagaacaggtagamaccttggtttagatcatgacttntggggmagattgtgtgcttttgaaaagacagccagggaattggattatyatcctgtctctgattcytgaccacctgtgagagttgg

SEQ ID NO: 13704 - DNA, 134 bp, Homo sapiens
tttgtttatccaacagccatccatgggtaccccaagggccagctctgttctaggcactgggggtctaggcatgggctcaggagaaggggtagaacgggagggcttcctggaggaaggcttcctaaccagagacc

SEQ ID NO: 13705 - DNA, 232 bp, Homo sapiens
gagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcg

SEQ ID NO: 13706 - DNA, 109 bp, Homo sapiens
aggttagagcttgtttgagggattaaagaatgttggcatggtcggtgttaaggataaacagtgaaagcgtaccctgtgcttcaacagcctgcctgctcacttcctgaat

SEQ ID NO: 13707 - DNA, 351 bp, Homo sapiens
ccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagca

SEQ ID NO: 13708 - DNA, 214 bp, Homo sapiens
agcggggcgtcacctcggacatacgacagcgggcggtgttcccggctccgtggggccgtcttcccggcgagtccgcgacggtcgccgcccacggcgaggtacgaggttttaaaaagtttttaatttggaaggcagggtgcggtggctcacgcctcggcctcccagagtgctgggatttacaggcatgagccaccgcgcccggcctgtttttttt

SEQ ID NO: 13709 - DNA, 414 bp, Homo sapiens
  misc_feature 293: n=a, g, c or t
tttgtgtgtgttacagctcttttagcctcgacattcagcaggtcccaagttcttgtcctgcgacttggaagcatgatatatgcagacaagtggagggtgagcaagatgaagagaagatttattgagcaatagaacagctcagaggagacccccagtgggcagcttgtctccatagccaaggtgtcccatcaagtgtccagctctcagcagagagggtggttcctctttgcagcaacttgtcccatcatttccttagttctcaacagagaggagaccctgggatgggcagctcnctctgtagcttgtcatcccgtcatctccccattgtctctctatcctctgctcaagtctggctgagtcctgggtttttatgagcctcagaggaagtgtatgctgattggtccatgggtgaca

SEQ ID NO: 13710 - DNA, 303 bp, Homo sapiens
ctctctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcccaagtgaaaaacagtctctacaatgctgc

SEQ ID NO: 13711 - DNA, 398 bp, Homo sapiens
  misc_feature 55: r=a or g
  misc_feature 269: n=a, g, c or t
  misc_feature 270: w=a or t
  misc_feature 279: r=a or g
  misc_feature 328: n=a, g, c or t
agaggctgaggtaggagtggagagagaaagggagcagggcctaggaggtcctgargtgcaggctggccgctgaaggttcaggatcttcccccacgcggcaggacatccgccaaggttcccagatctgagacggcgcacctcctgcgtgtccttgacggcaggtggtgcgccgtctcagatgctttggggaatctttaacagctgaatttgagtcagtcctcttaggctgcacctccagcctctgcagatcccccctcatttcccatggnwtggttgggrccccattattctctcatctcggcattcagggaacagtttccttagcggnccctggtcacatgtcatcgggctgggcaggaagcgtccctgggtgcgtgctccacttctccctctcagga

SEQ ID NO: 13712 - DNA, 222 bp, Homo sapiens
  misc_feature 101: n=a, g, c or t
ctttgttcttggttttgtttctcgatcttttgtttggagaacagctggctaaggatgactctaagtgtactgtttgcatttccaatttggttaaagtattngaatttaaatattttctttttagctttgaaaatattttgggtgatactttcattttgcacatcatgcacatcatggtattcaggggctagagtgatttttttccagattatctaaagttgg

SEQ ID NO: 13713 - DNA, 128 bp, Homo sapiens
agaacaggaagcggaggcataagcagagaggattctggaaaggtctctttgttttcttatccacagagaaagaaagaaaaaaaattgtaactaatttgtaaacctctgtggtcaaaaaaaaaaaaaaa

SEQ ID NO: 13714 - DNA, 215 bp, Homo sapiens
  misc_feature 61: y=c or t
aaaactgggcttgggaacaggaaggctttgcccgtttatttggattctcagggtagtcgaytttgccacctcttggctatcagctgccttggagattggtttcatagtaaggattctttctttaaggtgatatggagcaactgctttcacaggggcaccagcccctttgcttttactctgtccaaagttaacatgtcactgaaaaacgagccacg

SEQ ID NO: 13715 - DNA, 250 bp, Homo sapiens
gcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaagttacagatgagaaaactgaagctcagagagtgaaaggact

SEQ ID NO: 13716 - DNA, 187 bp, Homo sapiens
acggatgtattataacaattttaaggttacacttgtcctttcttgaacaggacaattctttattctaagactatatgcttcatagttttagttattttgaattgtccattctgttatgaaatacgatagttattgttggttgatgtcctctctcagaaaaataaaaaattagcagtcctaggtagat

SEQ ID NO: 13717 - DNA, 192 bp, Homo sapiens
agaccttttagaaggtaattaggccatgagggcagagtcctcatggcatgggattagggtcttataacaggacttgagtcctctataaggaacggagagttcacctttccttcccttctgccatgtgaggacacagcgtgtgtcccctctgaaggacacagcgacaagcctccattttgggcagagagcagc

SEQ ID NO: 13718 - DNA, 130 bp, Homo sapiens
atatggtggggcgcgggcggtgtcgctgtggggagctggtgctgttctcagatgtttccttccaatgggcttttggtgtaggatgtcggagaaccaagaacaggaggtaagagtatggtctgcagagaac

SEQ ID NO: 13719 - DNA, 329 bp, Homo sapiens
  misc_feature 222: m=a or c
  misc_feature 253: w=a or t
aagggcgagcggcgcggcagagtgcggcgcagccagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcamccttcaagcagtgtagttatatatcgacgawgaatggaaaaagatgtcccaaatgctgccccaaagccagagaagaaagatggggtgtccttctgtgctgaacatgt

SEQ ID NO: 13720 - DNA, 397 bp, Homo sapiens
  misc_feature 85: k=g or t
  misc_feature 311: s=g or c
  misc_feature 367: k=g or t
  misc_feature 392: w=a or t
agcttggttaaaaacagttatggcagtgggagtcgaagcgagggtctgaagttcacgactactagaaggggaggggagtggaaakgctctcagtgaaaaaggtacagtaaataaatgtccagggatattgggggctgggaagttgaataaatggtctaatctaggctggaggccataagggggaaaacagttgattctcggaagctctgccttctccccctctctagtgcgaatcactgaggcgccatttgatttctcgtttcctgcatgttttggcagtttacagtgcaaataacggtaccttggatgtstgtagagttttgtgtgcatatacaaattctcttaactaggtttaatttcatttgckctttaccaccctactccccagagawtaata

SEQ ID NO: 13721 - DNA, 111 bp, Homo sapiens
  misc_feature 104: n=a, g, c or t
aatctattgaatatatcacccatatttctatacagtcttctattccatttggccaacaggtatgtgcacaggtgaatgcatgttctttctggaagaggagaggnctttttt

SEQ ID NO: 13722 - DNA, 430 bp, Homo sapiens
  misc_feature 17: y=c or t
  misc_feature 27: k=g or t
  misc_feature 29: s=g or c
  misc_feature 35: r=a or g
  misc_feature 43: r=a or g
  misc_feature 53: r=a or g
  misc_feature 57: r=a or g
  misc_feature 63: r=a or g
  misc_feature 109: w=a or t
gaatttccgtttccggyggtgtccaakcsgacctraggagtcrcagttgtgarcagrttagarttacttgttattggtaaatagccactatggagactaaggaccagawgaaacacagaaagaaaaacggtagacccaaagctgcaaagaaaaagaagtgggcatctgcagggatctccagctaggagactaagaaaatgcccagaagagaaatgccaatgcttttgcatttcagtctgctgtgtggatgtctcgatcctttcacaggactctggatttgaagacacaaaagcatcatattccaatggttgatggaactccactagagccgccaccaataccggtagtggtgacggggcctccaaagttggaaagagcactttgatataatgcctcattcggaacttcacctggcagaagttcaccgaga

SEQ ID NO: 13723 - DNA, 340 bp, Homo sapiens
  misc_feature 328: y=c or t
gaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgygccaccctcaat

SEQ ID NO: 13724 - DNA, 448 bp, Homo sapiens
tttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaa

SEQ ID NO: 13725 - DNA, 339 bp, Homo sapiens
gaccagaaggctgagtggtggtgacctacaagaagaagaagggaaggtcataacagtaatgacttggagtggagaggccctgcaggttggagaagttcagtgtggctcaccatggagtgtcagagtgagggagatgactgctgagctccgagaggtgaacagagcccctggaaaatactaatgtccgtcagtcaacaaatacttgcagaatgctagtgtaaacagcattgtgcctggtattgtggactctccagagatgtgcatcaccttgttcctgccatctgaagtgtcctagacttctcaacgaagaggatatggacactaatcaagttaaacagc

SEQ ID NO: 13726 - DNA, 487 bp, Homo sapiens
  misc_feature 131: m=a or c
  misc_feature 399: s=g or c
  misc_feature 400: n=a, g, c or t
  misc_feature 401: n=a, g, c or t
  misc_feature 416: w=a or t
  misc_feature 418: n=a, g, c or t
  misc_feature 419: n=a, g, c or t
accagcagcccctaggagcccagcgccgccgccatgtcctccggggctagcgcgagcgccctgcagcgcttggtagagcagctcaagttggaggctggcgtggagaggatcaaggtctctcaggcagctgmagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagsnnctacttgagtgagawanngggtgaaggaatagaattttaaatagtaataactgcttgttttttttgtgcaagtacttttatacata

SEQ ID NO: 13727 - DNA, 162 bp, Homo sapiens
caagttgtcaagtgcattcactttagtgactatacatctataattaaaagaattattcccaacagtcatagtcagtcatgtagctacaatcttgtatatcacaggaaacaagatacttgtgttttgtatataatttttatacacacaattcttttttttttt

SEQ ID NO: 13728 - DNA, 126 bp, Homo sapiens
  misc_feature 106: n=a, g, c or t
  misc_feature 111: n=a, g, c or t
  misc_feature 124: s=g or c
ctctcgctaaccgtagcgcttttcgtgaaggcccgggtttttacagcacttcgcttttctaaccacgaacagtgctcgttcgttcgcagggccagcaaggagagcnccgcncccgcccgccgcscg

SEQ ID NO: 13729 - DNA, 83 bp, Homo sapiens
aacagaatttgttggcatgttctacacacagaccatggcttttcagaagccaagctgaataaaaacagttttaaaagaggcaa

SEQ ID NO: 13730 - DNA, 192 bp, Homo sapiens
tacatataggggaatccgaggctcaggctggctgtgtcagtcccctggggtattagagtaggggccagctctgcctggccctgccttagaacctggggacacagcctcagataaggcacaggaatgagtcagcagaccattcaggtggcagtgacaaggacggagatggtaacagtgggacacacctactga

SEQ ID NO: 13731 - DNA, 192 bp, Homo sapiens
  misc_feature 122: s=g or c
ctgtaggacaatttttgactattcaatttatgtaacagttacttgctatttcctcttgaatcgaatttcataactgataacttttgcagaatttactgttttaattttcaaattaattgggsaaaattttttataccattgcacatactgatccatctgctggatcatctatttggcttttttttttttaag

SEQ ID NO: 13732 - DNA, 459 bp, Homo sapiens
ttattgttatttttttgagatggcgtctcgctctgtcgccctggctggagtgcagtggtgcgatcttggctcactgcaggctccgcctcccgggttcatgccattctcccgcctcaggctctggagtagctgggactacaggtgcctgccaacacgcctggctaattttgtttttgtgtttttagtagagatggggtttcaccgcgttgggcaggatggtctcgatctcctgacctcgtgatccactcgccttggcctcccaaagtgctgggattacaggtgtgagccactgcacccagcaaaacccttcattattatgtgaaatttcaaacacggaagtatagtcatgaactaccatgtacctatcaatcagattcaactactgtaacagttcatggctagcattacttcgtttcccctttcagatgatttcgaagcaaatcttggacatcattttac

SEQ ID NO: 13733 - DNA, 266 bp, Homo sapiens
attattactcttctgatagatgagcaaattgagattccagaaagacctcacagccagcaagttggagagctgctttttgatgctagacagttggcctctggcctgtaatcttaataccccagaccatctttccatgtggccctcataggccctagaacagttgctcaggggaatcccggagcaagagatgagcacaggtgggagattcttcgcagactgtctgcagctcacgctaaggtgcgaggaagtggctggagtggaggaag

SEQ ID NO: 13734 - DNA, 484 bp, Homo sapiens
  misc_feature 443: s=g or c
cctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgcsaacccctgcagtcaaatcacattagtaatctgatttgctga

SEQ ID NO: 13735 - DNA, 456 bp, Homo sapiens
  misc_feature 11: n=a, g, c or t
  misc_feature 203: n=a, g, c or t
  misc_feature 385: r=a or g
  misc_feature 386: r=a or g
  misc_feature 387: r=a or g
  misc_feature 392: n=a, g, c or t
  misc_feature 398: r=a or g
  misc_feature 399: w=a or t
  misc_feature 411: n=a, g, c or t
  misc_feature 414: w=a or t
cagactctganacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgaganacataagcataattccccatctagtgatgatagttcggactacagccttgattcagatgttgaacatacagaaagttcccataaaaaaagaactggtttctacagggattatgacattccatttactcagcgtggacatatatcaggaagctacataacatcaagaagggtcaacataacarrratttnccagtrwagaatatgccgngtwcagcacctacagtgatgacaacttcggtaactacagtgatgc

SEQ ID NO: 13736 - DNA, 250 bp, Homo sapiens
  misc_feature 113: r=a or g
  misc_feature 135: s=g or c
tgaaagcaaagtaggcatctgacaaaagttgctttttcccttctgcattttaggacctcaagtaatgtttatccagaaactgctatcataccagggattcattgtgtatttarcaacataggcatgcaatctggsaaatttgaaaaactcttaacatacaccccaaatccctgcccaaatttaagaactagggtggacacagtgcgtttttccatgtcgcatcttctgtgatggggctacgatacgtggg

SEQ ID NO: 13737 - DNA, 450 bp, Homo sapiens
  misc_feature 431: m=a or c
  misc_feature 436: s=g or c
tcagtgatgttgaaccacatcttactaagatgctttgcttgctgtggcactctaaactctcttgcttgcttccatgacaatacatccaggtgatctcagaaaattgtgcagtgaataggctactgtgaaactacgactttcctctcattatacaccagcaatacatacagctcaacagtctcagtttaatgacaagaatgtaggatttcacaagcttctaaccataaattcagcttttcaagagcaaatgctttgaggatcgtcttaagaattataaaaaaactattgtgagagatctgcaaatttaggtttaggccactgctgatatcctaaactaagtgagatctgtaatgtctgcaagttagtcagaggtgaggaaggaaagcagcaccagtatccacaggacaccagcaccatccatggagttctcmagggscactcaaaaaagcc

SEQ ID NO: 13738 - DNA, 366 bp, Homo sapiens
  misc_feature 361: n=a, g, c or t
  misc_feature 363: w=a or t
tttccaccgagctgagccggagctggcaattcgctctgtggggttcccacaggaacatcccagtatcttatagggttatgtgctaaccgctgtgttgtaattctttgtaactgtctgtctctctcgctccagtctcatcacactataatttatgtacgacttaattatctgtttattctgcacttctcccaggaaatttccatgaagttgaggaagtgtctggacctgcagcattaagacgttaaaacaaacaaaccctggccaggcgcggtggctcacgcctgtaatcccagcactttgcgaggctgaggctggcggatcacttgaggtcaggagttcgaaaccagcctggccaacatgntwaaa

SEQ ID NO: 13739 - DNA, 272 bp, Homo sapiens
  misc_feature 155: w=a or t
aattcactccacctgatctcggggcgctgtgcgtgaggaaggcgcgggcgagccggagcagaagaaggagggagggagccagccgctgcagccaccaccgccaccatgtcctaccaaggcaagaagaacatcccgcggatcacggcaaatgagawacaaataagaaagaccttggaaaacccagagaaatcgactcctgtattttcagactccttttgctgtgaagtccctctttcatcaacatatgcctatttcaatatacgaaacacaga

SEQ ID NO: 13740 - DNA, 107 bp, Homo sapiens
atattgcagagaagcacctcatttcccaggcttactagtctaacttagccacatgtgttttaagaagcagcagtaagtaacatccctgtcagttgttcttttcagca

SEQ ID NO: 13741 - DNA, 396 bp, Homo sapiens
  misc_feature 122: s=g or c
ctctctcttccgccgtcgtcgccgccatcctcggcgcgactcgcttctttcggttctacctgggagaatccaccgccatccgccaccatggtgaacttcacggtagaccagatccgcgccastctttttgcctggaacgggcccatagccccccagccttgcgcagtctcggctccccccgagaagatgtcacctttgctaactctcctgcccccatcctgctcctgtctctgactcctctgcctttcccagaacacagggagaggctttctctgaagttcccttatctgaccaagggaagtttcttcagaaggaatgcagttgtcttgggccctctccctacaatctcattaaacagagaagattaactcacaggaaaggagactggagttgaca

SEQ ID NO: 13742 - DNA, 238 bp, Homo sapiens
ctctctcttccgccgtcgtcgccgccatcctcggcgcgactcgcttctttcggttctacctgggagaatccaccgccatccgccaccatggtgaacttcacggtagaccagatccgcgccctctctcatatcacaaataaagttacattatatcccttagctgacctgttaatttttctacagttgatgtgacagtgtctccattctatgatgaagaaatgaatttaagtcacacata

SEQ ID NO: 13743 - DNA, 110 bp, Homo sapiens
ctctctcttccgccgtcgtcgccgccatcctcggcgcgactcgcttctttcggttctacctgggagaatgaggaaggagggtgtgttaaccaaccaagggagtgggcccc

SEQ ID NO: 13744 - DNA, 213 bp, Homo sapiens
tctctttcgctgtttgagagtctctcggctcaaggaccgggagggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagg

SEQ ID NO: 13745 - DNA, 240 bp, Homo sapiens
  misc_feature 125: k=g or t
  misc_feature 126: s=g or c
  misc_feature 204: y=c or t
aagagccgggcgggggccgccggcgccgcatccctctctacctgccaacatcctgtattagagaacttgtggccggaggtgtggctgtggagagctggccggggagggacgctgctcagctgctkstctgctcctgtctcctgtcccctcccccggtcatgacagagacccgtgagccagctgagactgggggctacgccagcytggaagaagatgatgaagacctttccccaggccccg

SEQ ID NO: 13746 - DNA, 176 bp, Homo sapiens
  misc_feature 7: r=a or g
agctcarcatccttggaaataacctcaaaaggccttaggctaatgcacagggttcttccttctagttctgactcaccttcctgacctcattttatgcctcactatgaaaacacttggtatttttagatttatggtctctttcctatcactcccctttctttgttcagcaaaaccat

SEQ ID NO: 13747 - DNA, 147 bp, Homo sapiens
gtcgctcgcagccgtcatggcagcggaggagaaggacctctgagctattttgcggcatacgggagcagcagctcaggctcctcggacgaggaggataacatcgagccggaggagacgagtcgcagaaccccggatccggcgaagtcg

SEQ ID NO: 13748 - DNA, 326 bp, Homo sapiens
gcatgcgccgacccggcgcattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaa

SEQ ID NO: 13749 - DNA, 285 bp, Homo sapiens
gttgggggcagccaggcctggctcgagagcgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccc

SEQ ID NO: 13750 - DNA, 339 bp, Homo sapiens
  misc_feature 249: n=a, g, c or t
  misc_feature 286: m=a or c
  misc_feature 287: r=a or g
  misc_feature 320: m=a or c
gttgccgtttccgggtcacccaggcagcttgtggcggcgaacatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccangagtggcagaatttagtgacatttggaagcttttcamrcgtggttccctgtagtcatccatatattggtamcctgagtcaagtaaagttg

SEQ ID NO: 13751 - DNA, 140 bp, Homo sapiens
gtatattagcactcaacatctattcccagtccttgggatacttagtttacctctaatagtctctacttaaacttggggcctgacaaactttattaatgcttgatcacctgacctcaagtcttgctcattcctgttccccg

SEQ ID NO: 13752 - DNA, 255 bp, Homo sapiens
  misc_feature 238: n=a, g, c or t
atttaacaaacttttagtgaacatctgtagtgctagaattacatagactaaggtcactgttaaggcattctttgaatagcaaggaagataggagtgatatgtgcagtggcagaaggaagcctaggaagctgtgggaagtcggaggagtgtcttgtaacctagccagtgaggggtgatgtcagggaaggccttccagaggacatgacagcaagtcagagaagtgaaggatgagtaagtnagttggaaggaggttgg

SEQ ID NO: 13753 - DNA, 444 bp, Homo sapiens
gatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggc

SEQ ID NO: 13754 - DNA, 248 bp, Homo sapiens
  misc_feature 63: r=a or g
  misc_feature 86: k=g or t
  misc_feature 108: w=a or t
  misc_feature 138: w=a or t
  misc_feature 209: y=c or t
  misc_feature 219: w=a or t
  misc_feature 231: n=a, g, c or t
  misc_feature 232: s=g or c
  misc_feature 238: n=a, g, c or t
  misc_feature 248: w=a or t
agagcgagcttaacggattaataagcgcagcaggccagctctggggtctcggcaggtggtccrcaacatgacctctgagttcttckctgcccagctccgggcccagawctctgacgacaccactcaacccgatctccwactacaagcccgagttctacacgccggttgatgggggcactgctcacctgtctgtcgtcgcagaggacggyagtgctgtgwccgccaccagcnscatcancctctacttw

SEQ ID NO: 13755 - DNA, 730 bp, Homo sapiens
  misc_feature 433: n=a, g, c or t
  misc_feature 513: n=a, g, c or t
  misc_feature 704: n=a, g, c or t
ggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggnctccgcgggaggtgaggaaactgaaagccaccgaggaaaaggggggcgctccttaagaagtgccgcggtcacgtgtacgnttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcagccgacactccttcctgcctttgctcaagcggttccttcaccccgatcaangttccttcccatttctccatctgggg

SEQ ID NO: 13756 - DNA, 306 bp, Homo sapiens
  misc_feature 297: m=a or c
gatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccacaggcgcacatccaagttgtgagtaagaacctgtacagccaggacaaccaacatgcccccttgctatatggggtgctcgaccataggatggtamggccccctc

SEQ ID NO: 13757 - DNA, 538 bp, Homo sapiens
tctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcagg

SEQ ID NO: 13758 - DNA, 289 bp, Homo sapiens
aacctcacgaggccttacgtgcctagagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacc

SEQ ID NO: 13759 - DNA, 275 bp, Homo sapiens
gcggaccggagggtgcaggcgacgggaagcgcgggtggtcggctggggtccggctcctggagaacatggcccggcctcccgggggctctggtcccctcctcgttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactcc

SEQ ID NO: 13760 - DNA, 228 bp, Homo sapiens
  misc_feature 145: s=g or c
  misc_feature 146: m=a or c
gatccctagcggctgcagagtggaacatggcggcctccttgccgcttgcgttaccagagtccacccggcctcgtgctttctccgggcgcccgtagctggcgccggcatccacaaaaatagatcagacagaggatgaataaagagsmagctccaggctgtgaagcgtctagtccttgctcccctcagaagctgggacatgttggaccaaggtggtaaggatagtgagag

SEQ ID NO: 13761 - DNA, 274 bp, Homo sapiens
  misc_feature 154: k=g or t
  misc_feature 205: k=g or t
acatgaccggctttaagcaacatggcggctgccgtggtgcagcgcccgggctgagcgacagcaagtgcagcggctcctaccccgggtgaggggtggcctccgcgtgggatcgtgccctcttcagcccgctcctgtccccgacatcacgtgtatkccgcacgtcccctccgcgctgtgtgtctactgagacggggaggcgtgacakggcccgggtcccttctcagtggtgctctgtgcttcagggcaagctccccgtctccgggcgcacttccct

SEQ ID NO: 13762 - DNA, 262 bp, Homo sapiens
gttattgaggaacatggcgttgctggtgcgagtccttgtgagtgaaggagtaattttctacggtagctctctgggtcccgggttggagttcgacaaggcagggcgggaggaattggaaggaatcgcaggagggaagcctgtgttatagctaggctgagtggccgcttttccgtggggaaactgaggcagcttccgacctcttcctaccccgttttgaccttagctctcccatctttcgagaaggggaagactgacatctggc

SEQ ID NO: 13763 - DNA, 533 bp, Homo sapiens
  misc_feature 9: k=g or t
  misc_feature 20: w=a or t
  misc_feature 45: s=g or c
  misc_feature 46: s=g or c
  misc_feature 47: n=a, g, c or t
gtctctgckgcttccgcctwcccggcatcccctgcgcgcgcctgssntccggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgc

SEQ ID NO: 13764 - DNA, 340 bp, Homo sapiens
  misc_feature 98: y=c or t
ccgcataaatggatagaagagagaagcacctgtgctgtggagtggcattttagatgccctcacgaatatgaagcttagcacagctctagttacattcytaatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaa

SEQ ID NO: 13765 - DNA, 79 bp, Homo sapiens
agcaacatgtatccagttcttccttagttaggttaaatgtgtcttttccccccttattcccttcctcccttcctcccct

SEQ ID NO: 13766 - DNA, 364 bp, Homo sapiens
ctttccggtgtcggggcacagttgaagaagcgaccgagggactgggagtcgttagtgaggatgacgcggcatggcaagaactgcaccgcagggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagct

SEQ ID NO: 13767 - DNA, 148 bp, Homo sapiens
gaagatatgagagttagaaaaatatatatattttctaccacaaagtagaataagctcaatgggatacctaggtcttgaataaaatgaatagaattcagatttttccccaataacattggttacctcaacattcttatgctagcttgga

SEQ ID NO: 13768 - DNA, 155 bp, Homo sapiens
gaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacgg

SEQ ID NO: 13769 - DNA, 300 bp, Homo sapiens
  misc_feature 281: n=a, g, c or t
agccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggcatgagccggggcgggcggggcatgtcacgggacagacgggcagaactttaggaaggggcaccatggggtcgggccgaggctgattggggccatgagcgccccagccaggtgtatgaggactcaggggccaaagcaagtngccacgggggcagaaatgg

SEQ ID NO: 13770 - DNA, 325 bp, Homo sapiens
caattctgtgaattttgacaaatgaatatagttctgtaaccatgactactgttgagataggaccaattatatcacccccaaaattctttgttgctgaggtgcttttttgtttttttagaggaaaccaatgtgtatttgaagtcagaaaggaagaaacccatgggaaaggaggagatgatggtgttaaagaggaaagggttgaaggagtgaggcgtggaggtggtagggaggcaggtgggccactgagaatgcttcaattttggtgggaaggaacatttcctctcttcctatgaagtagaaggaaggatggatgcatacattcagg

SEQ ID NO: 13771 - DNA, 193 bp, Homo sapiens
cattctctgtcaacctgtctggttgattttctccccaccatatcactgaagtgagacttataacatttctagtgacctacttcttgccagtggtctgagggttctttgtctacaccccttcgatgaatttttccagtcttagggctttaggtagcttttacaggttgatgactctcaggtgtatatcccccag

SEQ ID NO: 13772 - DNA, 352 bp, Homo sapiens
agttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggg

SEQ ID NO: 13773 - DNA, 173 bp, Homo sapiens
  misc_feature 102: y=c or t
atacttgccctggcgaagaagatggcggcgcccatcacacacataaaacatggcttcccttcaaaacaaaaacatcccggggccggggcgcgcggccggcgytcacctgaggaccacatggtgaccgagaactcgccctccagggtcttgatctgcacctgcttctgctccca

SEQ ID NO: 13774 - DNA, 194 bp, Homo sapiens
  misc_feature 153: k=g or t
tttattaataatgtggtatgtgtatatgtatattcttttttaaaaaaattggaattctttctatgcattccatgttaccttttgtcattgatgtatactttttcctgtatctttaatgttctttgaaaacatttttagtggctacattgtgtktaatttcacagaagtacaatatatttgaaaataattaccct

SEQ ID NO: 13775 - DNA, 93 bp, Homo sapiens
acattctgacttgtttacagtacttcataaaaattatggatttattgcttaactatttaatgaatctctaaaataacatttttctacataacc

SEQ ID NO: 13776 - DNA, 178 bp, Homo sapiens
tacatgtaatatggaatgttaatgtacttataatgtgtattgtagtgtaaagttttatattcctggtttaaatttttaatttaggtcagtttaaattatatgtttgcctcaaaataaaactaaatacaatcagttggagtaatcaacatttttgtggttactgttgatgtgttctctg

SEQ ID NO: 13777 - DNA, 146 bp, Homo sapiens
agtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcct

SEQ ID NO: 13778 - DNA, 361 bp, Homo sapiens
  misc_feature 67: k=g or t
  misc_feature 68: s=g or c
  misc_feature 74: k=g or t
  misc_feature 136: y=c or t
atggtctctgtgtgttctaatccctgttcattctcatttactgtctgaagttgaggagatgggatgksccagakgatagggctcctgggatttcagacccaagaccagcaggactccagtcacctctaccccagcyctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggg

SEQ ID NO: 13779 - DNA, 167 bp, Homo sapiens
tgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttata

SEQ ID NO: 13780 - DNA, 251 bp, Homo sapiens
  misc_feature 161: n=a, g, c or t
tctaagaactttatgtttttaaccaatttaattgtcacaacaaccctataagataggcagcattatccctatcatatctacgagcaaacagagtggctaagtagctttctcaggttctcacagcctgattcgctgtctccacttcacttgacacgtctgtncattctcctttcaataattctttctgtataatccagttacattccacgtcacaccttctgagctcataatctccccattctaatggccag

SEQ ID NO: 13781 - DNA, 132 bp, Homo sapiens
catcttgtgtcggcggctcggctgtaaggaggtggcagggacaaccacaaccacaacggccgggggaggagaaggcggcagggcgattctaggcggcccaggcggcggggaggaggagaaggaggagggtgg

SEQ ID NO: 13782 - DNA, 119 bp, Homo sapiens
  misc_feature 119: m=a or c
cactaagatcaaccacacactcaaccgtaaagcaattctcaacaaattataaaaaccaaaattataccagccatactcttggaccacagtgcaacaaaattataactcaattacaagam

SEQ ID NO: 13783 - DNA, 440 bp, Homo sapiens
  misc_feature 4: y=c or t
  misc_feature 327: s=g or c
atayataggggtcaaaacggacacctctgaaacaaagacagattaacaagagaaaagcccaacaaatatattcgaccacagctttacaatacacaggagccttcggaatgaagacccaaagacccaagaaaaagtccgagagggcaacgccatggggctgagctgctcaatgccctcccagtgcatcctgctgcaaggatgccccccaggatgctgcctcacctaaccagccgctccaggagtggcccccagcccccaccccatggagcttcgacttcctggtgaccagtgctccagtaacctctaagtgcttgaaccacgcctgtsagccagttatggctttggctctgagagcccccctgaccaacttaaccaatgctttttttctgtaagaaattgccacttactgttggtttctgtccgacccggtgagatacttg

SEQ ID NO: 13784 - DNA, 351 bp, Homo sapiens
ctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagc

SEQ ID NO: 13785 - DNA, 110 bp, Homo sapiens
agggtgcaaatcaggaggaagtgttctgtttcaaccttaactggtctactgcaactcaattctggcactaaccactcagagttagtacagaccctacaagttaaaaggca

SEQ ID NO: 13786 - DNA, 202 bp, Homo sapiens
ccccaattactacctcttttatatttagttgattttttgtaatgtacaattttgattcccttctttccttttctgtgtattttaaagttattttcttagtggttaccccaaggtaaccactttcaacctggtttgaataataccaacttagtttcaattctgtcttctatacactactctgcttctatacatctctgtgcct

SEQ ID NO: 13787 - DNA, 437 bp, Homo sapiens
  misc_feature 101: s=g or c
agtgatttcctctgggttacggcgcaggcgcaagataagctaggagccgcgcgagtcgtagtgtcgctgtttgcgggtctccgcgcgggaccggggcgcasggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcagccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcat

SEQ ID NO: 13788 - DNA, 499 bp, Homo sapiens
  misc_feature 101: s=g or c
agtgatttcctctgggttacggcgcaggcgcaagataagctaggagccgcgcgagtcgtagtgtcgctgtttgcgggtctccgcgcgggaccggggcgcascggggtcgctgaggcgagggtgtcatgtcagacaacgaaggacaattttgatggcgacgactttgatgatgtggaggaggatgaagggctagatgacttggagaatgccgaagaggtcagtattcagcctcaggctcccacctctgcagcccaagctgccaaatcgtctgacaggaaggccaggagaatgtcgagatcctcccctctggggagcgaccgcagccaaccagaagcgaaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcat

SEQ ID NO: 13789 - DNA, 333 bp, Homo sapiens
  misc_feature 9: m=a or c
  misc_feature 66: w=a or t
  misc_feature 246: n=a, g, c or t
  misc_feature 319: n=a, g, c or t
tgaatgcamgatttggctttaagttgaagatgaattatttctcatgctcattttcttgcggcagtwatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttntagctccaggcttttctaaccagacttgatttcctcatgttctagaaagatcactaatggtcaagtggaacangcactacacgaact

SEQ ID NO: 13790 - DNA, 101 bp, Homo sapiens
  misc_feature 72: k=g or t
aataacttattaggaggcctcaagatacgtattgaattagataataaccagagcataaatgtaatgacagtkaggtatttgttattacaagattctgcaga

SEQ ID NO: 13791 - DNA, 464 bp, Homo sapiens
  misc_feature 310: w=a or t
acgtcgtgccctgcgcgtgagagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcwggaagctggaaaggaaggtactgcaccatctgaaaatggtgaaactaaagctgaagaggtactttccataaatacctcccactgattgaatcagtgtctttaaagaaatttctcaatccttcagccggtgatagcacgttcttaatgtctcttt

SEQ ID NO: 13792 - DNA, 452 bp, Homo sapiens
  misc_feature 369: r=a or g
  misc_feature 370: n=a, g, c or t
acgtcgtgccctgcgcgtgagagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaatrntcatgaaaaattggggttgattttatgtatctcttgggacacttttaaaagctatttttaccaagtattttgtaaatgctaa

SEQ ID NO: 13793 - DNA, 395 bp, Homo sapiens
acgtcgtgccctgcgcgtgagagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaactaaagctgaagagatcacatctctcgctcaactgttaatgt

SEQ ID NO: 13794 - DNA, 182 bp, Homo sapiens
gcgcacgcgactccgctaagtggaaccagcagaacccaaggccggccgagccaattggagactccttggccctggaagccctcgctgctgccgccaagagacgcggtcaattaacttctccctgcagccaggctctctgacccggcctgcccgcccctctcgccggtgcccgccccatgccc

SEQ ID NO: 13795 - DNA, 396 bp, Homo sapiens
  misc_feature 102: s=g or c
  misc_feature 360: k=g or t
gccccgccccgtccccgggcgtctccattttggtctcaggcgtggactcggcaagaaccagcgcaagagggaagcagagttatagctaccccggccgcggascggctcactgcactacccccgcccccttctttcctccagacgccgaagtcgcgggcgctcatggcgggcctggaggtactgttcgcatcggcagcgcggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagactgtatgtcckccggtatgagtataaggatgggtccagaaagctcct

SEQ ID NO: 13796 - DNA, 415 bp, Homo sapiens
  misc_feature 104: r=a or g
  misc_feature 138: k=g or t
  misc_feature 139: w=a or t
  misc_feature 148: s=g or c
  misc_feature 281: m=a or c
  misc_feature 340: n=a, g, c or t
aaaagtgtcctgtgcccagaacgcggttaggaagtgtgtgcatacgtctgaaccctaaatggttctcagttctgtaaacttctccttcccactgggtggagtarggcctttaagagcagctggaatgcagttcccctkwtcagcgtascagttgttgcctgtctgaacctctgccagtcctggagactggtgccctgagctccaaccagcgggcctcatcctacaccctcaccaccgcaacttctcacccgagcaagaagcagcttcccagagagaaagamcgttcccacctgcctagccatgggaaggacgctgcacaggccgaaaagttccagcaccntgggtctgacatgcggcaggaaaagccctcgagccccagcccgatgccttcctccacaccaagccccagcctgaa

SEQ ID NO: 13797 - DNA, 373 bp, Homo sapiens
  misc_feature 341: s=g or c
  misc_feature 342: n=a, g, c or t
  misc_feature 371: n=a, g, c or t
  misc_feature 372: n=a, g, c or t
  misc_feature 373: m=a or c
aatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatsnctcccctcttcccccaccccacaacgcgnnm

SEQ ID NO: 13798 - DNA, 178 bp, Homo sapiens
  misc_feature 141: m=a or c
  misc_feature 146: s=g or c
  misc_feature 147: n=a, g, c or t
gactgtggctcccgaagctgcttcgggccccagcggtgagggagaagactctcaaccagggtgacttctaggcgtcctcccggagctaccggggacactggcgttattgcccggaacactgagatagggaatgctcgagamacagsngcaggttttggggttttttttgaattactgg

SEQ ID NO: 13799 - DNA, 365 bp, Homo sapiens
  misc_feature 69: y=c or t
  misc_feature 107: k=g or t
  misc_feature 151: y=c or t
  misc_feature 306: n=a, g, c or t
ggaagcggaaggttgaatgcgtcgggtgggcacctcagcaaccagtagccatgcgcggcttggaggagycggggcctcggcctacagcgaccccgtgcggctgcgtkaagccggctctggagacaggattttgtttgtttttcacaaaaayggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttcggngaattgacatgatacatggcacacccgtactagacatcaagcctacatagctgagtatg

SEQ ID NO: 13800 - DNA, 392 bp, Homo sapiens
  misc_feature 12: r=a or g
  misc_feature 13: r=a or g
  misc_feature 221: y=c or t
  misc_feature 222: w=a or t
  misc_feature 254: w=a or t
  misc_feature 255: n=a, g, c or t
gttggggactarrgcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcaaggtgaaaccatgctgcagtggctgtcgggywtcgggtatactccttcgggggttactgctctwntgaagactatgagacactgcgtcagatagatgtgcacattttcaatgcagtgtccttgcgttggacaaagctgcccccggtgaagtctgccatccgtgggcaaggctcctgtggtaccctacatgcgctatggacac

SEQ ID NO: 13801 - DNA, 229 bp, Homo sapiens
ttatagatacaaccagttaccagtttcttacgcatccttctagaggttaacaatgcactagtttattgggtttttttctttttttcttttctctttttagatggagtgtcgctctgtcgcccaggctggagtgcagtggcgcaatctcggctcactgcaagctccacctcccaggttcacgccattcttctgcctcagcctcccgagtagctgggactacaggcaccca

SEQ ID NO: 13802 - DNA, 126 bp, Homo sapiens
atccccgtttcaagaactcaggatccaggaccgcagactccctccagggctccgatcccaagaccccgcgttggaggaacttgagatccggactctaagcgccccaaccagtttcgggctgcagcg

SEQ ID NO: 13803 - DNA, 314 bp, Homo sapiens
tttatcaggctgctgttaactgcattgcctggggatattttctgatagggtagattcaagcatggtgcccagtgaggagggcagaaaaggataattgtcactgttaaccataagtaccaccatgatttgagcacttcctatgtgccaggcactatgcaaagggtttttttgtttttgttttttttaaacagagttttgctctgtcacccaggctggagtgcagtggtgtgatctcggctcactgcaacctctgcctcccaggttcaagcgattctcctgcctcagcctcctgagtacctgggactaacaggcgc

SEQ ID NO: 13804 - DNA, 236 bp, Homo sapiens
  misc_feature 60: k=g or t
atttttcaaggagaggcttcttgctgaattttgattctgcagctgaaatttaggacagtkgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggc

SEQ ID NO: 13805 - DNA, 178 bp, Homo sapiens
  misc_feature 32: n=a, g, c or t
attctcgctagttcgatcggtagcgggagcgnagagcggaccccagagagccctgagcagccccaccgccgccgccggcctagttaccatcacaccccgggaggagccgcagctgccgcagccggccccagtcaccatcaccgcaaccatgagcagcgaggccgagacccagcagcca

SEQ ID NO: 13806 - DNA, 190 bp, Homo sapiens
  misc_feature 13: y=c or t
  misc_feature 84: m=a or c
  misc_feature 85: n=a, g, c or t
acgtgaccgtctytgggccggcgcgaaccatggccggcatggtggacttccaggatgaggagcaggtcaagtcctttttggagmnacatggagcgtggagtgcaactaccactgctaccacgagaaggacccggacggttgctatcggctggtggactatttggaagggatccggacaattttgatgagg

SEQ ID NO: 13807 - DNA, 760 bp, Homo sapiens
  misc_feature 24: w=a or t
  misc_feature 80: w=a or t
  misc_feature 87: y=c or t
  misc_feature 121: m=a or c
caagtggctgcgtttttgttagtwtggcaggtgtagactttttaagttgggctttagaaaatctgggttagcctgaagawaattgcytcagcctccacagtaccattttaaattcacatamaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaa

SEQ ID NO: 13808 - DNA, 407 bp, Homo sapiens
  misc_feature 15: s=g or c
  misc_feature 124: m=a or c
  misc_feature 209: n=a, g, c or t
  misc_feature 246: y=c or t
  misc_feature 247: m=a or c
  misc_feature 250: r=a or g
  misc_feature 259: n=a, g, c or t
  misc_feature 260: n=a, g, c or t
  misc_feature 272: n=a, g, c or t
  misc_feature 273: n=a, g, c or t
  misc_feature 274: n=a, g, c or t
  misc_feature 305: n=a, g, c or t
  misc_feature 358: n=a, g, c or t
  misc_feature 359: n=a, g, c or t
  misc_feature 360: s=g or c
  misc_feature 361: n=a, g, c or t
  misc_feature 373: n=a, g, c or t
  misc_feature 376: y=c or t
  misc_feature 377: w=a or t
  misc_feature 378: y=c or t
acccacgcggcgcastcccaaagttgcagacagcccggcgaaccgcgcaatgcgcttcttctgcctgcagcagagaaaaggaaagaaaactccgcaggggctccgttggcttctccacgagtgmcaaaccatgttttcccagatagaagaccggagccctgctcctttgcgatccgccgagggctgcagagagcatcctcatccatttnggcacccctgcccaggaagagcccggccatccctttymggrctggatccnnaagaggtgaatnnncttccgtggattccgatttgctccgtctgancagcctaggcaatccagcatcgcgtggtaccagtgccgctgggcacactggcnnsncgccggctccgnctywycagcaagcgcattcccaggtggtcaggct

SEQ ID NO: 13809 - DNA, 415 bp, Homo sapiens
  misc_feature 225: r=a or g
  misc_feature 333: r=a or g
  misc_feature 334: n=a, g, c or t
atttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcrcttgaagccagagtttgagaccagcctgtgcaacacagcaagaccccgtctctacaaaaacttaaagaattagctggctgtggtgttgctcacccatagttccagctrntcgggaagctgaggcagtaagatcacttgagcccaggaggccgatgctgcagtgaactgtgattgtccactacagtcagcc

SEQ ID NO: 13810 - DNA, 126 bp, Homo sapiens
  misc_feature 74: s=g or c
atgaaccatttcaccaatgaagccggttcccagccatcctcctcaccgccctccctctcagcgccttccttgcscctcctccccgagtcaccaccgtccagttccccaccctgcactcgtttcccg

SEQ ID NO: 13811 - DNA, 245 bp, Homo sapiens
  misc_feature 10: y=c or t
  misc_feature 11: y=c or t
  misc_feature 16: n=a, g, c or t
agagacgcayyctgtncataggcagtaagaatatataaaaatgagtaagctatgtaaaaatgagtaagaaccattttagtgcaatgctgcttgatctttttaggttactaatccctttcaaaatctgatgaaagctgaatctttcaccccaaaaaaagaaatgcacacttgtgcattgcatatacacaagatttagcatgtcttttttgccttggtctccttcaagccctgatgacattactgga

SEQ ID NO: 13812 - DNA, 250 bp, Homo sapiens
  misc_feature 194: k=g or t
agttacgcacgggaggcggtacctggttgtggagggtgacgccatgggtggggcggagcgtctgggatgcgctgggagcctaggatccccgacagttttgcagaacactgaaatctatggactctaaaatggacttcatttaaagaaacccacggaccattaatggacaaaaacatgagtcaatatgtattgtkgcattcaaatcctagcactctgggagagcatcaagtaccacgtttttgaagaccat

SEQ ID NO: 13813 - DNA, 463 bp, Homo sapiens
  misc_feature 61: r=a or g
  misc_feature 256: n=a, g, c or t
  misc_feature 424: y=c or t
  misc_feature 446: k=g or t
ataggaggagccaagatggccgaataggaacagctccggtctacagctcccagcgtgagcracgcagaagacgggtgatttctgcatttccatcgaggttaacaattcatgctgagtgtcccatgcatttggaagattttcccatggatgtgcatgcctgcccactgaagtttggaagctgagaatatgtcgtcatgacaacccacttccatctcaagcgaaaaattggctactttgtgatccagacctacttgcnatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggtyatagccgtctgttatgctttgkattttctgcactgattg

SEQ ID NO: 13814 - DNA, 84 bp, Homo sapiens
aacccagaagaggcgtctcaacacagcatgttggagatctgtgttttatgtttttatgtgattgctctttcttttccggccggc

SEQ ID NO: 13815 - DNA, 138 bp, Homo sapiens
gaatttttatgccattatgtcaaggtcttagctgattctcaatcaatttgtatcgtgcctgaagggtgatagaccgtctaccagcattctagaacccagcagggtgagggttgggcctctgctttcagtgtaacacac

SEQ ID NO: 13816 - DNA, 380 bp, Homo sapiens
  misc_feature 7: r=a or g
  misc_feature 311: n=a, g, c or t
  misc_feature 312: n=a, g, c or t
  misc_feature 362: w=a or t
acagtgrcattcaacttcctgcctgccagccccagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccagggtctctctgtgttactcaggctggagtgcagtggcgtgatttctgctcactgcagccttgacctnncagcaggctcaagcaatcctcctgcctcatcctcccgagtagctgggacwacaggcatgtgccaccac

SEQ ID NO: 13817 - DNA, 222 bp, Homo sapiens
  misc_feature 7: s=g or c
  misc_feature 176: m=a or c
tactgcsgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcgaccctaaatacgccgaccttcccggmattgccaggaatgagccagatgtttatgaaactagcgacctacctg

SEQ ID NO: 13818 - DNA, 275 bp, Homo sapiens
  misc_feature 214: s=g or c
  misc_feature 227: n=a, g, c or t
  misc_feature 272: s=g or c
ccccttccggccgaggcgcggaccgcgcggactaagtggaatcccggttggcttggggcgcaggcttccaacttcgtactctggcctctggcgtctcggctcgtcggttgggtacccgaacccagctactgctgcttgaagagaagatggatggggactcctcgccgtcgctgcgccgccggccttccctgggcggacgtacacctttgcgaasgtcagtgaggacncagggcccctccttggaataagctcttatttctcaagcgctgcasgtg

SEQ ID NO: 13819 - DNA, 201 bp, Homo sapiens
acacgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcg

SEQ ID NO: 13820 - DNA, 328 bp, Homo sapiens
  misc_feature 303: r=a or g
aaaaaggctggccaggccgcccccagcacgtagagggaatgagtcaggctccggctccacactggcacgtagtggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagrctggaatcatgagcaacaatggagc

SEQ ID NO: 13821 - DNA, 164 bp, Homo sapiens
  misc_feature 158: w=a or t
  misc_feature 159: k=g or t
  misc_feature 161: k=g or t
ctctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaawkgktta

SEQ ID NO: 13822 - DNA, 244 bp, Homo sapiens
  misc_feature 119: n=a, g, c or t
gacagacgggaccaggagctctcgaggtgtctggaggctcagcgagcgccggacccaggaggcccaaggagctggaggtgaccctcaggcagcaagaaccccacggaagggcgtgagcnttgcagacagctgtgcggcacctcgggctgggctcctgttaggaggaagtgcctgcacccaggcagcggctcagaggcagctgctccatgcagaactgaagctggttctgcagcagaaaggggag

SEQ ID NO: 13823 - DNA, 213 bp, Homo sapiens
  misc_feature 101: n=a, g, c or t
  misc_feature 167: k=g or t
gacaagctctcccgggcgcgggcgggggtcgtgtgcttggaggaagccgcggaacccccagcgtccgtccatggcgtggagccttgggagctggctgggtnggctgcctgctggtgtcagcattgggaatggtaccacctcccgaaaatgtcagaatgaattctgtkaatttcaagaacattctacagtgggagtcacctgcttttgccaaag

SEQ ID NO: 13824 - DNA, 310 bp, Homo sapiens
  misc_feature 136: k=g or t
  misc_feature 238: r=a or g
  misc_feature 239: r=a or g
cacgccattctgctgcctcatcctcctgagcagctgcgactacaggccccgcttcaccccttctcactctggaaaccgcacctttaactttgcagaccttccttcacccctgacttctgcttcacctttgacctckgccccccatgaatcccattttacctctagacctataagttctggtttatgtttgacccctccctctgagctgcacttcaccgctgaccttgcctcacctttrrccccccacctgagccccagctcctacctctgaccccaacttctctttgatctctgaatcccctctgactcc

SEQ ID NO: 13825 - DNA, 331 bp, Homo sapiens
  misc_feature 113: m=a or c
  misc_feature 114: r=a or g
  misc_feature 115: r=a or g
  misc_feature 123: n=a, g, c or t
  misc_feature 157: k=g or t
gttacttcctggtcctggtccgaaatttccaccgccaccacgtgaatccccaaagccaaagttgcctccgcttcaccccttctgactctggaaaccgcacctttaactttgcmrraccttccnttcacccctgacttctgcttcacctttgacctckgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactcc

SEQ ID NO: 13826 - DNA, 507 bp, Homo sapiens
  misc_feature 7: s=g or c
ggaagcsgaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaacacaggaagtatgccagatggaaggcaacatacat

SEQ ID NO: 13827 - DNA, 303 bp, Homo sapiens
  misc_feature 301: n=a, g, c or t
ttcggaggtcagagctcggcggggtgcggctagtggcggagcgcgctgcgaggggagggctttccactgtcgctggcgtgaactcgcgtgcccggtttcaccaggtactgccttctaacttgagctggccatttccacatgtcagataggaccaacttgccttttaactacccgtgtgatacttaaacactgttgccggtatcacagcttttcttcaaaacagagtctcactctgtcacccaggtggaagtacagtggtgcactctcggcttgcttcccaggctcaagtgattctcatgcntc

SEQ ID NO: 13828 - DNA, 445 bp, Homo sapiens
  misc_feature 43: s=g or c
  misc_feature 403: n=a, g, c or t
  misc_feature 405: n=a, g, c or t
tcttcggaggtcagagctcggcggggtgcggctagtggcggasgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggcttcaccaggtactgccttctaacgagctgncnatttccacatgtcagataggaccaacttgccttttaacta

SEQ ID NO: 13829 - DNA, 82 bp, Homo sapiens
acccagagcccgctgccgccggagccgagccgacccgccccgccgacgaaccccctgaagctgtgccaagatgtgtgacgcc

SEQ ID NO: 13830 - DNA, 218 bp, Homo sapiens
gaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcga

SEQ ID NO: 13831 - DNA, 300 bp, Homo sapiens
  misc_feature 11: w=a or t
acctgtcagcwgcggccagtccccaggccccagactgccgggtcggctctgagctgccagcatctgggacgtgtctgtgcgtgtccctgcctcttaattgcaagggtgtcattgggcatcctttgttctgtattatccatccatcactgctacccacagccctcaattctcaacccctacaacttattcctgtccggagacagcctaagggtaagtttgggggctagccttaacctgttttatcttactacttattggtacattgtcttttcagggaaatgaaaagccttgattgtgttg

SEQ ID NO: 13832 - DNA, 227 bp, Homo sapiens
  misc_feature 41: s=g or c
  misc_feature 143: m=a or c
gcagtccaccgccaggagccttccggtttctgcgcggtgcsgacctcgtcccgaagcctggggatacaccctctcgagagcccgctgtcgccctccgttaaggtcgaacccctcacagttgctgtgggcaactccagcccaamattccctcgctctggttctcgccccattgggaaactcggccccacgcttcccacttttctggatgaggtgtcccctttctcccc

SEQ ID NO: 13833 - DNA, 305 bp, Homo sapiens
  misc_feature 7: m=a or c
  misc_feature 8: s=g or c
tcccgtmscttagctctcggccctgggccctttttcctcctcggctgcgcgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagcca

SEQ ID NO: 13834 - DNA, 252 bp, Homo sapiens
  misc_feature 130: w=a or t
  misc_feature 131: w=a or t
  misc_feature 137: w=a or t
  misc_feature 141: w=a or t
  misc_feature 142: k=g or t
agaggtgcggcgggggagccctccagaatacccatcatatagcccctgaggtggcatggtgatgtctccatgagggaaccccttcccactcatcctgtcacgtatatcatagtgttcttgactgggccawwtcatcwaagwkgggatttaccctgtgaaacagggagaagacttatggaccccaagcatcatttcgagttgtagttgagtttttaaaagacatacatgcaaagttcctttgctttggaccct

SEQ ID NO: 13835 - DNA, 172 bp, Homo sapiens
gactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccacca

SEQ ID NO: 13836 - DNA, 97 bp, Homo sapiens
actgttggcccgccccctgggctggcctgggagggaacccgactagcagagccctctgctcagttgctcccagcagtggccctgggaccagctctgc

SEQ ID NO: 13837 - DNA, 505 bp, Homo sapiens
  misc_feature 199: m=a or c
  misc_feature 375: n=a, g, c or t
  misc_feature 376: w=a or t
  misc_feature 505: m=a or c
ctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaaggggmcatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtgnwtcatgtgtctaactatcgggctcctaaggactcagaagaaatagatgatgtgaccagacaactccaggagaagggctgtggggctcgtacccctcaccaagtttgtctgagagctctgaagatgaaaam

SEQ ID NO: 13838 - DNA, 416 bp, Homo sapiens
  misc_feature 347: w=a or t
  misc_feature 388: r=a or g
  misc_feature 396: s=g or c
  misc_feature 397: r=a or g
atgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcgcatctcttcccgaacacgagcaccacaggcgcccgaagccggaacaggcgtttagagaaaatggcagacgatattgwtattgaagcaatgcttgaggctccttacaagaaggatgagracaagttsrgcagtgccaacggccatga

SEQ ID NO: 13839 - DNA, 215 bp, Homo sapiens
  misc_feature 69: r=a or g
atgcacagtcctgttgccacggccatggccgggtggggagctgggctccagtgagcacagagctccttrccagtaggcgatgcaagttatctctggggcccggaggacacgagtgaggaccgggcaccaatcaggttctcgctctgcgccggcctttgttctcactcgggagcaggttgcgggcgtctagcatcgggaacccgcattcgactcgg

SEQ ID NO: 13840 - DNA, 168 bp, Homo sapiens
agaggcgtttgcggcccagcgcctggactggaccttggcgttgggccgcagttgcccggagtttttggggcccccgggaacccgcgcgccgaggccggctaagtttggcagactctctgagctctcggaattcgactgcctccattgttgctccttctggcacccaca

SEQ ID NO: 13841 - DNA, 342 bp, Homo sapiens
  misc_feature 176: k=g or t
  misc_feature 236: n=a, g, c or t
  misc_feature 325: m=a or c
  misc_feature 328: m=a or c
gggaggaggagcggagggagaagaaggttgcgagctcagcacaggctccggcgctggctcccgcagctgagtttgggagatgtctaagtgattttttttttttcccggaaggcaaatggctggcgtggaagcacaacccgctttcactcttcgaatttgtgcttagctcttttctkgtaccttgcgactcgtgaccaacatgctgtgatgtgtgccgagggaggaattggtcagcnacaacctggatcttaccacagtttggatatgactgaggctctccaatgggccagatatcactggcgacggctgatcagaggtgcaaccmggmtgatgattcagggc

SEQ ID NO: 13842 - DNA, 108 bp, Homo sapiens
agaataggattaacctggaggctaacctgggtacatgaattaggccggggaggctggtttgagagttctgctcgaggcggctgcgcagtacaacccggagcccccgcc

SEQ ID NO: 13843 - DNA, 97 bp, Homo sapiens
aggagggcccaacccggctgggtgggtgggaagtgtggctggtaacctggcagccgcggagaggtgggtgacgggcctgggctaactgagtggccgg

SEQ ID NO: 13844 - DNA, 509 bp, Homo sapiens
  misc_feature 321: s=g or c
  misc_feature 418: n=a, g, c or t
  misc_feature 419: s=g or c
  misc_feature 476: r=a or g
  misc_feature 487: n=a, g, c or t
attcattgtcttgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgcggsagccccgtcgtcaccctggagggccacaccaagcgtgtgggcattgtggcctggcacaccacagcccagaacgtgctgctcagtgcaggttgtgacnsgtgatcatggtgtgggacgtgggcactggggcggccatgctgacactgggcccagargtgcacccagnacacgatctacaagtgtggaac

SEQ ID NO: 13845 - DNA, 359 bp, Homo sapiens
  misc_feature 220: n=a, g, c or t
  misc_feature 221: r=a or g
  misc_feature 285: n=a, g, c or t
  misc_feature 286: k=g or t
  misc_feature 353: k=g or t
  misc_feature 354: k=g or t
attcattgtcttgacaagagcatcttcagcgggcgagtccccggctcctccagctccttcctcctcttcctcctcctcctccacctccggcttttgggggatcactgtcctctctcagcagcaggtcacgcacacaaagcatttaggaaattctaatgtatcaacagggctgagacccactgaactaaatgaagggattaaatgaaaagataaaagaaanrgccggcactgtggctcacgcctataatcccagcactttgggaggccgaggtgggtggatcactnkaggtcaggagtttgaagccagcctagccaacatggtgaaaccccatctctactaaaaacacaaaaakkagccg

SEQ ID NO: 13846 - DNA, 161 bp, Homo sapiens
gtgccagcgggcgtgtggccgcgggtttcgcacggtccaataagggagggcggcgtggcccggcctggtagcgacgaggacgcgccacaccgacaactccccggcttccagaccctaccagcactaccctaaccctcagccgacagtctcagccccaccga

SEQ ID NO: 13847 - DNA, 406 bp, Homo sapiens
atgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagccccc

SEQ ID NO: 13848 - DNA, 118 bp, Homo sapiens
ggtaccatatagcgtggaagagtgagttttgtgtgatggagtgggaccaggctctctgatccaaccctctgctagcaactcggctgtcggtggggtggcgcgcgcgtattctcacgga

SEQ ID NO: 13849 - DNA, 207 bp, Homo sapiens
  misc_feature 139: s=g or c
attcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcasttccgtgtttgctgcgcccgcactgcgatttacaaccctgaagaatctccctatccctattttgcccc

SEQ ID NO: 13850 - DNA, 340 bp, Homo sapiens
cattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaa

SEQ ID NO: 13851 - DNA, 235 bp, Homo sapiens
  misc_feature 106: w=a or t
  misc_feature 213: k=g or t
aaaagcgtcagtgtgaagggaaggctaaggacgcatcggtgctggagagttgagaatatgccttcccctccacccccaacccagtcaccttatttgaaaaaaaatwaaaaaacaccttttatttaaaaacctaaccctggaagtttgctcgggaaggcattctcttcctcttcctccagctgcctgaaaatcatatgcgtggtttttcctgtktcctgctctgtagctgacatca

SEQ ID NO: 13852 - DNA, 198 bp, Homo sapiens
  misc_feature 106: w=a or t
  misc_feature 108: m=a or c
aaaagcgtcagtgtgaagggaaggctaaggacgcatcggtgctggagagttgagaatatgccttcccctccacccccaacccagtcaccttatttgaaaaaaaatwamaaaacaccttttatttaaaaacctaaccctggaagtttgctcggtaagtgttttttcattttctttccctgctttcctcttctttttccc

SEQ ID NO: 13853 - DNA, 234 bp, Homo sapiens
  misc_feature 4: r=a or g
  misc_feature 17: y=c or t
  misc_feature 232: r=a or g
  misc_feature 233: m=a or c
agartgcaccggcagtycgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaarmg

SEQ ID NO: 13854 - DNA, 232 bp, Homo sapiens
  misc_feature 98: y=c or t
accggaaagccggggaaatggccatggtgcggaggactcgctggctgatcaggctgccaatgaatggggcaggagtggcaaagaccccaatcacttcygacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 13855 - DNA, 82 bp, Homo sapiens
ttttcctgcaaccgaatgcaccttggttccctgcaggacaggctggagcgggagtctgttttagaggagcaggcacgtagga

SEQ ID NO: 13856 - DNA, 193 bp, Homo sapiens
  misc_feature 186: n=a, g, c or t
  misc_feature 187: n=a, g, c or t
  misc_feature 188: k=g or t
aggtgacagccgcggggctccgagccgccggcagcccggacgcaccgggagagcgagaggtggaggccgcggacattttggtgccaagcgaaccgagccggggcgccgggagctattgggacctgcggaagcctggctacagataagggaccaaaatgactgactcaaaatatttcaccacgaccnnkaaagg

SEQ ID NO: 13857 - DNA, 242 bp, Homo sapiens
  misc_feature 10: k=g or t
  misc_feature 11: n=a, g, c or t
  misc_feature 12: n=a, g, c or t
  misc_feature 33: w=a or t
  misc_feature 129: r=a or g
  misc_feature 130: s=g or c
gtgtacaggknnggtcctggatattcgcgccgwacccagcactccggttcgacggggctgcagtttgcagggcccggataaccgaggcagtggcccctcccgcgtccccaggtttcaaggacgctaggrstctccgcggccctgaggcttcgcactggggagtggggccgccaggatggacgtgttcatgaagggcctgtccatggccaaggagggcgttgtggcagccgcggagaaaacca

SEQ ID NO: 13858 - DNA, 262 bp, Homo sapiens
  misc_feature 127: n=a, g, c or t
  misc_feature 220: r=a or g
  misc_feature 253: n=a, g, c or t
acatacacaaaggcccccagcacaagagaactacgcagagctggagggagtccatggactgtcccacggcacactagaatctatcacctctgtcccttctccatgctcccaactgcaaagggagganagaggtggtgtctttgaggtttttgcatttctgacaatcaaccgatggctccacctggacctgccaaccccgccaagcagtcgtggacccagragcagactccctggcctgccaaactatccttanaaaacccta

SEQ ID NO: 13859 - DNA, 164 bp, Homo sapiens
ataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggcc

SEQ ID NO: 13860 - DNA, 305 bp, Homo sapiens
ggaatgctcgaagtatgcacacgttcccaaaagtagacctccttcaccgccggaggagcatacatcaccccgtggcagccgtccaccttctcaggcgtttcgtaaccgagtaaactgagagctgggaacagccctctattaagtagcccgcggcgcggagtctctttccacttggctaaggcgaaccgccccagacgcgtccgcgcgccggcagctgcaggctcaggccatctccagtcttcctgccgcgcccgcctctcctcctgggattctcctcctcctcctggacttccccgcagctgccc

SEQ ID NO: 13861 - DNA, 352 bp, Homo sapiens
  misc_feature 65: n=a, g, c or t
aagagccacgcggcacgcccgggaggctttctctggctggtaaccgctactcccggacaccagancaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctaggg

SEQ ID NO: 13862 - DNA, 171 bp, Homo sapiens
  misc_feature 133: s=g or c
  misc_feature 134: r=a or g
aacctgtggcgcgctccgcggttccggcgcctgaagttttagctgcggtggcggcggcagtcgggaccgactgcaagatgtcatttgtcagagtgaaccgctgtggtccccgagttggtgtaagaaagacacsraaagtaaagaagaagaaaacttcagtgaaacaagaat

SEQ ID NO: 13863 - DNA, 326 bp, Homo sapiens
  misc_feature 128: r=a or g
  misc_feature 246: k=g or t
  misc_feature 278: k=g or t
  misc_feature 279: s=g or c
gtcgtggcgacggtggcggcgagcggcgtcagagcttgagggggggttgacggcttctggcgggtggcggtgttgaaggcgagagcttgcttggcccgtgtcgcttctgtcccaagaaccggacggaragtgagggcacgagggtcgctgtcgggggctgtcgtcttccacgtacacgtcgtcgtgaggagcgcagtccggactcttcccgcaacccctccggctccctttccgcacgcctcgagkcggcggcggccaccgagacagcagcgcacctksccccatcccttccccttatcccccagcccaaaagggcccggtctgcg

SEQ ID NO: 13864 - DNA, 287 bp, Homo sapiens
  misc_feature 250: s=g or c
ataaaagcctagtggccattgtgttcgctgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcastcccagccgcccagacacatggccccaggccaagcac

SEQ ID NO: 13865 - DNA, 353 bp, Homo sapiens
  misc_feature 143: w=a or t
  misc_feature 227: n=a, g, c or t
  misc_feature 303: w=a or t
  misc_feature 304: w=a or t
gactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgawtgtttcgctggtcctgttgatgcctggcccctgtgatgggctgtttcgctccctatacagaagtgtttccatgccacctaagcnagactcaggacagccattatttctcaccccttacattgaagctgggaagatccaaaaaggtaagtaagtttaattwwatcagaaaaccactggcatgagttcaacagtttctcttttttttttttt

SEQ ID NO: 13866 - DNA, 151 bp, Homo sapiens
  misc_feature 105: r=a or g
  misc_feature 106: r=a or g
aattaaataataaaacaatccttaagtctgatttggagagagctcgagcggggtccagagggtggaaccggtgaatttttcaacttccaagttttgcaacgaaarraagcaagagagggagggaaaaaaaagagcctagagcagaaaagag

SEQ ID NO: 13867 - DNA, 203 bp, Homo sapiens
gtccgcgcccgctctcggcgcgacgtctccagccatgaaccggtttggtacccggttggtgggagccacggcgacttcttcgccgccgccgaagccgcagcaatgaaaacctcgacaaaatagatatgtctttggatgatatcatcaagttgaatcgaaaggaagggaagaagcagaattttccaagactaaatagaagactc

SEQ ID NO: 13868 - DNA, 212 bp, Homo sapiens
  misc_feature 14: s=g or c
acttagggcgggasccggcgagggcgccggtgctttgttctgtctgaggccaggaagtttgaccgcgctgccatgccgaaccgtaaggccagccggaatgcttactatttcttcgtgcaggagaagatccccgaactacggcgacgaggcctgcctgtggctcgcgttgctgatgccatcccttactgctcctcagactgggcgcttctgag

SEQ ID NO: 13869 - DNA, 169 bp, Homo sapiens
  misc_feature 26: n=a, g, c or t
actcactgctttctaggactggggangatcccctggctctgtgctgttccccagtgggccgttgttcagtgtcctgcttttctttgttttctgtgtgtcaggttgtttccttggttaatcctaatgcgagtacttgcatgtttcagttgaaggtattgtttttactcgc

SEQ ID NO: 13870 - DNA, 351 bp, Homo sapiens
  misc_feature 26: s=g or c
  misc_feature 28: n=a, g, c or t
  misc_feature 30: n=a, g, c or t
  misc_feature 115: r=a or g
  misc_feature 184: r=a or g
  misc_feature 233: s=g or c
  misc_feature 296: m=a or c
  misc_feature 297: s=g or c
  misc_feature 305: s=g or c
  misc_feature 306: s=g or c
ggctaggaaagacgtccgttgaggastngnttgccctttctgtgtaagctgtgagcgtaggcggccctgagggggtgtgttgcaggggtttccaagcccagcaccagcacccttrcccttttccatcaggggttcagcctagggtccccgctggtgggcggctcccgagtcttggagaagagcrcgagaacctagcaccgcccccgaagtgcggagaccccctgggcaggctsaaagatggcggcggcgtctgtctctgcggcttctggttctcacttgtcgaacagctttgctgmsccatcaasstctaatggaagcatggttcggcattcttcatctccatatgtagta

SEQ ID NO: 13871 - DNA, 446 bp, Homo sapiens
  misc_feature 374: r=a or g
attttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcagcatccccgactttcgctctccrtccaccggcctctatgacaacctagagaagtaccatcttccctacccagaggccatctttgagatcagctat

SEQ ID NO: 13872 - DNA, 193 bp, Homo sapiens
  misc_feature 29: s=g or c
gcttcctggccgagggcgggcgagcggasctgctttcgcagcgatcgcgagcgtgtggcgattgcttctgtctgttatttagatatggaagctgaggggatgcacagaggctgccagaacctaggtcagggtctcgctcggtgctgaccgcccccggggtcgagtaggcgatggggagcccgaagctcaagga

SEQ ID NO: 13873 - DNA, 289 bp, Homo sapiens
  misc_feature 29: s=g or c
gcttcctggccgagggcgggcgagcggasctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttccacaggagaccgcgccggtggccggagctggtgcctgcggcgggtggggatgagcgccgggtggctgctgctggaagatgggtgcgaggtgactgtag

SEQ ID NO: 13874 - DNA, 236 bp, Homo sapiens
gtgcttccgggttctggtgtaggagcggcgtcttctcgcgcggatggtgaagctgaatttggtacgctggaccctcggacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgtaacc

SEQ ID NO: 13875 - DNA, 125 bp, Homo sapiens
tcagaattccttctcttttcttctgatacagattttagttctgaacctagttctgtaatcattggcttttctccagttacaagttttaattcctttacccctgttctatttcatttcagaaacca

SEQ ID NO: 13876 - DNA, 117 bp, Homo sapiens
tatttttccttcattagtttcccattctgttgtatttatttaatttttatttcattttccagacctaagtcaatgttagtctaccactgtacgtctggtaacctcaatccctgcaac

SEQ ID NO: 13877 - DNA, 274 bp, Homo sapiens
  misc_feature 223: r=a or g
agacgactaagctgcagtgaaaaacatgtcccagttcatcggtgaacagggagtagaatatggacagtattgaataatgccagatactaaaggaagaaaacgtgcgagaaaccctcttgttatacaggagtaacattttcttagccccatcttcgtatggtgccgtacacctgaaatgaaactagatatgtctttaatttgaagtcaacgattatgttacaarataagaaaatcgagtcgcttaaaaatcaaatgccaaggtcacacagcaggt

SEQ ID NO: 13878 - DNA, 342 bp, Homo sapiens
  misc_feature 88: y=c or t
  misc_feature 89: k=g or t
  misc_feature 92: y=c or t
  misc_feature 103: k=g or t
  misc_feature 109: s=g or c
  misc_feature 277: y=c or t
tcaagactgtttccacactgtggaagctttgtactttcactctgctcaataaagcctgcagctttttctcactctcagtccatgtctykttyactcactggtkgtcagsttccacaccatttctttggtgtggcttggcaagaacctcaggtgttacatcttggcgagccagacaggagactccagaaaaggatcaaagccatcaagctacaaatgatcttacaaatggaacctcaaatgagctcagctcacggcttctaccgaggacccctggatyaacccgctggtcctcaattaccctagaaaattcccctctggaggacaccaaactgcagggccctt

SEQ ID NO: 13879 - DNA, 175 bp, Homo sapiens
atttgtgttgctgaatttcgaagagtgatggtgggagtgtgtgtggtgggggcagtatcaacctcatccttcccttgaccgagacctttcactgctcctggactttcagggtgtgctatcctttgcctccccccaacaacctgtctgctgccctaaaaaaaaaattaaaaaaaaa

SEQ ID NO: 13880 - DNA, 139 bp, Homo sapiens
tagggaaaatttgaacaaaaagtagttcccaatttgtgggatgcaggattatttttaggattatggagagtggtggttgtgttcaacctcatctacctcttggttacttccccttaaccaccccttcctatctactgag

SEQ ID NO: 13881 - DNA, 362 bp, Homo sapiens
  misc_feature 116: n=a, g, c or t
  misc_feature 118: y=c or t
  misc_feature 119: n=a, g, c or t
  misc_feature 122: k=g or t
  misc_feature 123: n=a, g, c or t
  misc_feature 124: y=c or t
  misc_feature 131: n=a, g, c or t
agtgttttccattttctcagcaacctccagaagttgagtgcagggggatagtgctggccggtgtgtctgggtttcgtggggttggtttgtgtttgcacaggtttcactgctgtgtntyntcknyccagtgncgaagtgccagagggtggactggtccccaaatctctgtaccggactgcagaggagctggagaacgaagacctgaagctctggactgagaccatctaccagtctgcaagcgtcttcaaaggagccccacatgagattctcattcagattgtggatgcctcgtcagtcatcacttgggatttcgacgtgtgcaaaggggacattgtgtttaacaatctatcactccaagaggc

SEQ ID NO: 13882 - DNA, 134 bp, Homo sapiens
attttgaagttcgccctgtcagtagcttctcggggttcagaacctccatctggacgcccattcacttttaccgctccgatccgttcctcctcacattcaccttatccgcccgcacagtcagaccacagtcaccc

SEQ ID NO: 13883 - DNA, 291 bp, Homo sapiens
  misc_feature 219: r=a or g
acaggataatacaagaaggaaccactgcaagtgaaatccagccaccagtaatgccgagaggccaggcctgtgcctcccaaaacctgctcctccgcaggcttccccggcccatctccagagcgccctcctctcaccactttacataaacgaatgtacccaagatcccccatcagttttccatgcagctgccagagtgccaccaaagcaaacctcatctcragactctgtggccaggccctcacaacctcctgccaggctctcgctacctacccatcaacagcaagactccca

SEQ ID NO: 13884 - DNA, 446 bp, Homo sapiens
  misc_feature 225: n=a, g, c or t
  misc_feature 226: n=a, g, c or t
agtcgtggtttcctgcgtttgtagatggaaggaagaacttgtgtgcttagacctgacgctgggaggagatgctgccacctaggttacttgtaggaccctatacggcaacctcctttgccaggaactatttataaacatcctgcaggaaaatgagtctatatgtcagaatacacatttcccaccttgcccaacagtagaaaaacataagaagagaaaaacattaannaatgacaaggaagttaatggaagtcagcaatgtgatggtgtttggaggtggagccttcagaaggtaattaatgcccttgtaagaagaggccagagagcttgcgcaccttcttcctgccatgtgaggagccaagaagccggctgtctgcaacctgcaagaggaccctcactagaagctagccatactggcatcctcatcttggctttccaacttccagaac

SEQ ID NO: 13885 - DNA, 166 bp, Homo sapiens
atatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggag

SEQ ID NO: 13886 - DNA, 413 bp, Homo sapiens
  misc_feature 127: n=a, g, c or t
  misc_feature 157: k=g or t
cttgagggaagagagagaccttctcatattgttttatattgttttatactcagtacctgttttaagaaaaaaacaaggaagtgaaatcaaagacaggcagcccggcaccaggcctgaaaccagcccntggggcctgcctggcctaaacctagtagtkaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaag

SEQ ID NO: 13887 - DNA, 347 bp, Homo sapiens
  misc_feature 125: m=a or c
  misc_feature 246: s=g or c
tcagatctgaacctgatttgtgtgtgcaccgcgtctccagcgatcccggatccactgcgctgccaggggcctgggggtgggtccttgctgtctctgcgacgacatccttacgtttcggcactctmatgctgggtttgtgcgtgtgtgtctgcttagcggtctagcgggctgttaggctccctcgcccccagctccttggctcgctcagctcctccaccgcagcccagcagttagacgcgcgcgcascagctccccacgagatggaacagaccgaagtgctgaagccacggaccctggctgatctgatccgcatcctgcaccagctctttgccggcgatgaggtcaat

SEQ ID NO: 13888 - DNA, 421 bp, Homo sapiens
  misc_feature 135: m=a or c
  misc_feature 410: s=g or c
  misc_feature 417: s=g or c
  misc_feature 418: m=a or c
  misc_feature 421: n=a, g, c or t
aggcattcggccacgctttgaggaaagaaggggcgcaaggttggtgggaccgacccttgggaaccgggcggccgcctggcatgatgggagttgtagttcgatgctggtttagggtttcaggcgtggaggttccamaatccgaggtttgatttcagcctgcccttgccagtgcctgggccgctgggagccgttattggctgccgttaaggaccgttacgtttcccgggtaagtgaaagggcctgaggccgcgggtgctacctgcctggagccggaatgccccaggccttcttagagtgggcttttccgcaagaagcctagttgactcctggccgccttcctcactcgggagtctgggcaacctgcggtcattggcagttcaaggtctcatgagaggcagtggatttttttstgcgaasmtgn

SEQ ID NO: 13889 - DNA, 130 bp, Homo sapiens
ggctggttttctccgcgggcgcctcgggcggaacctggagataatgggcagcacctgggggagccctggctgggtgcggctcgctctttgcctgacgggcttagtgctctcgctctacgcgctgcacgtg

SEQ ID NO: 13890 - DNA, 136 bp, Homo sapiens
agttcccggcggcccgcccgcgccgtgctggactccaccaacgccgacggtatcagcgccctgcaccaggcctgcattgatgagaacctggaggtggtgcgcttcttggtggagcagggcgccactgtgaaccagg

SEQ ID NO: 13891 - DNA, 477 bp, Homo sapiens
  misc_feature 126: n=a, g, c or t
  misc_feature 128: n=a, g, c or t
  misc_feature 257: n=a, g, c or t
  misc_feature 269: w=a or t
  misc_feature 270: n=a, g, c or t
gatttatcctcatttgatttggccagaaagtaggtaatatgcattgattggcttctgattccaattcagtatagcaaggtgctaggttttttcctttccccacctgtctcttagcctggggaattnanggagaagccttagaatgggtggcccttgtgacctgaaacacttcccacataagctacttaacaagattgtcatggagctgcagattccattgcccaccaaagactagaacacacacatatccatacacnaaaggaaagacwnttctgaaatgctgtttctctggtggttccctctctggctgctgcctcacagtatgggaacctgtactctgcagaggtgacaggccagatttgcattatctcacaaccttagctcttggtgctaactgtcctacagtgaagtgcctggggggttgtcctatcccataagccacttggatgctgacagcagccaccatcagaatgaccc

SEQ ID NO: 13892 - DNA, 446 bp, Homo sapiens
  misc_feature 255: w=a or t
  misc_feature 259: y=c or t
tctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccawtgtycctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatac

SEQ ID NO: 13893 - DNA, 359 bp, Homo sapiens
  misc_feature 294: n=a, g, c or t
  misc_feature 305: y=c or t
  misc_feature 307: n=a, g, c or t
  misc_feature 327: m=a or c
gactgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagtgaggctccagctgcgggactactgcgcccaccacctcatccggctgctcaagtgcaagcgtgacagcntccccaacttycnggcctgcaagcaggagcggmacgactgggactactgcgagcaccgcgactat

SEQ ID NO: 13894 - DNA, 408 bp, Homo sapiens
  misc_feature 3: n=a, g, c or t
  misc_feature 374: s=g or c
aanttttccggttagccttcggggtgtccgcgtgagaattggctatatcctggagcgagtgctgggaggtgctagtccgccgcgccttattcgagaggtgtcagggctgggagactaggatgtcggacacgtggcagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtgccctaagcccagcacagcttcagcagttcctgaattagctacagatcctgagttagagaagaagttgctacaccasctctctgatctggccttaacattgccactgatgc

SEQ ID NO: 13895 - DNA, 542 bp, Homo sapiens
  misc_feature 123: k=g or t
  misc_feature 486: n=a, g, c or t
aaaaaaccatctctactctggtcaacaccgggcaactgaaccattcctgcacgttactttttaacgtagctggcgccattcccgacccatctttatagtggccagaaagccaagaacgtaagkgttctacacaatagggcgccttcaaattttttactttagcaacgtgatcttcctttaaggggaagtatgttccctcctagaaacgctcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaaggtgagcagtctgggtcggtagcgaaagcgnagaccttagctgaccccgcagctgtctttctctttgttaacctcaacacatcgcgc

SEQ ID NO: 13896 - DNA, 483 bp, Homo sapiens
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccacgttttgttgacccattcacccatcaagggacccaagttgcttccacattttagctacagtgaataatgctactagaaacataagggcacaaagctgggtctgtgacaccctgcttttaattcttttgtcacaagccctgttgttttaaccttgctgtgtgagcggtggcagagatgtgagttaccctgagttaccggctgtgaatctgtaagggtcacagcaacttcagtccttgc

SEQ ID NO: 13897 - DNA, 375 bp, Homo sapiens
ttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactc

SEQ ID NO: 13898 - DNA, 339 bp, Homo sapiens
  misc_feature 219: s=g or c
aagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctsagggcggtggtggctgggggcagcctcatggtggtggctgggggcagcctcatggtggtggctgggggcagccccatggtggtggctggggacagcctcatggtggtggctggggtcaag

SEQ ID NO: 13899 - DNA, 137 bp, Homo sapiens
ggctgtgttaaggttcttttattcccaggagccagctatgtgcctggaaaaagaatgcattcctgcacttctcttgcttaacctttcattccaatgtgaaaaaagagtttcagggccaggaaagtgacagacacaca

SEQ ID NO: 13900 - DNA, 410 bp, Homo sapiens
  misc_feature 214: r=a or g
  misc_feature 215: n=a, g, c or t
  misc_feature 237: m=a or c
  misc_feature 380: s=g or c
agcccgctcgagtttcaatgcgcgttgttgcttaacgaagcagagtcctacacactgtctgctgctctcctgatcatggcttctccgagttctttcacctactattgccctccatcttcctcccccgtctggtcaagagcccgctgtacagtctgaggcccgagcacgcgcgagagcggttgcaggacgactcggtggaaacaagtcacgtccrntagaacaggcaaaagtagaagmaaagatccaagaggtcttcaggttcttacaagttcaaccaccttgtaccaaggcttgttttgcagagggagaagcacttccattatctgaaaagaaggccttcgacaaactgacagatgcctaatgagtgtctggatgccagscgcccatggctctgctattggatcctgcac

SEQ ID NO: 13901 - DNA, 277 bp, Homo sapiens
  misc_feature 71: n=a, g, c or t
  misc_feature 72: n=a, g, c or t
  misc_feature 73: s=g or c
ccttatttacattcacactaaattttggtgccttccagcacattagtggcaggcacccttctggaacactnnscaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccc

SEQ ID NO: 13902 - DNA, 339 bp, Homo sapiens
  misc_feature 162: y=c or t
  misc_feature 179: w=a or t
aacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttatttttttttttyctctctctctctctctwaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcaggg

SEQ ID NO: 13903 - DNA, 431 bp, Homo sapiens
  misc_feature 157: k=g or t
  misc_feature 158: n=a, g, c or t
  misc_feature 159: m=a or c
aaatcaagtccgcggggcatggaggctgctgtcgctgcagcagctcagcttgcccggggcgggaactccccctttctcctttcgcctccccagcacccacaccctgtctcccccttaattcttccctggataatagcaccctaacgacaacagtcaknmtaatagggttagaacgacaggggaggaaaactcaacagcctaaatatctctgaaaactgcatcgcaaaatggaagaaagagggggtcccactactgtttcaaaaaagagccatggaagtcaaatgctgaggatggtggcatcataggatgaatggagctgggttcttgaaacactgcctggaggaaagacagcaaaaatgcctcatgaatccaactggactgttaggatgctcacccttggagaccagcaacaatgtgtgcagaaacccagg

SEQ ID NO: 13904 - DNA, 423 bp, Homo sapiens
gcattcgctccagggttttgggaccctaggttgcggagtccttacctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactacc

SEQ ID NO: 13905 - DNA, 120 bp, Homo sapiens
aaaaagcgacttaaacctactagatttggcagctggaaaggaggatagtggacatgtgatgtcacattactaaagaaagcatcaaaaaaactgcatcggtggaaatgaggacccaaggta

SEQ ID NO: 13906 - DNA, 139 bp, Homo sapiens
  misc_feature 130: w=a or t
ggaggaaggcgctggcgggcagtgatggcggctggtgatggggacgtgaagctaggcaccctggggagtggcagcgagagcagcaacgacggcggcagcgagagtccaggcgacgcgggagcggcagcgwaagggggag

SEQ ID NO: 13907 - DNA, 382 bp, Homo sapiens
  misc_feature 195: r=a or g
  misc_feature 255: s=g or c
gagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgarcggctcctagaccggcaggcggcggccttcaccgcttcagtgcaacacgtggaggcggastgtcagctcagatccgctacctcacccaggtggccacagggcagccccatgagggctccagctactcttcgaggaaggactgtcagatggctctgaagcgagtggactatgccgcctcaagctcagt

SEQ ID NO: 13908 - DNA, 349 bp, Homo sapiens
agtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggtgagtcccctcctgctctggggtctctccgggggttgcggggcccaggcagggctcacagggttgggtggagcttggtttctcacttggaggctccggaaccaac

SEQ ID NO: 13909 - DNA, 45 bp, Homo sapiens
tccgcgccgcgcggacccaacgagcccgcgctcagactccccagc

SEQ ID NO: 13910 - DNA, 341 bp, Homo sapiens
  misc_feature 104: r=a or g
  misc_feature 125: s=g or c
  misc_feature 128: s=g or c
  misc_feature 132: n=a, g, c or t
  misc_feature 146: n=a, g, c or t
  misc_feature 238: k=g or t
  misc_feature 242: k=g or t
  misc_feature 244: w=a or t
  misc_feature 245: k=g or t
  misc_feature 295: m=a or c
  misc_feature 301: m=a or c
  misc_feature 322: n=a, g, c or t
  misc_feature 323: m=a or c
  misc_feature 338: y=c or t
  misc_feature 341: w=a or t
cttacctggggcagtgtctgcctggtggccactagagacagcccagcctgggccatggaagaaaacccgaccttggaatcagaagcctggggctcctctagggrgtggctggccccccgggaggscasaggnaggcccatcgctgncttctgtgctgaacgagctgcccagtgctgccacccttcggtaccgagaccctggggtgctgccttggggggcgctggaggaggaggaggakgatkgwkgaaggagcagaaaggccttcacagaagtcacccagacagagctgcaggamcctcamccttcccgggaactgccctgnmccatgcaggccagayggw

SEQ ID NO: 13911 - DNA, 199 bp, Homo sapiens
tggggaggatgacgaggagacgggagagtatgccactgacgaggatgaggagctgagccccacgttcccgggtggtgagatggccatcgaggtgtttgagctagcggagaacgaggatgcactgtcccctgtggacatggagcccgagaagctggtgcacaagttcaaggagctccagatcaagcatgcggtcactgag

SEQ ID NO: 13912 - DNA, 134 bp, Homo sapiens
gtccttggcagggcacgtgcgggaggaagtggaactccctgtacgcgcggccctagtcggctcctcaacgtggagcgatgggaggccttgagaagaagaagtatgaacgaggctcggccaccaactacatcacc

SEQ ID NO: 13913 - DNA, 114 bp, Homo sapiens
ggatggggagagaagagggatagggccagcaaggcagggatcgaacgagtgtctggcagccgggagcccagcgaagagagcgagcaagcttaggaaaacgagcgaagtaaaggg

SEQ ID NO: 13914 - DNA, 486 bp, Homo sapiens
  misc_feature 25: y=c or t
atgtcagtgtgacaactgatcgggygaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaaatgaattactcaatctcctatgaccatctatacatactcc

SEQ ID NO: 13915 - DNA, 163 bp, Homo sapiens
  misc_feature 58: s=g or c
  misc_feature 145: n=a, g, c or t
ctttccagcctcacgcccgtgggctgcagttggaacgatggcggcggcagctgccgcsggggcctagcccggggttctggacctggggactccccagaagggcccgagggggaggctccggagcgtcggcggaaggcgcacgggntgctgaagctttactacg

SEQ ID NO: 13916 - DNA, 116 bp, Homo sapiens
agatacgtggctgccgtctgtccccgctgaggaggtgcagcagccggagatggcggcggtgctgaacgcagagcgactcgaggtgtccgtcgacggcctcacgctcagcccggacc

SEQ ID NO: 13917 - DNA, 342 bp, Homo sapiens
  misc_feature 203: s=g or c
  misc_feature 312: s=g or c
aagcagtatttccaggaggctgtgagggggagaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctstaccccaagtccctctccaggcatgtgtcagtgcgtacctctgtggtgacccagcagctgctgtcggagcccagccccaaggcccccagggccggccctgccgcgtaasacggcggatcgaagcgtgaggatggcatca

SEQ ID NO: 13918 - DNA, 170 bp, Homo sapiens
  misc_feature 86: s=g or c
agtatttccaggaggctgtgagggggaggtccaacgcagtccagctgacaaggatggaatacgccatgaagtcccttagccttctstaccccaagtccctctccaggcatgtgtcagtgcgtacctctgtggtgacccagcagctgctgtcggagcccagccccaaggcc

SEQ ID NO: 13919 - DNA, 157 bp, Homo sapiens
gccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccc

SEQ ID NO: 13920 - DNA, 155 bp, Homo sapiens
  misc_feature 118: k=g or t
tgtcttcgtccgccgttaggttgcggctgctgtggttgccaacgctacactgggtagaacgccagacaggggccacttttcgagaccgagtagagacggacagtgaggaggataggakccacttacacgcttttatgtcagccgcgatcccaccc

SEQ ID NO: 13921 - DNA, 167 bp, Homo sapiens
ccctaccacccttgccatgtcacctcccagaccttcagattccaggtacctcacctttgcctgcacatggaagccacctggaccatcggatcccagccaacgccccactgtctttgtcccaggagctcccagacactcaggttccagctacacacctttgcccctac

SEQ ID NO: 13922 - DNA, 169 bp, Homo sapiens
  misc_feature 61: r=a or g
  misc_feature 62: n=a, g, c or t
aggaacttcctgagcgcgggcagtggcgggcgggacttgggggggcagggggcactgttcrnggtagaggagggggcgaacgccgaattccggcccgtagtccaggcgtcccctgccagtgccccacatcctcctcggcgcgatttttttcccgcgcgggcaaggttgg

SEQ ID NO: 13923 - DNA, 434 bp, Homo sapiens
  misc_feature 20: k=g or t
  misc_feature 365: n=a, g, c or t
  misc_feature 410: n=a, g, c or t
  misc_feature 423: k=g or t
gaggaagatcgaccagagckctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagaagagagtgatgtggaaaagtctaaatatttgattatgaccagacaattaacaaacggaagagccagaatttgggcactaatttgtctgtctgtctggaaaaaaaaaacaancaaacctgcatcatgagatcacctgctcactttggactcaaaggnatctgaaattackgtttaatatta

SEQ ID NO: 13924 - DNA, 205 bp, Homo sapiens
gaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagagg

SEQ ID NO: 13925 - DNA, 158 bp, Homo sapiens
agttaccgagtttctaaggcctcgtcccctgacgggaaggcggcgttggggggcggctgggtttacccttcgagatctctgatggatttgttgactcctctgtgggagaaaggcttggtctactgcaggtgttaacgctaagccaggctggagctgcg

SEQ ID NO: 13926 - DNA, 394 bp, Homo sapiens
  misc_feature 110: s=g or c
  misc_feature 130: y=c or t
gagatctgtccagctgcggtgagaggaacgctgaatcgccgaagagaattggctgcgcttccttgtttgtgagctagaattagaatggcgatcagtccacgaagcgatgsaactttctccagtcagaaaycaacaccttcagagagtcctcgaacaaagaaatttccactaactgaagaggaaatattttatatgaattgtagagctgcctacttaactgtcttcaaaagcagcttggaaaacattatttctaaagatcaactttacttaggtaaatttttaaaatttttaaatctttcacctttttgttgaaagttaataaataggtccgaaagactgaaattagaattaccttgttgaatcatcccagtttcttagtgaagcttgagcaatg

SEQ ID NO: 13927 - DNA, 166 bp, Homo sapiens
  misc_feature 106: n=a, g, c or t
agaaggcggcggctgtcagagctggagggccgggcaccgcggccatggagggtcaacgctggctgccgctggaggccaatcccgaggtcaccaaccagtttcttanacaattaggtctacatcctaactggcaattcgttgatgtatatggaatggatcctgaact

SEQ ID NO: 13928 - DNA, 348 bp, Homo sapiens
  misc_feature 38: s=g or c
  misc_feature 226: n=a, g, c or t
  misc_feature 304: s=g or c
  misc_feature 305: m=a or c
acgcgtctcatccatggcttccgcggactcgcgccggstggcagatggcggcggtgccgggggcacttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcntttgtgattccgggaaaacgttgctctttgtcaggttgttaacaggcctttatagagacactcagacgtccattactsmcagctgtgctgtatacagagtcaacaataacaggggcaatagt

SEQ ID NO: 13929 - DNA, 198 bp, Homo sapiens
ttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttaca

SEQ ID NO: 13930 - DNA, 105 bp, Homo sapiens
tttcatcaccttgtttttttgaacactgtataccctctgtgaatgtaaaaacatttgaagagtatcaagcactccacgggtagtggcagttgcaagaagtctggt

SEQ ID NO: 13931 - DNA, 246 bp, Homo sapiens
  misc_feature 233: y=c or t
attccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagtyggggaagggaagg

SEQ ID NO: 13932 - DNA, 194 bp, Homo sapiens
ggattatgacgctggattatgacgcaggcagtgggcgcggactctgcggttcgcttgactgacggcgcactccgggcctagccacagcagcaacggcagaggccagcgggcgaggtcaagatggtggctccgcgggcgggggaggcagtggagggaggaggagtcagaccttagccagccggaaacaccgaaac

SEQ ID NO: 13933 - DNA, 88 bp, Homo sapiens
agggggcctggagggaacggcagccagctgctgaggttctgctctctggtgctgaccttccttccccctcccctctgaacttcccacc

SEQ ID NO: 13934 - DNA, 253 bp, Homo sapiens
  misc_feature 95: s=g or c
  misc_feature 133: n=a, g, c or t
  misc_feature 144: k=g or t
  misc_feature 237: w=a or t
  misc_feature 238: k=g or t
  misc_feature 248: k=g or t
cccaggctgtcgccgggtgtgcagcggcgtcgcggccagtagagggattctgggtaacggcccggacccccggctgggcttctggctcggcgcasaggttccattcacgccaagtctgttggcagtggcagtngtagggccaakggcggtttgtagggacccggagcagccggacatggaacaaccgtggccgcctccgggaccctggagcctccctcgggccgagggtgaggctgwkgaagagagtkacttc

SEQ ID NO: 13935 - DNA, 153 bp, Homo sapiens
gcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacct

SEQ ID NO: 13936 - DNA, 375 bp, Homo sapiens
  misc_feature 138: k=g or t
  misc_feature 158: s=g or c
  misc_feature 303: m=a or c
aagcctcggctacttccgagggggtgagtggcttcaccgccggtcccttgcagcgctgccttcgatctctccacatctcggtggcgcgggatctcaagatgcgcctccacctgctcctgctgctcgcgctgtgcggtkcaggcaccaccgccgcggastcagttacagcttgcgtggcaactggagcatctgcaatgggaacggctcgctggagctgcccggggcggtccctggctgcgtgcacagcgccttgttccagcagggcctgatccaggattcttactacagatttaatgaccttamctacagatgggtctctttggataactggacctatagcaaagaatttaaaatcccctttgaaattagcaaatg

SEQ ID NO: 13937 - DNA, 290 bp, Homo sapiens
  misc_feature 149: n=a, g, c or t
ttgaagagtcccgccccctccatacgggaggaaacgtgtgtccctggggccctcagccaagcctccactatctttttggcccagacggatttcccaggtcacaagtggctggagacttcctcttgaaaaacatttgccgtcgtttttcnctggcagagcccctttgaccctggctaacaaggacagcctgacttggatcccactatgcaggaaggaaggcgactcttccccgcacctcttgctacgattaggacttgcgacttggtgaaaacaggaatcaaaacttgggc

SEQ ID NO: 13938 - DNA, 211 bp, Homo sapiens
  misc_feature 19: n=a, g, c or t
caacgagcccacggccgcngccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggag

SEQ ID NO: 13939 - DNA, 116 bp, Homo sapiens
agctggagcccgcgagccacggagcccacggaggagcccacggaggagccccagcgtccgaacgggcagaccccctcgagccgcgaaggagcccgagaagcagccacgatgtgcgc

SEQ ID NO: 13940 - DNA, 191 bp, Homo sapiens
acagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgag

SEQ ID NO: 13941 - DNA, 342 bp, Homo sapiens
  misc_feature 335: m=a or c
aagtcttttacatatttattatttgtaatagtttagctgtagattcttttggaattttctctataatcatatttgtaaatatcaacaggtttatttcttcatttccaatctttatcactttcgttactgttttttctagctcattgtactggctaggatctcttctataacggtgaataaatgcggtgaataagggacattcttgacttgttcccaactgcaggaggaaaattatattattaactagggtgcttgttgtgggtttcttttggggggtggaggtagatattataagattacataagttttatttctattttgctaagttttttatmatgaacg

SEQ ID NO: 13942 - DNA, 84 bp, Homo sapiens
  misc_feature 12: m=a or c
taataattatamactcttagaactggaagctacctacttttatgtgctacagcttgtcatgcaacgtatgcatgtctctctctc

SEQ ID NO: 13943 - DNA, 166 bp, Homo sapiens
agtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagag

SEQ ID NO: 13944 - DNA, 419 bp, Homo sapiens
  misc_feature 269: k=g or t
  misc_feature 270: s=g or c
  misc_feature 328: n=a, g, c or t
  misc_feature 338: n=a, g, c or t
  misc_feature 339: k=g or t
cgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggtaaaggaagcggcatgccatctcccctctgtttttcccttaggctgcccttgagttccagtccttaggcatgggcactgcggacgcgkstttagtgcctcagtggtacaatgttggtctcttagtttcttctagccgtatcgccgcngtggtgcacnkagccaccacacactagttgtgttgatctcgattggttgtgctgctgaccctcggggagggaagttgggacaaaagcagat

SEQ ID NO: 13945 - DNA, 110 bp, Homo sapiens
gtccttttatgaacgtgagcttgatactttgaaaaggtcacagctttttacagcagaaagcctacaggccagcaaagaaaaggaagctgatcttagaaaagaatttcagg

SEQ ID NO: 13946 - DNA, 281 bp, Homo sapiens
ctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctga

SEQ ID NO: 13947 - DNA, 289 bp, Homo sapiens
  misc_feature 189: m=a or c
  misc_feature 190: m=a or c
  misc_feature 203: m=a or c
  misc_feature 239: r=a or g
attagagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttmmtggcgtagaacgmcagaagccgctagtaagtcgccaagacctacagcargaattctgcaccaaagggcataaaatcttgttattttaatttgcatctgg

SEQ ID NO: 13948 - DNA, 96 bp, Homo sapiens
  misc_feature 5: y=c or t
  misc_feature 35: k=g or t
  misc_feature 36: s=g or c
ccggyagtcggcccgcgcctcccccggcgctactkscacctcgcgctcggaggcgtcacagaacgtgctcttctctccccctcccccctcccgctc

SEQ ID NO: 13949 - DNA, 136 bp, Homo sapiens
aggcaacgtggccttccagaccgctggtagtggacttgaggctgtcgggaaggaggggtgtggcctagaccactaagggccgtgacgtggtgccgctgagcttggaccccgaccagaagatagagattgaaacgat

SEQ ID NO: 13950 - DNA, 300 bp, Homo sapiens
  misc_feature 7: r=a or g
  misc_feature 67: r=a or g
  misc_feature 68: w=a or t
  misc_feature 69: m=a or c
agctgartgaatacctccgaagccgctttgttctccagatgtgaatagctccactataccagcctcrwmttccttccgggggacaacgtgggtcagggcacagagagatatttaatgtcaccctcttggggctttcatgggactccctctgccacattttttggaggttgggaaagttgctagaggcttcagaactccagcctaatggatcccaaactcaggagaatggctgcgtccctgctggctgtgctgctgctgctgctggagcgcggcatgttctcctcaccctccccgcccccg

SEQ ID NO: 13951 - DNA, 406 bp, Homo sapiens
tgccttgttaaatcgtcaacagcagcagcaccaccatcattgattgggttatggcaggaaatgctatagttagatttgctacaaattagtttagatagagagtatgggtgaaaataaggtaatcttttcagatgttgtctgataaatggaagcagtgcattcatgagcagagctgcaaaataaatgttgagtacacctttgaaacaaggttgcctaccgtgaattatagcaaacaaacggaagtattctcaaggtgtgtggaatcaataaaaaccaaagtgtcaagatgcaaagagcagtcagcttgtataggtgcccacaactactaatcataacttgataggtgtggaaagaactgctgaataccctccctcttacactgccccaactatggcactgccctaga

SEQ ID NO: 13952 - DNA, 181 bp, Homo sapiens
  misc_feature 22: n=a, g, c or t
gattgagattttgtgcacaagnacaaatcaggaaatccgagaaattgtcagatgttatcagtcagaatttggacgagaccttgaaaaggacattaggtcagatacatcaggacattttgaacgtttacttgtgtccatgtgccaggtgagtatagtatgaatgcttgtgcgttgatagagg

SEQ ID NO: 13953 - DNA, 193 bp, Homo sapiens
attgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggc

SEQ ID NO: 13954 - DNA, 647 bp, Homo sapiens
  misc_feature 140: n=a, g, c or t
  misc_feature 385: s=g or c
agacgctctgcttcgtgaccttggctctgctctgtgggcgccgccccagcctgggcgcgtccatcgtcgagtaccttctcctctgcctccccctccctctgcttctatctctctccaattgccctccctggcctgcggcngcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctgggggstgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgttaaaaattcagattgaactatcttacaaatggctcccagaagatccactccctgtgggaacacagcagttgtggaagtgaagacaggactggacccagaataagggttcaaatatgtg

SEQ ID NO: 13955 - DNA, 226 bp, Homo sapiens
  misc_feature 197: w=a or t
agtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccaggtttgattactcaggagtwggaagttcagatggtaactcagaggaaag

SEQ ID NO: 13956 - DNA, 358 bp, Homo sapiens
  misc_feature 50: n=a, g, c or t
  misc_feature 324: s=g or c
acttccgggactcagggtcgcagggaactacttccgggggagcggcgcgncggcgcgggaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagcsatcttccagctcatctgtgtgctggccatcatcg

SEQ ID NO: 13957 - DNA, 228 bp, Homo sapiens
tagacttttcttgaaagggcagaagccagctcctctcccgaatcccagaatctgacattccaggactccactaggcctgttttcctctgtgggaactagagccaaggcgagagacccgtgccagccccgaggctcccggggcccatgggcccaggcatcgggctggtacagggccccggggctctctcagcccatctgtcacccctcccccccaacacccagatgtcc

SEQ ID NO: 13958 - DNA, 99 bp, Homo sapiens
cagctaaggactgcaaaaccccactctgcatcaactagatcaaggacagtgtggtggccggcttccagtgggccaccaaggagggcgcactgtgtgagg

SEQ ID NO: 13959 - DNA, 253 bp, Homo sapiens
  misc_feature 245: m=a or c
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgamgtttacgc

SEQ ID NO: 13960 - DNA, 309 bp, Homo sapiens
  misc_feature 57: r=a or g
  misc_feature 62: n=a, g, c or t
  misc_feature 259: n=a, g, c or t
  misc_feature 296: r=a or g
agggcaatctgccggaagagtcaggttctgtgtatgtctccgcgtcttccgcggagrtttgntgcagggcctgcagcattgaactagatgtcgtccccgcagccccagaagatgggcagggctgtggcgaccgcggcgatccccctggggacctccgtagcgtcttggtcacgaccgtgctcaacctcgagccgctggacgaggatctcttcagggaccctaacctccaaaagaggtacccattggcgctcaaccgaantgctgctcaggaggtccccattgagatcaagccagtraacccatcccccc

SEQ ID NO: 13961 - DNA, 154 bp, Homo sapiens
  misc_feature 148: n=a, g, c or t
aagggacatgtgaactaggcatgaatgcaagagggtgcctggcatttttagggcactgtgagtagaccaatatggatgtttctaaaatcgccagaattggccggatgcagtggctcacacctgcagtgccagcactttgggaggccgngtgggt

SEQ ID NO: 13962 - DNA, 133 bp, Homo sapiens
tcatgttataatcatttgcttgtgtgattttaccacacactgtatccaactaggtagcattactggaaaacttatttgattttttgccaaatgggagatggctggaatattttttgtagtagagaatatgtgg

SEQ ID NO: 13963 - DNA, 240 bp, Homo sapiens
gtctgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgaga

SEQ ID NO: 13964 - DNA, 169 bp, Homo sapiens
cctcaactatttgtgtattctgaaatacaattcaaaccgggaaagcaggataaatgcttgatttcttctttttatttaaacatcttcagaataatgagttggtgtcatagcaccctcttaagatgaccaatgaggttttcttttttttcctcaataatatggactcaag

SEQ ID NO: 13965 - DNA, 329 bp, Homo sapiens
  misc_feature 143: w=a or t
acctatttccaaataagttcacattcataggtaccagggtttaggatttcaacatatctttttgggagacataattcaactcacaagaatggctttattgaaatatactgtaccacataccatatcagttcacccattaaagwatacaacttatggtttttagtatgtgcacaggtttgtacaaccatcattacaagataatttttaaaaattgtcattccccttaaaagaaactccatactcatcagtagtcactctatattttcccccttcctgctctatccctaagcaaccactaatctactttatgtctctgtatatacgcccac

SEQ ID NO: 13966 - DNA, 240 bp, Homo sapiens
  misc_feature 50: w=a or t
  misc_feature 136: n=a, g, c or t
  misc_feature 167: y=c or t
caagttttccaattcgttttactaagctagcaaaattttttataccaggwgcattaggagcttcaccgtgggaggccttcaagggcttcatgactcctgaagttataggctgactcctgggctgggggggctgggnaactcacacctttgtcctgcaggtggccatycgagaggcctatgaggcaggtctgattggcaagaatgcttgtggctctggctatgattttgacgtgtttgtgg

SEQ ID NO: 13967 - DNA, 244 bp, Homo sapiens
  misc_feature 8: y=c or t
atttagayctttgcaacctgtaatgggctcgtgaggccaggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaacccccca

SEQ ID NO: 13968 - DNA, 296 bp, Homo sapiens
  misc_feature 134: k=g or t
  misc_feature 213: s=g or c
cactcactcacgatataactcacgatttcactcacaatctcatagactcacgattttactcacgatcttacgatctctcacaatctcactcacagactcactcacagactcacgatctcactcacgatttcgckcactcatgatctcactcacagactcacgatctcactcacgatttcactcactcacaggctgacgatctcacgatctcastcacaatctcacttattcatgatctcatgatctcactgactcatgatctcactcacgatctcactcatgatatcactcacgat

SEQ ID NO: 13969 - DNA, 212 bp, Homo sapiens
  misc_feature 194: y=c or t
  misc_feature 208: w=a or t
actcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaaycccaccaatgcagwggtc

SEQ ID NO: 13970 - DNA, 703 bp, Homo sapiens
  misc_feature 663: m=a or c
gcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcamctaaattcctaactgcagacttttgcctttttctctctca

SEQ ID NO: 13971 - DNA, 302 bp, Homo sapiens
  misc_feature 120: r=a or g
  misc_feature 134: r=a or g
  misc_feature 230: n=a, g, c or t
  misc_feature 286: r=a or g
taagcacttgttggcctacagaggtgtggcaagcagagcacctcagaactcaggcgtactgcccgccgcccgagccctgcgagggccgatagcgagggtgtggcccttatctgcacccarcagagcgccggcgrggtggtcctagtggagagcagtgagcgtctgggaggctggattcgctccgttcgaggccctaatggtgctatctttgagcttggacctcggggaantaggccagcgggagccctaggggcccggaccttgctcctggtgagaggcttgtggratgtctaggagaggtt

SEQ ID NO: 13972 - DNA, 169 bp, Homo sapiens
  misc_feature 166: m=a or c
cgtaatagcatctattattactatgtaatatctcctcttatttgctttaatatagtaactcattagcagtgacataatattcatacagcagtgtttatcttcattacttgctttacttaatgaagacttaagccctttttacagccccattttctctcccctgtamgcc

SEQ ID NO: 13973 - DNA, 94 bp, Homo sapiens
tttctctgagagctgggacagacttttcttttgctgccttagacatcagaactccaggcttgctggactttagactccagaacttacatcactg

SEQ ID NO: 13974 - DNA, 418 bp, Homo sapiens
  misc_feature 383: m=a or c
agcattttgggaaagagtggaattctgggtgttaggcccgccattcgcttgactcacgccttcgccgtagcatctttcgcagcggaccgaagagaagaaaagtaggccagagccggtgaggctggggacgggcgaggggaggtcgaggcgcctgtgaggggccaggggctggagaaagacttgctgcatggaactctgcggggctcggggagggaagaaagcgggaagcttgggccacccaaacatcagcgtcgcctcactagctcctggaagtaagttcattagctttcccctcaacgtgcatgcttctcacattctgtatctctccaggtgagtgtttttcaaagcttccaggcagtaatctcgaagtcatttctgattgmctatctccttcccccaaatcctatgagtttttttt

SEQ ID NO: 13975 - DNA, 165 bp, Homo sapiens
atcctttgagggagctcagggacatttcgggattctggatttcttggtctgcaactccctgtgtgccaggcggggctgggccccgctgcggctggctggcgtttggcgctctcatcgagggagcgcttcgctttgaaatctacccactccttttttttttttttt

SEQ ID NO: 13976 - DNA, 496 bp, Homo sapiens
tagatcacgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaa

SEQ ID NO: 13977 - DNA, 202 bp, Homo sapiens
cctcccttaagctggctagcaccgtttagaactccttgtcattgcctcttctttaggggcctcccctgatgatgctgggttaggttggctgccctgcacttacttgcacagcacaacggtgtaattgctaatttgtatgcctgttacctctgcacaccgtgggcactgtgagagcagtgaccttgtccttggcttagcattg

SEQ ID NO: 13978 - DNA, 377 bp, Homo sapiens
  misc_feature 143: s=g or c
atttcaggaggactctcacaggctcccacagcctgtgttaagctgaggtttcccctagatctcgtatatccccaacacatacctccacgcacacacatccccaagaacctcgagctcacaccaacagacacacgcgcgcatasacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttccca

SEQ ID NO: 13979 - DNA, 195 bp, Homo sapiens
  misc_feature 9: s=g or c
  misc_feature 11: n=a, g, c or t
  misc_feature 57: r=a or g
agagcgcascngcacgcccagcgagttccagaggcgccagtggaagctgcggcggcrgtgtctcgcgttcggcgggatttctcttcgctccggctcggcctaggtctacgtccccagctccagccgccggctcggactcggtctctgacccccaactcggtcccctagtccggccccggctccgggccccccaac

SEQ ID NO: 13980 - DNA, 643 bp, Homo sapiens
  misc_feature 144: m=a or c
  misc_feature 150: s=g or c
  misc_feature 151: y=c or t
  misc_feature 488: n=a, g, c or t
  misc_feature 546: r=a or g
aaagaatcaaattcataggataagtcataccttaatggtggtagagcctttacctgtagcttgaaaggggaaagattggaggtaagagagaaaatgaaagaacacctctgggtccttctgtccagttttcagcactagtcttamttcagsytatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctcngccatttgggaaagtggtttctacgtcactggacaccggttctgagcattagtttgaraactcgttcccgaatgtgctttcctccctctcccctgcccacctcaagtttaataaataaggttgtacttttcttactataaaataaatgtctgtaa

SEQ ID NO: 13981 - DNA, 227 bp, Homo sapiens
  misc_feature 91: k=g or t
cccctgtgattggaggacgacaacaaacggatggtttgggctcaggaggaaaggacctgcctgatggagcccggcaattggcgggagagakagcgtgtgtaactctagggaggggagaatcaccccttagcgacatcacccccacgcgcgtgactgagactgcatcctcccatgagggtaaacgtgggaggtaaagagaccttccgctgcgtaaagctggatcgacc

SEQ ID NO: 13982 - DNA, 471 bp, Homo sapiens
  misc_feature 2: y=c or t
  misc_feature 11: k=g or t
  misc_feature 12: r=a or g
  misc_feature 13: s=g or c
  misc_feature 33: k=g or t
  misc_feature 34: y=c or t
  misc_feature 407: m=a or c
  misc_feature 410: s=g or c
  misc_feature 413: s=g or c
  misc_feature 425: k=g or t
  misc_feature 446: k=g or t
tytttctccgkrscagcttcacaactgccctgkyttcctggctactgctgctgctgtcttctcacacatagacacgcacacacaccctttctcgcacacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcmcascgsagttcttaataktgtggataagagatccatctktctcattctggatacctacttagtg

SEQ ID NO: 13983 - DNA, 134 bp, Homo sapiens
ttagttttggatcatctaggtgtgttaactctgaagtcagatgactcagtagtcaattttatgtatgtttgaatttatggttaattgtgaggccttcacacacaattattcatgtaattaatatttaatacaca

SEQ ID NO: 13984 - DNA, 360 bp, Homo sapiens
  misc_feature 29: m=a or c
  misc_feature 140: n=a, g, c or t
  misc_feature 148: w=a or t
  misc_feature 152: m=a or c
  misc_feature 153: w=a or t
  misc_feature 154: k=g or t
  misc_feature 165: r=a or g
  misc_feature 175: k=g or t
  misc_feature 180: k=g or t
  misc_feature 234: y=c or t
tagctgttttagagaactccagttaattmgaaaatgcttaactttttctgtgttcatgattataaatctaattttgttttatggttttaggtctcgtcagcctatctcggcccctctcttttcatgtcctgacaaaaacnaggttaawttcmwkcccaaccgggrtcagctttckgtcckgtaaaacttctaggccccctcttacctgcttctgaccttatgctcaagaactcycctaactctggccagagctcagctttggcaactctgaccgttgagcagctctcatcccgggtttcctttacgtctctttctgatgacaccagcacagcgggctccatggaggcctctgtccagcag

SEQ ID NO: 13985 - DNA, 150 bp, Homo sapiens
aagaactctgagaccgggagcccagctgcccaccctctggacattcacccagccaggtggtctcgtcacctcagaggctccgccagactcctgcccaggccaggactgaggcaagcctcaaggcacttctaggacctgcctcttctcacc

SEQ ID NO: 13986 - DNA, 300 bp, Homo sapiens
tttagggctattagtgattatgtctatatttatattaacatgctttttttcttcaattattttggtttacagttttagacattgtttattgacttcctgctctgcaagatgaggatttagataacttctccaactctgctttctttcatgtttcctcctaatatgatttcatgactattcacagttcaaccctatcaatgttgtaatttcaagtcttagatttgaatcttcattatttttcaacaataggaaaaatctcttacctccatatttttaaaatacgaagacagttacaccccc

SEQ ID NO: 13987 - DNA, 1292 bp, Homo sapiens
  misc_feature 16: w=a or t
  misc_feature 17: w=a or t
  misc_feature 267: r=a or g
  misc_feature 625: m=a or c
  misc_feature 626: y=c or t
  misc_feature 630: s=g or c
  misc_feature 1135: r=a or g
  misc_feature 1202: n=a, g, c or t
  misc_feature 1203: k=g or t
  misc_feature 1204: n=a, g, c or t
  misc_feature 1205: n=a, g, c or t
aaattactaattggtwwtatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgracataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcamytttscctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatrgtaggcacagaagaaacatggcaaactgctctgtgctttcaaaccaaagtgttccccccaaccccanknnttgtctaagcactggccagtctgttgtgggcattgttttctacaaccaaatctgggtttttttcttctttctttaaacatagaggta

SEQ ID NO: 13988 - DNA, 153 bp, Homo sapiens
acccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgcca

SEQ ID NO: 13989 - DNA, 440 bp, Homo sapiens
  misc_feature 31: y=c or t
  misc_feature 144: s=g or c
  misc_feature 152: s=g or c
  misc_feature 153: s=g or c
  misc_feature 166: s=g or c
  misc_feature 168: s=g or c
  misc_feature 169: r=a or g
  misc_feature 219: w=a or t
  misc_feature 329: r=a or g
  misc_feature 330: r=a or g
  misc_feature 395: k=g or t
  misc_feature 396: n=a, g, c or t
  misc_feature 421: r=a or g
gacatcatagtatatccgtgagtcaagcggytgtgggtttttggctcttgcatctgctatagttctgtctcgggtgccatttgctaactctgttctctgtgtagctgcttttggcagctcctcatctctcttctaatccaccastcacagtsstagagaacagacsasragttaagaccgtcacctacagaatcccaagggccaaaactgggcagaggwcaactccatccttcttacaaaagggcttctccacaagaagcatttccgttagactctagcagtgagataccctgcttcaagaatttctcatggagccagaagcctttgarrtttgcccttatgatcctcaccaccgaatcccactcagcagattccagtaccacctggcatcgtgknggagaaagaaccccaagaaagccaraaagatggccacctgcaaa

SEQ ID NO: 13990 - DNA, 195 bp, Homo sapiens
taagaaaaatactagtaggaatgaactcttatctattgctggtaggagtgtcaatttgcaaacactttggaaaacggtttgttacttttaaataaaaccaaacatgtacacatcaacccattctttagtatattctagaaaaatttctaactgtatgtagaaaataggagaaaccagcaagaatatttagagcag

SEQ ID NO: 13991 - DNA, 168 bp, Homo sapiens
cctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttacttttttttt

SEQ ID NO: 13992 - DNA, 436 bp, Homo sapiens
attccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgtt

SEQ ID NO: 13993 - DNA, 246 bp, Homo sapiens
  misc_feature 197: w=a or t
  misc_feature 199: n=a, g, c or t
  misc_feature 204: r=a or g
  misc_feature 205: r=a or g
  misc_feature 217: k=g or t
  misc_feature 221: k=g or t
attccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatwgnaaggrrgagtagctacakgaakgtgtaagatcttggaggaagacagc

SEQ ID NO: 13994 - DNA, 208 bp, Homo sapiens
aattcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaacca

SEQ ID NO: 13995 - DNA, 495 bp, Homo sapiens
  misc_feature 367: s=g or c
  misc_feature 475: m=a or c
tcaatttcatcacctttccttttctcagaggtttctgaaggattactgatagtgattcatcagtgacagttcagattcttttagctgtctatggatgtggttcacctgagcctgaaaacccaaaaaggagtagctctcacttaaaggggctgcgactctcctagctccacacctgtcttctgcctcagtcacctcttaccagagtctccctttccagtaagatcattctcatagttggtggaggtggaaacaacacgaggaagagtggcttctcttataatatgacgagggcttcttcaagcaggtctgttatcatacgctttgttttcttcttggtctgatcatagatttttaaaaaagaacctcsaaaacaaaaaacctaatggttatttcaacttcttatgttttaactcttcccagaccttagaacaagcttgtccaacccaaggcctgcaggctgtatgtggcccaggamagcttttgaatgtggcccag

SEQ ID NO: 13996 - DNA, 186 bp, Homo sapiens
cagggaatttttgtgcaactctttcccactgtgttctgcagtcaggctgactgattggtggtggtgtttgttcattgaataattggacttcctcagaaggccctccatgtggtaaggcccctgccggccgtggtgggattaaggctgttaggggtgaggcttgaggcgtctaagagaacagtggcc

SEQ ID NO: 13997 - DNA, 327 bp, Homo sapiens
acttttgctcctctgtgccttgcctgccgcatctccgacgactttggcgagtgctgctgcgcgccctacctgcccggaggcctgcactccatccgcaccggcatgcgggagcgctaccacatccagggctccgtcgggcagactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacaccc

SEQ ID NO: 13998 - DNA, 277 bp, Homo sapiens
  misc_feature 144: r=a or g
agggagcacacaccgccagtctgtgcgctgagtcggagccagaggccgcggggacaccgggccatgcacgcccccaactgaagctgcatctcaaagccgaagattccagcagcccaggggatttcaaagagctcagactcaggrggaacatctgcggagagacccccgaagccctctccagggcagtcctcatccagacgctccgctagtgcagacaggagcgcgcagtggccccggctcgccgcgccatggagcggatccccagcgcgcaaccacc

SEQ ID NO: 13999 - DNA, 391 bp, Homo sapiens
  misc_feature 296: n=a, g, c or t
  misc_feature 297: n=a, g, c or t
  misc_feature 357: m=a or c
catccttgtttattcctccaatacatacactgatcgttatgcaactgaatacttcagggcgaccctcagcaggtcttcagaattttctctcttaactgtctccttcaggtatcctgccctgtaaaaagtagccacactggcttcctcaaattgtccagcactgcctcttcaattgtggaggggccgttgtgctctgccctctacatcatggcctgcgcattttttttttcttttgagacggagtctcgctctgtcgcccaggctggagtgcagtggcgcgatctcggctcactgcnngatccgcctcccgggttcgtgccattctcctgcctcagcctcctgattagctaggactamaggcgcccaccacaatgcccagctaattttttgt

SEQ ID NO: 14000 - DNA, 214 bp, Homo sapiens
acttcttcacacaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaatagggg

SEQ ID NO: 14001 - DNA, 169 bp, Homo sapiens
gttgagaggcccgcgaactgacgggccagtgagcgggcgtcgggagtgggcggatgcgttggggttcgggtcgtgggtgttgaggcggagaggaaggcgtggtgtggcgtctccaggtgattgcgattgggggaaggtagaggagccagagaaccactcagccgtttcg

SEQ ID NO: 14002 - DNA, 271 bp, Homo sapiens
tcgatctggactgttctcaggcaagccggggagtaacttttagttttgctcctgcgattattcaactgacgggctttcatttccatttcacacaccctagcaacaccttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcc

SEQ ID NO: 14003 - DNA, 381 bp, Homo sapiens
  misc_feature 32: n=a, g, c or t
ctcctccctgtagagcaaagggcacgtgagcnaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactggcccatttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaa

SEQ ID NO: 14004 - DNA, 179 bp, Homo sapiens
  misc_feature 66: n=a, g, c or t
agctagctagttcctgcttgaactgaggaccatctatttggttaccgggagtgtggctggtttctnttgcctgttttgatactcttctcctggtaagttttagcttcaaatggtattgtccacaccacagcccttgatctcaggtaattctccacaccactgccttttttttttttttt

SEQ ID NO: 14005 - DNA, 173 bp, Homo sapiens
attttcctgcagctgcctgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccc

SEQ ID NO: 14006 - DNA, 391 bp, Homo sapiens
  misc_feature 163: m=a or c
  misc_feature 165: s=g or c
  misc_feature 167: m=a or c
gagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagamgscmatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggccccagaatctctctgggcctggtggtcgggagggg

SEQ ID NO: 14007 - DNA, 292 bp, Homo sapiens
  misc_feature 43: s=g or c
  misc_feature 279: n=a, g, c or t
  misc_feature 282: s=g or c
attactgattcacagcgagaggcagcagcagcagcagtagcascagcagcagcaacaacagcgctgcttgtcacgaatcgaggattgcaatgagctcatcgttttctccttgcagcttcacaactgccctggcttcctggctactgctgctgctgtcttctcacacatagacacgcacacacaccctttctcgcacacacacacacacacacacacacactctcacacattctcacatgctagacccttctaagcagcttgtccgtttttacacatcgnatstgaactctcc

SEQ ID NO: 14008 - DNA, 154 bp, Homo sapiens
acaagcccttgacttagctcataactgccctgttgactagggatttctagacccattttgaagatggggagactgaggctgagggaggtagtgcggcttgctgaaggtggaggaggccagaccagaacccaggcgtcttttttttttttttttt

SEQ ID NO: 14009 - DNA, 361 bp, Homo sapiens
  misc_feature 8: r=a or g
  misc_feature 11: k=g or t
  misc_feature 46: n=a, g, c or t
  misc_feature 47: k=g or t
  misc_feature 313: s=g or c
  misc_feature 342: r=a or g
agtagggraakacccaggctgcgggacgcggtgcaggctgcggcgnkgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaaggttcagtaccagcagcccgaccatcacgcggcgggatgtctgtggttggcattgacctcggctttgtcaactgctacattgctgtcgcgagaagtggcggcatcgagaccatcgccaatsagtacagcgacaggtgtaccccgtaagtrcctctgctgagcatcacct

SEQ ID NO: 14010 - DNA, 398 bp, Homo sapiens
  misc_feature 176: s=g or c
  misc_feature 177: s=g or c
  misc_feature 350: r=a or g
tagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcssttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaratccatccaagttgttgcatgtatgaatagtttcttcctttttttctt

SEQ ID NO: 14011 - DNA, 369 bp, Homo sapiens
  misc_feature 95: r=a or g
  misc_feature 313: w=a or t
gaattcccacgagagcaatccggatgttcaaggatcggtaaaactgaaaggacacagaaaaaccacagtatctgtcaataccacctaggatttaraagccccttcctttcattctggtggagcttgagattaaaaagaaaaaactaaaactaaaaaataaaaataaatttaaaaaaaaagctccttcctagcctaagaactcagagcacagataccagatttctcttctgcccatggctccaacagaaggaggcaactggtgttactgacattttttagaaagggaaaatgagatcctgagagagagcagggwcagagtctcgccctagtctcctaggctggagtgcagtggcgcaatcttggctcact

SEQ ID NO: 14012 - DNA, 170 bp, Homo sapiens
atttttaagctcttctgtgtcgagctaaggagctgctctgtgcccggcttacagaactggaaggggtagccaccttccgcctgatggaggctggagaacggatggaacctggatccctggagcctgggacactacctcgctgcggttggtggtggccacagaccagtagg

SEQ ID NO: 14013 - DNA, 442 bp, Homo sapiens
  misc_feature 363: s=g or c
attagaaagcaacggctaactatgtgccagcagccgcggtaatacataggttgcaagcgttatccggaattattgggcgtaaagcgtctgtgggttgtttgttaagtctggcgttaaattttggggctcaaccccaaaacgcgttggatactggcaggctagagttgtgtagaggttagcggaattccttgtgaagcggtgaaatgcgtagatataaggaagaacaccaagatggcgaaggcagctaactggacatatactgacactgagagacgaaagcgtggggagcaaacaggattagataccctggtagtccacgccctaaacgatgatcattagctgatggggaactcatcggcgcastaacgcattaaatgatccgcctgagtagtacgttcgcaagaataaaacttaaaggaattgacggggatccgcacaagcg

SEQ ID NO: 14014 - DNA, 408 bp, Homo sapiens
  misc_feature 114: n=a, g, c or t
  misc_feature 169: s=g or c
  misc_feature 170: n=a, g, c or t
  misc_feature 207: n=a, g, c or t
  misc_feature 214: r=a or g
  misc_feature 348: n=a, g, c or t
gtgggcagaggggcgggggttgggaagatggcggctcccagcctcctcaactggaggcgagtttcttccttcacggggccggtcccccgcgcccggcacggacaccgagcggtngccatccgggagctgatgatcatctttggagggggaaatgagggcatcgcggatsnagctgcacgtctacaacacggctacgaatcagtggtntctgccrgctgttagaggagatatccctccaggctgtgctgcccatggatttgtctgtgatggtaccagaatattagtatttgggggaatggttgaatatggaagatacagcaatgagttatatgagttacaagcaagtcngttggttatggaaaaaagtgaaaccccatccccctccttctggtttacctccttgtcctc

SEQ ID NO: 14015 - DNA, 189 bp, Homo sapiens
  misc_feature 18: n=a, g, c or t
gagaagactgaataagcngtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtgg

SEQ ID NO: 14016 - DNA, 242 bp, Homo sapiens
acttcggagcctggagcacagggcgagctctcctccgccctgcagcctcaggtaaggatccggaccttcactgctgccccaactggggctcctcagctcggggcctctaggggcttgggctgctggtctgggtggaggcgcgttgggggtgtcgaggagcttgggtgcaagccccatgcgggaagctcagggcaaagcgccttgaaaccctctctagtgaaggaaggtaaaatggctccggg

SEQ ID NO: 14017 - DNA, 269 bp, Homo sapiens
gaatctttgttcagccacactgactgaacagacttttagtggggttacctggctaacagcagcagcggcaacggcagcagcagcagcagcagcagcagcagcagcagcagggctcctgggataactcaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaa

SEQ ID NO: 14018 - DNA, 178 bp, Homo sapiens
cttttaactttgtttctccatctttacattaagtgttgggatacagggctgaacaagaacaggtaactgtcttatggctttacgtttatgtgttttcctctgaaattaggcaaatttcctaatcttgctgaagttattttcatccttaagaagtaatattataggtctttatagagtg

SEQ ID NO: 14019 - DNA, 318 bp, Homo sapiens
  misc_feature 229: k=g or t
  misc_feature 230: n=a, g, c or t
  misc_feature 279: n=a, g, c or t
  misc_feature 280: k=g or t
gctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatknctggttataagcctgtagctattcagacatatcctatacttggtgaaankatcacccaagatacactgtactggaacaactataagac

SEQ ID NO: 14020 - DNA, 174 bp, Homo sapiens
gcatgcgccttgacgagtgagccggggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctg

SEQ ID NO: 14021 - DNA, 245 bp, Homo sapiens
tttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcagtcgaggacggtcggactcccgcggcgggaggagcctgttcccctgagggtatttgaagtataccatacaactgttttgaaaatcc

SEQ ID NO: 14022 - DNA, 123 bp, Homo sapiens
tagggtttgagtcagtgggggatacaggctgtgcgggctgctgcctgtctgtctgtgcattgcacaccatcagagaggttagtaacttaatctatccgggagagcaggagtaggaacccgggg

SEQ ID NO: 14023 - DNA, 230 bp, Homo sapiens
ctttaattttaataaggccaacttaccaatttcatggataggcttttgtgttatatttgaaaactcattgccaaggctacatagattttatcctgtgtttttcctagaagttttatagttttgcattttacatttaggtatgtgatccatttagagttaatttttatgaaaggtataaggtctgtgtctagattaattttttttttgcatatggattcctagttgtacca

SEQ ID NO: 14024 - DNA, 278 bp, Homo sapiens
cactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcga

SEQ ID NO: 14025 - DNA, 281 bp, Homo sapiens
gtcacttccggcgaggcagaggaggcgggagagtgagagaaaggctggaagacgagcctgcaggatgtttcctcaatgaggggaaggctgctgcacaatggcagtttttgatactcctgaggaggcctttggtgtctacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagac

SEQ ID NO: 14026 - DNA, 146 bp, Homo sapiens
gtataagaaggaataatgtaagttttagaactgcgggatgcagtattataaaacacctttccactactggggaaatactgcaccataacaggtagtcatggaaacacaacttgaaaaaccagaattatttaaaacttatgttgcca

SEQ ID NO: 14027 - DNA, 336 bp, Homo sapiens
gtgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaatataaaggtatccaaactctgtcttaatgtaaatgtaactatttttccttcaagtgttgactagggagtcggtttctctcttaaagacactcactgtacaactgatagcagctgtcatatttctggcaaaatgtgtttacgtatctgacaagttgtacatttgtgtatgaa

SEQ ID NO: 14028 - DNA, 258 bp, Homo sapiens
  misc_feature 204: s=g or c
gtgtgtcacttccggcctccctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggasggagacagggagggacagggcagaggaggagaggaaggcgatgcgacggacagg

SEQ ID NO: 14029 - DNA, 141 bp, Homo sapiens
gtgtgtcacttccggcctccctttagctgccatcttgcgtccccgcgtgtgtgcgcctaatctcaggtggtccacccgagaccccttgagcaccaaccctagtcccccgcgcggccccttgagcaccaaccctagtcaccc

SEQ ID NO: 14030 - DNA, 159 bp, Homo sapiens
tataatctttaaagtaacctaattagtaatacagattacttttacaaagaaaacatgaaactcaggtttacaaacaaatcctaccaagcctttagggaaaaaaaaaggtaatttcacattagtactgcatttcattgattataaaaacactctcccccg

SEQ ID NO: 14031 - DNA, 493 bp, Homo sapiens
  misc_feature 413: n=a, g, c or t
  misc_feature 450: n=a, g, c or t
  misc_feature 472: n=a, g, c or t
  misc_feature 475: r=a or g
ggagttctgtctgggcctattcgggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgccgcattctcccaatctctttcctgagaagtggcggagttgggggcacttcgaggtcgccttggggcgaggtggtncgtgagggggtcccagatatgccagcagcggggggangtcacctttgagaaagtgcgtngargtgggtttcttcagaagc

SEQ ID NO: 14032 - DNA, 359 bp, Homo sapiens
tttataagagtagaagtgatgctgttttatttgaagcctgagagcttctggttccataaccagaaattgctacctggctcttctattggaatggggcttttccattcttagtccatccaactctgaacttgctctgaatctcaaacctttctattcgcagaacaaatgctcaagttttttcaagagtttttctgtagattaggtttattagcaccaacttcatgacttctaaaatgtgactgcttgaatacaggtatctaccagtgatatggggtggataattaataatgcttggctacttctataaagacagtgttgcttatttttcaaaactttttctttttttctttttttttttt

SEQ ID NO: 14033 - DNA, 301 bp, Homo sapiens
  misc_feature 118: n=a, g, c or t
  misc_feature 119: n=a, g, c or t
  misc_feature 129: r=a or g
  misc_feature 236: n=a, g, c or t
  misc_feature 238: w=a or t
tggaaggaggcgttcgtctagatttgtcggcttgcggggagacttcaggagtcgctgtctctgaacttccagcctcagagaccgccgcccttgtccccgagggccatgggccgggtcnnagggcttgtrccctctcgcttcctgacgctcctggcgcatctggtggtcgtcatcaccttattctggtcccggtgcccttccagctgtcactgaaatggctttattcgtcaccgtcntwgggctgaaaaagaaacccttctgattaccttcatgacgggaacctaaggacgaagcctacagg

SEQ ID NO: 14034 - DNA, 266 bp, Homo sapiens
  misc_feature 36: s=g or c
  misc_feature 137: k=g or t
  misc_feature 138: s=g or c
  misc_feature 189: y=c or t
ctgcttccccagctccagaacttccggccagcgcascattttggcttcctgaccttgggctacggctgaccgttttttgtggtgtactccgtgccatcatgtccgtccaccagtcctgacatgaacttttacagttksctctgtgttaagtttatttcccttaaccaagacaatttggaaagggttgtyattttccatcgatcaccacaactgcttttagaacttgacaacgtaatttctgttctttttcagaacagtaaagaaag

SEQ ID NO: 14035 - DNA, 454 bp, Homo sapiens
acatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaag

SEQ ID NO: 14036 - DNA, 161 bp, Homo sapiens
  misc_feature 35: s=g or c
ttctttttaattgttttaaatttttcataggggasttttggacaaaacagtcactggggagatcactgccatttttacacacttgactttttaaaaatacaaccaaccaaccaccacaacttcttatacatttgggacatgagccagagtttaaaaggaaa

SEQ ID NO: 14037 - DNA, 393 bp, Homo sapiens
  misc_feature 327: w=a or t
  misc_feature 343: k=g or t
  misc_feature 344: r=a or g
  misc_feature 360: n=a, g, c or t
tactaaggagctatcctgaccctgccttgagggagccccagttgtcagatatttgggggtttctaagtctcttctttcctctttattctctaatttcccacatctctaggaacttctttcttgagtataatctcagttcctactgtatgtatttgactcctcagggagcaattcagagaataccagttgtttctttccactcttttctcccctacatggacatggaggattttcattcacttgttttcttagcatctcttttccaggtataggaaatatatattttcactttttcttctaatttttaatttagcaatttttatcatwcttgtggcctagcttkrtttccttcttttatgnctaaagccttgcattgatgaataccaacagact

SEQ ID NO: 14038 - DNA, 197 bp, Homo sapiens
gagttattagggctaggtaggtggaacttggagcccaagtaatctcagttccaattccagctccattaacaaactgggttaattttaggcaattatctcagattttctgagcataagtttcctaatctttaaaaatggggataagggccgggcgcggtggctcacacctgtaatcccagcactttgggaggccgagg

SEQ ID NO: 14039 - DNA, 209 bp, Homo sapiens
  misc_feature 143: k=g or t
agtggtgtcatatttggactccaaagaagtatactcaagaaatgactacttcgatggttttagcagataatttttagttatttgaggataagaataatagtctgcttatgaaagaacttggatataagtactgtgatgcagaktcctggacacagagaagtcagcaacttgcctgaggacagcctgcaggacacagcactgtgatttga

SEQ ID NO: 14040 - DNA, 96 bp, Homo sapiens
  misc_feature 80: k=g or t
  misc_feature 83: y=c or t
cccccttttccctccatggtttctctccgctcccgtgagtaacttggctccgggggctccgctcgcctgcccgcacgcckccygccacccaggacc

SEQ ID NO: 14041 - DNA, 92 bp, Homo sapiens
  misc_feature 80: k=g or t
acagggacaacttgtacctgcttgtcacgaaaatgctgaaaataataatactctgacttgggcaaatagtatttctttckttcttttttcta

SEQ ID NO: 14042 - DNA, 243 bp, Homo sapiens
ccaaaggggactatcctctggaggctgtgcgcatgcagcacctgatagctcgtgaggctgaggcagccatgttccaccgcaagctgtttgaagaacttgtgcgagcctcaagtctccacagacctcatggaagccatggccatgggcagcgtggaggcttcttataagtgtttagcagcagctttgatagttctgacggagtctggcaggtctgctcaccaggtggccagataccgcccacgt

SEQ ID NO: 14043 - DNA, 322 bp, Homo sapiens
  misc_feature 124: k=g or t
ctattgtgaatagtgacacaataaacatatgtgtgcatgtgtctttatagcagcatgatttatagtcctttgggtatatacctggtaatgggatggctgggtcaaatggtatttctagttctgkatccttgaggaatcgccacactgtcttccacaatggttgaactagtttaaagtcccaccaggcagtaacaaagtactcctccccctcctctctggggtggtgtcagaagagtggagagtttgaactttcaccactgttccatggtaatgaggtcaccctgatacgatggcgtcaagggaggcaataatgaaacacctt

SEQ ID NO: 14044 - DNA, 182 bp, Homo sapiens
gggggaacagtagtgtctggagggaagggggaagaatcttcatccactccattgtctgaattgttcacccggtaacttttgccatgacaattttacaaattaaggttttcttttaaaattgaggaataattgacatttcatcaagggcacagatcttcagcatggagcgtagacccaagggc

SEQ ID NO: 14045 - DNA, 246 bp, Homo sapiens
acaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggggaattccacaagttggctgatgccaagatatttttga

SEQ ID NO: 14046 - DNA, 495 bp, Homo sapiens
  misc_feature 203: n=a, g, c or t
accacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtntctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgaaacagaaatcaagaacaagatgcaacagaaatcacagaagaaagcagaacttcttgataatgaaaaaccagctgctgtggttgctcccattacaacgggctatacggtgaaaatcagtaattatggat

SEQ ID NO: 14047 - DNA, 314 bp, Homo sapiens
  misc_feature 135: r=a or g
  misc_feature 229: k=g or t
  misc_feature 230: s=g or c
  misc_feature 309: w=a or t
cttctacttcctgggcccggagaaggtggagggagacgagaagccgccgagagccgactaccctccgggcccagtctgtctgtccgtggtggatctaagaaactagaatgaaccgaagcattcctgtggaggttratgaatcagaaccatacccaagtcagttgctgaaaccaatcccagaatattccccggaagaggaatcagaaccacctgctccaaatataaggakstggcacccaacagcttgtctgcacccacaatgcttcacaattcctccggagacttttctcaagctcactcaaccctgawacttg

SEQ ID NO: 14048 - DNA, 317 bp, Homo sapiens
  misc_feature 127: w=a or t
taattaattaattaattaagatgaagtctcactatgttgtccaggctagccttgaactccttgggctcaagtgattctcccatctcggccttctaagtatttgggactacaggcaggttctaccacwcctgacttgttccttattttagatgttgaaaataagcaagtgaaataaaggcttctcaagtgtacacagcactttgctagatactgtggatgatttttcagggaagatgccattcctcccctgaagaagataattattgtagagttagagctaacagacaaaatagatgatatataaaattattcttagg

SEQ ID NO: 14049 - DNA, 75 bp, Homo sapiens
  misc_feature 57: k=g or t
gcagtttgcactctataagaagatgacccaggcggccatcctgatccagagcaagtkccgaagctactatgaaca

SEQ ID NO: 14050 - DNA, 362 bp, Homo sapiens
  misc_feature 123: n=a, g, c or t
  misc_feature 128: n=a, g, c or t
  misc_feature 129: k=g or t
  misc_feature 130: k=g or t
  misc_feature 186: m=a or c
  misc_feature 187: m=a or c
  misc_feature 303: y=c or t
  misc_feature 304: m=a or c
agtagacgccatgatggatgtgtctggtgtgggtttcccaagcaaggttccttggaagaagatgtctgcagaggagctggagaatcagtactgtcccagccgatgggttgtccgactgggagncagankkaagccttgaggacctactcacagataggaattgaaggcttggagtgcaatggcgcmmtctcggctcaccgcaacctccgcctcccaggttcaagcgattctcctgccctcagcctcctgagtatctgggattacaggcatgtgccaccacgcctggctgattttttattttcymgtagagacggggtttctccatgttggtcaggctggtctcaaactcccgacctcaggtg

SEQ ID NO: 14051 - DNA, 375 bp, Homo sapiens
  misc_feature 120: m=a or c
  misc_feature 122: m=a or c
  misc_feature 123: y=c or t
acctgaccggagagccggctagatatggcgtcctctttgcttgcgggcgagcgattggtgcgtgctttgggccccggcggggagctggagccagagcggctaccccgaaagctgcgggcmgmytgaggccgcgctggggaagaagcacaagggcggtgatagctccagtggcccccaacgcttggtttctttccttctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggat

SEQ ID NO: 14052 - DNA, 328 bp, Homo sapiens
  misc_feature 172: k=g or t
  misc_feature 212: n=a, g, c or t
agacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagakgcaaacagaggcacaacatgaacgtgagctccagaagctnagcagagagtgtctctgcgcagagcacaccttgagcagaagattgaagaggagctggctgcccttcagaaggaacgcagcgagagaataaagaacctattggaaaggcaagagcga

SEQ ID NO: 14053 - DNA, 287 bp, Homo sapiens
  misc_feature 56: s=g or c
aatgggaggaggcgtctcggcgggggacaagcagtagctacccgcgggagcgggasgggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaaca

SEQ ID NO: 14054 - DNA, 266 bp, Homo sapiens
  misc_feature 7: s=g or c
  misc_feature 195: r=a or g
  misc_feature 237: s=g or c
agaagtsaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgarggtgggggaagggcaaggaggcgctcgagctggtgcgcggasatcctgggagacgtagtccagcgaggggg

SEQ ID NO: 14055 - DNA, 188 bp, Homo sapiens
  misc_feature 33: r=a or g
atacacacactgctccagccacagtggttcttrtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccc

SEQ ID NO: 14056 - DNA, 303 bp, Homo sapiens
  misc_feature 299: w=a or t
  misc_feature 300: n=a, g, c or t
tattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcwntgg

SEQ ID NO: 14057 - DNA, 159 bp, Homo sapiens
  misc_feature 71: s=g or c
agatccgagccgggctggctgcagagaaaccgcaggagagcctcactgctgagcgcccctcgacggcggasggcagcagcctccgtggcctccagcatccgacaagaagcttcagccatgcaggccccacgggagctcgcggtgggcatcgacctgaag

SEQ ID NO: 14058 - DNA, 275 bp, Homo sapiens
agcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggctgtgagttcgggttgggggtgggaacgcgggcgccacaggctggcctcacaaccaagggc

SEQ ID NO: 14059 - DNA, 237 bp, Homo sapiens
agagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagtgggaagatgtaaatgctgctgcctgtgacctcgccagggaagtggctggcaaaggt

SEQ ID NO: 14060 - DNA, 607 bp, Homo sapiens
  misc_feature 509: s=g or c
acttggccttcagcccctgcctcggccagaggtttcatttttaactgaatatttaccaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgctgtcattcagagtccacaggatggatgaatggatatgaaaatgaacaaacgtgtgacacaacactgcatgatttaccggcaatgactttctgatcaagcctgaacatcccaagacaaccatgctgtgaagaagtcggtctaccccactggagaaggaaaggctgttcagggaagtgaagatgccccagctgacagtcaccacctgccagacatgtgagcaaggctgtctgagaccttcagtctcagtcaagccatcagaaagtcgcagccagttgagtgatcccaagcgagascagcagcgataatgcccagtttgccaaaacagaattgtgagaaataataaatcattgttgttttaagccaggtgtgggcagacattttcttaaaggac

SEQ ID NO: 14061 - DNA, 473 bp, Homo sapiens
  misc_feature 20: s=g or c
  misc_feature 423: n=a, g, c or t
aggcggggatgtgtgcgaasctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaaccngcgtcatacctttatctatagccttcccctaggtcttcagaagcatcaag

SEQ ID NO: 14062 - DNA, 246 bp, Homo sapiens
  misc_feature 20: s=g or c
aggcggggatgtgtgcgaasctgccgctgctgcagcgagtctggcgcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtagtgacttgtcaggaggatcaatatga

SEQ ID NO: 14063 - DNA, 367 bp, Homo sapiens
gttgttgcagtatctgacttcagcgatttgtcttcttgtctcaataagtgtaagaagtgggtagaggatggaaagggagaagaaaggattaaagttaagcctgaatgtttcattctccaccttaatgaccgcatctactaatagccaataaaatgaattggcctctctactgggctgcttgaccttcctcatgacatggcagttggaacaaccatgattcaatatgtgagtaggctatacaggagacaggaaccattgggagccattttgaacactctctactacaggatcaaaagcaaataattacaaaacagtacatcaatgcaacaatggcattatatgtaagcattaatatagaattttggag

SEQ ID NO: 14064 - DNA, 179 bp, Homo sapiens
atgtttcaaatgcttagctgcctataaagctgtaacagtttagccagtggtcactgaggaagaatataagttagcctcgtagtgaccatgtggaagtcctgacctcgcttgcagacttgaccactggatgtgacaaggtagcttcactacagctctactatttaatcctggaaactaaa

SEQ ID NO: 14065 - DNA, 469 bp, Homo sapiens
  misc_feature 7: m=a or c
  misc_feature 35: n=a, g, c or t
  misc_feature 36: n=a, g, c or t
  misc_feature 126: y=c or t
  misc_feature 127: n=a, g, c or t
  misc_feature 133: r=a or g
  misc_feature 219: k=g or t
  misc_feature 440: n=a, g, c or t
agttcgmggagagggaagaatatggccgccgggtnnggtgagggcgacgcgcttgcagtcgccgtctcttgcttccccgtcctctgacatcgcctgcagccgagcgggcccgttccgccggaagcyngaaggrccaggtattcaaataaagttaattgcagctttctgtgaaaatgtcagttttgatatcacagagcgtcataaattatgtagaggaakaaaacattcctgctctgaaagctcttcttgaaaaatgcaaagatgtagatgagagaaatgaggtaagaccaagtttgcaaaattacattctttcacaaatatttgttgactgcctgctatgtataggatagaagtgtgtaagaaataggtagttctaacccttagtaatactgcactgtacttatgatagaatgtcttatagttaaaagtacttcaaattncatgtttttggagtacattttaacttata

SEQ ID NO: 14066 - DNA, 62 bp, Homo sapiens
tgacaggtgaagaatctgaggcttagagaggtcaccagctggtggccaaggaagatcttttt

SEQ ID NO: 14067 - DNA, 291 bp, Homo sapiens
  misc_feature 16: s=g or c
  misc_feature 238: s=g or c
ccctaattcaagggasagttaattggccttttattccaagaatgggccttagtggcagtatcttaaaagcccacaagatggagatgtttcctaatgaaaggcctttaatttctttatagagctgagttagtgtcacatcccagtccccacccatgacccttccccagttaaaaagaagagaaaatgttgagcaagtctgatttgattcccatggtgacatttttagccattatgtaasaaattctgacagtttacccttaaaattaaaaacctccagtcctgtctttttaa

SEQ ID NO: 14068 - DNA, 101 bp, Homo sapiens
ctactgctctcttcccagtggctcatcttccaccctccaagctctaagaatgttgagttgtcctgctggtgtggactcatctcaaggagatacaaaaaaaa

SEQ ID NO: 14069 - DNA, 300 bp, Homo sapiens
atatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcct

SEQ ID NO: 14070 - DNA, 458 bp, Homo sapiens
  misc_feature 423: m=a or c
  misc_feature 428: n=a, g, c or t
  misc_feature 441: r=a or g
attcctgcagaggatcaagacagcacgtggacctcgcacagcctctcccacaggtaccatgaaggtctccgcggcagcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtgtctgcttgctcttgtctagcttgggaggcttcccctcactatcctamcccanccgctccttgaargggccagatctaccaca

SEQ ID NO: 14071 - DNA, 412 bp, Homo sapiens
  misc_feature 292: n=a, g, c or t
agggtgagtgggagcccaggaaggagcgagtaggagagagggagcgagagccaggcaggaccgcaggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggaaagggggagattgaggtgggagagagaagcagagcgagaganaggaggctgctggaaggagaaagaagagggtgaggaggcgacagagggagaggaggaagaagaggtagaaggagagagaaaggggagagaaaggagagaggagggttggaggtgcatgaa

SEQ ID NO: 14072 - DNA, 275 bp, Homo sapiens
gactggccagtggatttagcagcatggaagacatcagtggcctcgaggaggacagtttcagcagaatggtggctgcacaaacctgatccaagtgggattaagaaaaaaatgggagaaggctgagtgcagtggctcatgcctgtaatcccaacactttggaaggcccgaggtgggcggatcacttgaggtcaggagttcgagaccagcctgggcaacatggcaaaaccccgtctctactaaaaatacaaaaactatccaggcatgatggctgtttt

SEQ ID NO: 14073 - DNA, 360 bp, Homo sapiens
  misc_feature 10: n=a, g, c or t
  misc_feature 23: n=a, g, c or t
  misc_feature 24: n=a, g, c or t
  misc_feature 125: s=g or c
  misc_feature 126: s=g or c
  misc_feature 247: y=c or t
  misc_feature 287: k=g or t
acggggcganatggcggcggagnnacaggaggcgctgagggagttcgtggcggtgacgggcgccgaggaggaccgggcccgcttctttctcgagtcggccggctggtacttgcagatcgcgctassagcttttatgaggacggaggggatgaagacattgtgaccatttcgcaggcaacccccagttcagtgtccagaggcacagcccccagtgataatagagtgacatccttcagagacctcattyatgaccaagatgaagatgaggaggaagaggaaggccagakgttttatgctgggggctcagagagaagtggacagcagattgttggccctcccaggaagaaaagtcccaacgag

SEQ ID NO: 14074 - DNA, 172 bp, Homo sapiens
  misc_feature 13: r=a or g
aataaaaggggarcggcgaagaggcaggaagacaagaccatgtcgaagggccccgggcccggcggctccgcagcttcctcggcgcccccggccgctaccgctcaggtgctgcaggcacagcccgagaaaccgcagcactacacctatgttagatactaaagaaggcttcccc

SEQ ID NO: 14075 - DNA, 154 bp, Homo sapiens
ctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaa

SEQ ID NO: 14076 - DNA, 298 bp, Homo sapiens
  misc_feature 90: n=a, g, c or t
ggctagcaattataggatagattcatctaaaatatggtattctgcattttggttttttttcttaagtgaataataccagtcttcaaaganaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacacga

SEQ ID NO: 14077 - DNA, 388 bp, Homo sapiens
  misc_feature 318: y=c or t
  misc_feature 354: r=a or g
aaggagacagtcatggaagcggaggggtagtcctgaccccgcgtgggtcctgacgccgagattaagacgagtggccatttaggaggatgtggaccctggacgctcgtggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaagcgagagcaggaatgttttgaccgagcctgccccatccccactgaagaggagtyccagcacatgttaggaggaccacagatgactcttcrctgaatctctatttatacacaaatatccttcaga

SEQ ID NO: 14078 - DNA, 417 bp, Homo sapiens
  misc_feature 12: s=g or c
  misc_feature 99: s=g or c
  misc_feature 118: m=a or c
  misc_feature 132: k=g or t
  misc_feature 387: m=a or c
acagtaggtagsaagtctcagaggaaggagcccctccctgggagccagacccccacaccatggcgagcgtggtggtgaagacgatctggcagtccaaasagatccatgaggccggggmcacccccacggggktggagagctgctcccagctagtcccagaggctccccggaggtgaccagccgggccaaggggatcccgaagaacaaagaaggccgaagcggtcagtcagaggagatgagacaatggaagtagtcagagttatagccaggcacagtggctcatgcctataatcccagcactttgggaggccaaggtgagcagatcgcctgagtccagaagttcaagaccagcctgggcgacatggcaaaaccccgtctctacaaaamatacaaaaataattagctgggcgtggtggt

SEQ ID NO: 14079 - DNA, 208 bp, Homo sapiens
  misc_feature 183: k=g or t
  misc_feature 204: n=a, g, c or t
aagacgctcgggcggcgggacccagggaaggcagcggccggagcgcgcaaggtgttgaaagacagagaagcgaagacagagacgtggaaagacaggggagagagacacggagagagacgcagaaggacagagacgtggagagagacgcagagagacagagacgtggagagacacagagagacktggagagacacagagagactnggag

SEQ ID NO: 14080 - DNA, 230 bp, Homo sapiens
gcggcgcgcgcgaagacgctcgggcggcgggacccagggaaggcagcggccggagcgcgcaagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaa

SEQ ID NO: 14081 - DNA, 407 bp, Homo sapiens
  misc_feature 164: n=a, g, c or t
agtgtggtgtaggacaggtctgaatcactgtgcctgtcccaggtggcacagtaatagaccccagaatcattttcaattagattttgcagtctcaatatccagctccacctcctgggtgtatgagtataatactttcctggactgagtcctgattccaacacatnccttgcggtggagacgtcatagtacagaagacgctgtggggccttcccctcctggtgtaggtaccagtggatgtagaaggtatttgttacagtaagatcgcaagtgatttcagcagatgacccagtctgcctggtgactgacttcgttctcccttccaagttggaagatttctgactggctgcaatgggaacaacacaaaatacaatgaggtattcctttgtatggcacccctttcaagaaga

SEQ ID NO: 14082 - DNA, 261 bp, Homo sapiens
aagactctaggagtcccttggactgaagctggtctttgctctctcctcacagggcacccctcctgagactgtggtgggaaccagcacaagccggagctgctgcctgcagattcacaaggggcaagtttgaatacgaatctgctgtgttcctatctgccaagttcctatatgtttctggggtaaacactgagacacgccaagaaacaaacacacacatgcacaacttccctgaccacaagactacacaccacacacacacac

SEQ ID NO: 14083 - DNA, 298 bp, Homo sapiens
acaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaatgatcaagaagagattagaaaaaaacagagcccctagaaatgtaagaagtgaaatgaaaagctcaatggatagcttagacacagctgaagagag

SEQ ID NO: 14084 - DNA, 187 bp, Homo sapiens
  misc_feature 18: n=a, g, c or t
gtgcgccacgtacgcggnggctctgagaacccggaagttacgttttaggcccgcgtcacgggggcgggagtcagctgagctgccggggcgaggttgggatcacctggcaccggctgaagggagcctgtgatttttttgtagcgggggcggggagtaaggtgcaagactgcgccagattcaaggacga

SEQ ID NO: 14085 - DNA, 278 bp, Homo sapiens
acagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccgtaccatacacactgcctgtttccttgcctgttggttcgtgcgtgataatcaca

SEQ ID NO: 14086 - DNA, 199 bp, Homo sapiens
acagaagaggaaacagtctcagggaggcccggctgcaagactgggtgacacacacagggagtgtggatctgggccagtggcggggagctttaaggtggccacccaggagaggaacccccagagagcccagatgaggctgcggaggcagaagaagggtgtggtccccttcctgggggattttctgactgagttacagagg

SEQ ID NO: 14087 - DNA, 211 bp, Homo sapiens
atcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaata

SEQ ID NO: 14088 - DNA, 424 bp, Homo sapiens
gctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcacccggagggtggcttattgggagatacttgaatgtcttcatgtctcgcccgccaatcactcgggcagtgaccgtcttcccaaccttcagcttggtagtaggagaggtgccctctggaacatcatctagaatgtgcatggtgtattttggaaacaatgactagctggctggaaca

SEQ ID NO: 14089 - DNA, 414 bp, Homo sapiens
  misc_feature 323: r=a or g
  misc_feature 324: r=a or g
  misc_feature 404: k=g or t
aaaaaaactgtcccccccgggcggagagaggtcgcgctctttcgcacactccctcgccaagggttaatttctcaaatcgcacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgrrtgggggaagcagacaggagaacactcgaaatcaagcgctttacagattattttattttgtatagagaacacgtagcgackccgaagacca

SEQ ID NO: 14090 - DNA, 302 bp, Homo sapiens
aggtaagtaaagtataccagaagagaacagacattataccgtcaatatcctcaaaggttatttttcgggtattaggctctaattcctacttcacaccttttttttctttttgagacggagtctagctctgtcaccaggctggagtgcagtggcgcgatctcggcccactgcaacctctgcctcccgggttcaagtgattctcctgcctctgtctcccaaatagctgggactatgggcgcgtgccactacgcccagctaatttttgtatttttagaagagacaaggtttcaccttattggcca

SEQ ID NO: 14091 - DNA, 347 bp, Homo sapiens
  misc_feature 301: w=a or t
aaagagggagccatggccttgctgacatcttgatttcagacttctatcctccagaatgggaagagaatggatttcaacagaatcgtgtggcttcagatgataaagaagtaagaatttccaggggacctctgagggtctatttgagggcatgaatatggaaaattcagctccagctcctccaccccactccctgaacagcactgcagaactgtgctaagctcctgtggcttggaaagaacagatgcaagagacataatggagtctcgctctgtcaccaggctggagtacagtggcgtgattwtgctcacttcaacctccgcctcccgggttcaagcaattctcctgcc

SEQ ID NO: 14092 - DNA, 578 bp, Homo sapiens
ttctcaggtatgtagtcatgtttgttgctgagcagtgagttttggctagcttatggcaaggtgatttaatagacgttaaagttgagtagcttaggtatttcagtaggttgtaaattgccaatgaattaatgttttcttcctagagaccttcaaataatttaagcccatcttaaaggtggaaatgaagtacttccaaaatgttaactttgcctatatttagtattatagttcagagtagatctttcattgaggattgccctcaacagcttaactactttcctcacattggtgtccagctaagtacctcaagttaaaggtaagatccctttaccagcagatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttccagg

SEQ ID NO: 14093 - DNA, 192 bp, Homo sapiens
catgtcgcgtttgccagctgccactatgttaagctttctcagtagagggtgctgcatggacacagcaggaggaagagacattcttactaatttctgcttctgattatgtgccagtcagcattgtgcagggtatccagtgacaatcatctccatagttttgctgtcaccccatcgggtagctcgccagaaggt

SEQ ID NO: 14094 - DNA, 262 bp, Homo sapiens
  misc_feature 35: s=g or c
  misc_feature 39: s=g or c
  misc_feature 41: n=a, g, c or t
  misc_feature 50: n=a, g, c or t
  misc_feature 262: n=a, g, c or t
ccgcacgcgttacaggagccaggtcggtataagcsccasgncctcgccgnccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcactccn

SEQ ID NO: 14095 - DNA, 286 bp, Homo sapiens
  misc_feature 143: n=a, g, c or t
ctgtgttactggatgaagttgcagaagatatgggtaagtgtcaccttaccaaaggcaaacaggctctagagattcgaagtagtttatctgagaagagagcacttactgatccaaacagggaacagaatattcgcgaatctctngtgcggaatctacagtgggccaaggctcatgaacttccagaaagtatgtgtcttaagtttgactgtggtgttcagattcaattaggatttgcagctgagttttccatgtcatgatcatctatacaagtatagtttacaaacca

SEQ ID NO: 14096 - DNA, 118 bp, Homo sapiens
aaaaaactagcagtttggcaagtcagtgcaagaggctgacttctgagaggcttccaggagcccgaagagaggacctccacgggagaagggagtgcgtgtgctcggttttttttttctc

SEQ ID NO: 14097 - DNA, 300 bp, Homo sapiens
  misc_feature 261: n=a, g, c or t
  misc_feature 284: r=a or g
atcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgntgattttcctcgcggaccctgcrctcccgacacccccgc

SEQ ID NO: 14098 - DNA, 109 bp, Homo sapiens
tgtttgactaatacagcttggaggagaggttagtcaagagataagccccttaacctctgatggactgaaaataatcaggaactttaaaaaggaggaaatatgtagccaa

SEQ ID NO: 14099 - DNA, 249 bp, Homo sapiens
atcttgttcccaggggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccc

SEQ ID NO: 14100 - DNA, 232 bp, Homo sapiens
  misc_feature 164: r=a or g
gtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagargtagatgtccacgcccacagaccctggtgcgatgccccacccagggccttcgccggggcctgggcctt

SEQ ID NO: 14101 - DNA, 165 bp, Homo sapiens
ttccggctccggtgtcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggc

SEQ ID NO: 14102 - DNA, 201 bp, Homo sapiens
ttgtcatggccggctcctaccctgaaggtgcacctgcaatcctcgccgataagaggcagcagttcggaagccggttcctgagcgatccggcgcgcgtcttccaccacaatgcctggtaatcaccctgccccctcgcccggcctgtcgctggccgtctgtcccgccgcctcggagcattccgaaaagcccctgaccgccgac

SEQ ID NO: 14103 - DNA, 137 bp, Homo sapiens
aagatcctccaagagcactgccgcatgcaccagagacctccccggggccctgggtcctggcatttggacagtgcaatctggccaagctcatgtccactcaaggttatggcagctccagtgtctcttgaatgtgaaag

SEQ ID NO: 14104 - DNA, 196 bp, Homo sapiens
  misc_feature 153: r=a or g
tgtttccggcggcgtcgcgcgtttgcgagcctcgggtggtcctcagggaggcaggattcctggttttcaagcctgagctgatctctcggctggagcagggagaagagccatgggtcctcgacctgcagggagcagaggggacagaggcaccarggacctccaagacagattctacgattaggactgaaaatgagca

SEQ ID NO: 14105 - DNA, 142 bp, Homo sapiens
acagtataaaacttcacagtgccaataccatgaagaggagctcagacagctcttaccacatgatacaagagccggctggtggaagagtggggaccagaaagagaatttgctgaagaggagaaggaaaaaaaaacaccaaaaa

SEQ ID NO: 14106 - DNA, 319 bp, Homo sapiens
  misc_feature 195: n=a, g, c or t
  misc_feature 243: w=a or t
  misc_feature 244: r=a or g
  misc_feature 245: n=a, g, c or t
  misc_feature 246: n=a, g, c or t
  misc_feature 304: n=a, g, c or t
  misc_feature 305: n=a, g, c or t
  misc_feature 314: m=a or c
acacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacgtcctcagctccaanttgccacctcctctcgccagagtgatgaggtcccggcttctgctctcwrnngcccatctgcccacaattcgggagaccacggaggagatgctgcttgggggtcctggannggagccccmacccc

SEQ ID NO: 14107 - DNA, 147 bp, Homo sapiens
  misc_feature 109: y=c or t
tgagcggagaagagcgagcaggggagagcgagaccagttttaaggggaggaccggtgcgagtgaggcagccccgaggctctgctcgcccaccacccaatcctcgcctcycttctgctccaccttctctctctgccctcacctctccc

SEQ ID NO: 14108 - DNA, 68 bp, Homo sapiens
aattcaagtcctggcttgagagccgagcggcaagagcgcgggccggggaagggaagagtaggagagga

SEQ ID NO: 14109 - DNA, 305 bp, Homo sapiens
acacttccggcctttgtgggccgcagcgacggcggtctgcggctgtcggttctgtttgttgctgtcactgctgtttgttcttgccagcggctagggtctggctgttttgcccagaatggagtgcagtggcgtgatggtctcggctgacagcagcctcgacctcctgggctcaagccttggcctcccaaagtcctgggattacagccccacctgcagagtcaagtccctcctcccacctcagcactgctagaaaagagcttcaggatggagccacacatgtcactcaagcccaagggtcagtcaac

SEQ ID NO: 14110 - DNA, 168 bp, Homo sapiens
  misc_feature 97: r=a or g
actggacccagcccttagcaacggcctggcgacggtttccctgctgctgcagcccccgtcggctcctcttttccagtcctccactgccggggctggrcccggccgcgggaaggaccgaaggggatacagcgtgtccctgcggcggctgcaagaggactaagcatgaat

SEQ ID NO: 14111 - DNA, 222 bp, Homo sapiens
  misc_feature 118: s=g or c
  misc_feature 121: y=c or t
  misc_feature 123: w=a or t
  misc_feature 137: k=g or t
atcttggaattgggaggaagagggagagggagaccgggacgagaccggggctgtggtgcggagagaggctgagacggagaagaggagaggcagagagggcgcggggaccgtcagcagsacytwagctacaaatcgtkcagctattctcggaagagagaagggagagggaggaggccggggcgggagtgggggctgtcaccctcggaccccggcgtgagaggg

SEQ ID NO: 14112 - DNA, 415 bp, Homo sapiens
  misc_feature 269: s=g or c
  misc_feature 288: s=g or c
  misc_feature 320: n=a, g, c or t
  misc_feature 321: y=c or t
gacttcctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccscgacgaggaggaagcggastggagctgctgaggcagtttgacctggcctgnyagtacgggccctgcaccgggatcacacggctgcagcgctggtgtcgggccaagcagatgggcttggagcctcccccagaggtgtggcaggtgct

SEQ ID NO: 14113 - DNA, 355 bp, Homo sapiens
gacttcctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggggaggagccccagccccgcgacgaggaggaagcggagctggagctgctgaggcagtttgacctggcctggcagtacgggccctgcaccgggatcacacggctgcaacgctggtgtcgggccaagcagatgggcttggagcctcccccagaggtgtggcaggtgct

SEQ ID NO: 14114 - DNA, 57 bp, Homo sapiens
  misc_feature 33: s=g or c
aagaggatggcgacctcgtcgatgccgccatcstcatttatactgattgcacacccc

SEQ ID NO: 14115 - DNA, 396 bp, Homo sapiens
  misc_feature 176: r=a or g
  misc_feature 178: r=a or g
  misc_feature 179: n=a, g, c or t
  misc_feature 184: r=a or g
  misc_feature 187: r=a or g
  misc_feature 311: n=a, g, c or t
  misc_feature 312: r=a or g
gcagtggggtgtggttagagggctaggaagcaatccaaaacagcagctcaggctgcccaaagccgtgtccaagcgatcattttctccattttgggccaagtcaatttgcaccggcaagaggcagaatgtttgttttatggggaggaggaaaataaaaaaggaagtcagagagcatrgrncggaracragcaacaccaccaaagaggtttcatctcgggtggatgttaaacgattggaatgctaataatgggcgcgaggagcaaacacaattgttctgagtccacagctgcggcacttttaatgacaggaanrgtgtttaagcttctaaaatgtcatctatcaagcacctggtttatgcagttattcgtttcttacgggaacaaagtcagatggaca

SEQ ID NO: 14116 - DNA, 129 bp, Homo sapiens
ctgctctctcttgtcccccacattctgtcctgtccccttcccatccatccacttcttccagacacagcaggaagaggccctctgaaggggccgccggccccagacaccatccttacccccccaccgacc

SEQ ID NO: 14117 - DNA, 480 bp, Homo sapiens
  misc_feature 141: r=a or g
  misc_feature 214: s=g or c
  misc_feature 217: n=a, g, c or t
  misc_feature 282: r=a or g
  misc_feature 294: w=a or t
  misc_feature 342: n=a, g, c or t
  misc_feature 343: w=a or t
  misc_feature 414: s=g or c
  misc_feature 415: y=c or t
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaaraggcgttgggcatgggtttgacggcagccggggacgcgagggacacggcggacgcggtggcggctgagggcgsctnactacctggaacaggtcaccataactgaagcatctgaagatgactatgaatatgaagagataccratgacaattttwgcatcccagaaggtgaagaagatctggcaaaagcaattcagatggccnwagaacaggctacagatactgaaattttggaacggaaaacagttcttccttcaaagcatgcagtacctgaasyaatagaagactttctctgcaatttcttgatcaaaatgggaatgaccagaactcttgattgctttc

SEQ ID NO: 14118 - DNA, 247 bp, Homo sapiens
gactagaaattgtaatcgcggagaaagagagagacagacagagccggggagaaagggaccaagacagacggacagacagacaacctgactgagacgggctcagggccgatgagagggtgacagggatagagcaagagggaggaatagatggaggagaaggagagaaggggcctgggggtcccgagggaggcaagattgtgaggggggagactcaggagggggttgaggccagaggaggtggacgggg

SEQ ID NO: 14119 - DNA, 313 bp, Homo sapiens
gaggagagagggaatgactctaaggaagggagggagacaaagaaggcagagggaagacctggggtccagaggtgcggctgagggtttgtgatgtacagtcatgcttctgctgggcacactgtgagtcttcaatgggcgctgggctctttcacgcccttgctgtgggggacggtctcccaggctctttctttcccctcacaaacctctaatccattagcatagtgtgagatggctccttctgcctctttgcagctagtggggtccctcacttcacaggcagaagagggggtggcgggcagttttctcattctag

SEQ ID NO: 14120 - DNA, 329 bp, Homo sapiens
  misc_feature 97: s=g or c
  misc_feature 153: s=g or c
aatcggtctctggacgctgcgcggcgctcctaggagcaggcgttcccgactccggcaagagggtggcgcctggactctcgccctcagagggaggccsgtcccacggtctgtggctacggatcccaggaccctcttcgcgggcgattcgcgtasctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccac

SEQ ID NO: 14121 - DNA, 285 bp, Homo sapiens
aaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagc

SEQ ID NO: 14122 - DNA, 367 bp, Homo sapiens
  misc_feature 66: k=g or t
  misc_feature 277: k=g or t
agttgttggggcgggtcggccgggagattaggatcttgtgtttgtggcctccgcagccagcttagkctgctcggtgtcgtgtcgcagttatgtactgccatttattatgactcttagaatatagttatttcttactcttccgctgcctcctttgcttttaaagcctgttctgccaagtctcgctggagaaggaaacccctgaaactggtcctggtggtctcagaccgccgcgcgagcgaagagtggggaggacaaaggttggggagttgagaaggakggagatgggtgcatctggaagggagtccgtcctgaggagtcccccatcagctgtcagccagccagcagcaaagcaaattaagactacaca

SEQ ID NO: 14123 - DNA, 227 bp, Homo sapiens
gccatcttcttctgggctcactgagggtctacctgttttggggaggctgctgcgacgaagagttccctcagcctccggccttgtgtgtccgactcggcagcagtgcttccatgtggtggtgtagtgcgcttcccagggatcttgagagtgaagatctcgaaggatttcataggtatatttttttctttgctatgtcatcgtagtcagtggtggcagaaaagcgctgc

SEQ ID NO: 14124 - DNA, 198 bp, Homo sapiens
ggatgctgtgggtgtggttggaggaggtcctttaagggctgtcttcggtggaggtttgggagaagagttggcctggctacaactctgcttcaaccaaagcatctttagtttgagcttttaatatcttgggcctgtcctgcaggcttgtttgaacaaagactatacataaaataagcaagaaccatttctttttttttt

SEQ ID NO: 14125 - DNA, 183 bp, Homo sapiens
  misc_feature 128: y=c or t
tcatttgttctgttttgctactttggaccaaaaaccatgagtttagaaactaaaactaaaatggcataattctaattttggttatcatatgaaagttaactatatttttactactgtaataataagtyctttttgtttgtttttaaccacagagaagtaaaaagaagaaagcaacagaatagg

SEQ ID NO: 14126 - DNA, 192 bp, Homo sapiens
atcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataaca

SEQ ID NO: 14127 - DNA, 160 bp, Homo sapiens
tgccactggaacagtatctttcaaaattattcataatctccatgttatcaaatctagtagttccgtcatcatctgactcaggttcttagcaacatttgccacagttgagcactgcttaagatacactctttacttgatttccaccacaccacaccccacc

SEQ ID NO: 14128 - DNA, 346 bp, Homo sapiens
tactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtg

SEQ ID NO: 14129 - DNA, 530 bp, Homo sapiens
  misc_feature 99: r=a or g
  misc_feature 106: w=a or t
  misc_feature 109: w=a or t
  misc_feature 112: k=g or t
  misc_feature 113: s=g or c
  misc_feature 119: n=a, g, c or t
  misc_feature 120: n=a, g, c or t
  misc_feature 128: n=a, g, c or t
  misc_feature 137: s=g or c
  misc_feature 140: m=a or c
  misc_feature 141: m=a or c
  misc_feature 148: m=a or c
  misc_feature 149: s=g or c
  misc_feature 165: s=g or c
  misc_feature 166: s=g or c
  misc_feature 175: s=g or c
  misc_feature 176: m=a or c
  misc_feature 240: y=c or t
  misc_feature 242: y=c or t
acagcgcaggcgctggcgcggagaggcgcaggcccaggtccactccccagctgtgaaaggaatgaagatatagagaaacaaggaagaaattgaccccgrcgaagawgawagksaagaannagcatttngataagaasagmmaattgamsgaagatgtttgatgcssaatatgatsmaggagaaagcacatattttgatgatcttaaaggagaaatgcagaaagaagcacagctgaatcaygyagaatttgaagatcaagatgatgaagccagagttcagtatgagggttttcgacctgggatgtacgtctgcgttgagattgaaaatgttccctgtgaatttgtgtagaaccttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcga

SEQ ID NO: 14130 - DNA, 218 bp, Homo sapiens
tgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcagtggtgcaatcttggctcactatagccttgacctctcag

SEQ ID NO: 14131 - DNA, 53 bp, Homo sapiens
agaagtgagtacgtgagcggcgcacaagatcccagctcggaccccggacggcg

SEQ ID NO: 14132 - DNA, 186 bp, Homo sapiens
aaaataggctgagtttcacgcgcgtatgctttgcccgctatggccgcagtcaaggagcctttggagttccatgccaagcggccttggcgccccgaggaggcagtagaagatccggacgaggaggatgaggataatactagtgaagccgagaatgggttctccctggaggaagtgttacggctcgga

SEQ ID NO: 14133 - DNA, 526 bp, Homo sapiens
  misc_feature 281: n=a, g, c or t
ccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgnggcattgggaatctcgtgacatttggccacagcctgagcaagacctgttccccggcctgccccatcccagaaggcgtcaatgttggtgtggcttccatgggcagctgctgccagagctttctgtgcaatttcagtgcggccgatggcgggctgcgggcaagcgtcaccctgctgggtgccggtctgctgctgagcctgctgccggccctgctgcggtttggcccctgaccgcccagaccctgtcc

SEQ ID NO: 14134 - DNA, 206 bp, Homo sapiens
  misc_feature 43: s=g or c
gactggggccggataatggcgggcgctgcagaagatgcgcgastcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgag

SEQ ID NO: 14135 - DNA, 175 bp, Homo sapiens
agtctggacctgcccaaggacccctgcaattaggcctcccatgcagaggtcagtgagagcccaagccaattgctctaggccccgtggctggctacttatggggcactgtcctgaccagctctgctaagatgctcctggcccctccctccaccccgtccagaggacggacccccag

SEQ ID NO: 14136 - DNA, 118 bp, Homo sapiens
tagagggactgggaacacagtgtatagaaaaaggggaggagagaaagaatggtgagattttgaatatctgcaagatggaaggggttttggtggcaataatagaggaataaaatagaga

SEQ ID NO: 14137 - DNA, 122 bp, Homo sapiens
atttccgcttccgcctcttctttctcgacaagatggccacaccggcggtaccagtaagtgctcctccggccacgccaaccccagtcccggcggcggccccagcctcagttccagcgccaacg

SEQ ID NO: 14138 - DNA, 231 bp, Homo sapiens
cggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcg

SEQ ID NO: 14139 - DNA, 110 bp, Homo sapiens
agtcagcagcgagagggttcgaagatggcggcgcgcaagggtcggcgtcgcacgtgtgaaaccggggaacccatggaagccgagtccggcgacacaagttccgagggccc

SEQ ID NO: 14140 - DNA, 130 bp, Homo sapiens
aaaatggggtgggtggggggtggggcaggcgacggtggggaagatggcgtaccagagcttgcggctggagtacctgcagatcccaccggtcagccgcgcctacaccactgcctgcgtcctcaccaccgcc

SEQ ID NO: 14141 - DNA, 131 bp, Homo sapiens
  misc_feature 11: n=a, g, c or t
actcgcatggngactcctccatctctgtcttccctgttgtgacagtctcagagcctacgttctttcaatggctgggctacaagatggtgacaggctgcccaacctgacacagcaagaaggcggccatctgc

SEQ ID NO: 14142 - DNA, 549 bp, Homo sapiens
  misc_feature 400: w=a or t
  misc_feature 406: y=c or t
  misc_feature 433: r=a or g
  misc_feature 446: y=c or t
  misc_feature 452: r=a or g
  misc_feature 473: m=a or c
  misc_feature 479: n=a, g, c or t
  misc_feature 480: n=a, g, c or t
  misc_feature 499: y=c or t
  misc_feature 511: m=a or c
  misc_feature 522: k=g or t
tatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgatttttttttttttttwaatggycactccatcaacatcccccatggccaragcctgagctggyccccaragacacaggcattcagctgamagcctnnccttcacgctgctgctgtyctcatgggggamaggcctcaggkggcaatgcacaaatcattagttaaggg

SEQ ID NO: 14143 - DNA, 638 bp, Homo sapiens
  misc_feature 251: k=g or t
  misc_feature 391: k=g or t
  misc_feature 552: k=g or t
  misc_feature 586: k=g or t
  misc_feature 623: k=g or t
aacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgtkacaggcttagctttgtgtgaaaaccagtcacctttctcctaggtaatgagtagtgctgttcatattactttagttctatagcatacttgcatctttaacatgctatcatagtacatttagaatgattgcctttgattttktttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgtkaagcatctagactaaaagccaaaatataattatkgctgcctttctaaaaacccaaaatgtagttctctatkaacctgaaatgtaca

SEQ ID NO: 14144 - DNA, 236 bp, Homo sapiens
  misc_feature 81: s=g or c
caaaaaaatcagtctttaagcatttgcttggtaaggtttcttaagattaggtttataatacaaccatctgtaatgtatctstcgtttgagcttgtgggccatacaattcattaactagatgaatacattgtggacagcatcctcactacccctctctactcactcacaaagaaccatgatacactggaatgtttttctctggaattctttctactcttgtattaaaatttttcccc

SEQ ID NO: 14145 - DNA, 120 bp, Homo sapiens
ttctatcttacataaaaatagagaccttcaggcacaaattccctgaacttcacttactaaatccacagccatggacaagattctgtgctctaggttgtgacatcccaactctaccacagg

SEQ ID NO: 14146 - DNA, 322 bp, Homo sapiens
  misc_feature 193: s=g or c
  misc_feature 197: n=a, g, c or t
gctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtsagtntcctgaggaccatctcagaggccccgggatcacccgaacagtcctccatgtgaatcaatcccatgatgcaacatgcctccccagcccccgctctgacgatgatggccacgcagaatgtcccgccc

SEQ ID NO: 14147 - DNA, 266 bp, Homo sapiens
  misc_feature 70: m=a or c
  misc_feature 75: r=a or g
  misc_feature 76: m=a or c
  misc_feature 81: m=a or c
  misc_feature 90: w=a or t
  misc_feature 145: k=g or t
  misc_feature 146: w=a or t
  misc_feature 169: n=a, g, c or t
  misc_feature 170: w=a or t
  misc_feature 172: m=a or c
  misc_feature 196: k=g or t
  misc_feature 197: w=a or t
  misc_feature 211: k=g or t
  misc_feature 212: w=a or t
gggttggttggttttggctttgtttttaagcttgcttggaagattgtagggctggaagttagtggagaamgtatrmtgaamtcttcattwccggatgaaagttttaactccttacccagttagattgtgattttattgagatgakwcactgtagtgtccttagtatctnwgmccaaaacagacactgagtatatgkwtgcttatataactkwcatttgaaaatgaaaaacaagtggtgtcagcagtcaaattacaggcatgctttt

SEQ ID NO: 14148 - DNA, 182 bp, Homo sapiens
gatcacgccactccactccagcctgggcgacaaaatgagactgtgtttcaaaaaatatataaaaaagtaaaaacaaagaaaggcattggcaagtagcttataagaaaattaacttgtttaaagcaccatttctgagtgtgagtaaagattgtgtgctctgtgtggccctgccctgccctctg

SEQ ID NO: 14149 - DNA, 329 bp, Homo sapiens
  misc_feature 25: r=a or g
  misc_feature 26: r=a or g
  misc_feature 36: m=a or c
  misc_feature 82: s=g or c
  misc_feature 86: m=a or c
  misc_feature 148: m=a or c
aagatttcagctgcgggacggtcarrggagacctcmaggcgcagggaaggacgtgaggaggggaagcgggctggggcggcascggmgcggaggggcagctgcgcaggcggaatgaggaacgcctttgctctaaggcgaccaccctggmagctcttcactgagggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaagg

SEQ ID NO: 14150 - DNA, 99 bp, Homo sapiens
gaagagcgggaagaggcggacagcgaggccaagatttcagctgcgggacggtcaggggagacctccaggcgcagggaaggacggccagggtgacacgga

SEQ ID NO: 14151 - DNA, 191 bp, Homo sapiens
  misc_feature 126: w=a or t
  misc_feature 138: w=a or t
  misc_feature 162: k=g or t
  misc_feature 168: w=a or t
  misc_feature 179: r=a or g
cagttctttcactatatttggaagattttcagtcacatgggaagcttttcaaggcttgattattaatcatgctgcttagatcatgaatcatgaaattatttagtactgtttctagtacgtgtgtawtttaatactttwtttttggccttttttgcccttttktttttwaaacagatgtrgctaatgttacc

SEQ ID NO: 14152 - DNA, 436 bp, Homo sapiens
  misc_feature 20: m=a or c
  misc_feature 45: n=a, g, c or t
gtaactgaaaatccacaagmcagaatagccagatctcagaggagnctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaagccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccag

SEQ ID NO: 14153 - DNA, 186 bp, Homo sapiens
  misc_feature 144: s=g or c
  misc_feature 149: k=g or t
  misc_feature 179: s=g or c
cctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgasgccgkctgagttaccggcatccccgcagccacctsctctccc

SEQ ID NO: 14154 - DNA, 204 bp, Homo sapiens
  misc_feature 200: r=a or g
acagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctggggatcagctgggggctatggargcgg

SEQ ID NO: 14155 - DNA, 125 bp, Homo sapiens
agagcggtgggccgggggctggaggacaggtttgtgcgctggacgcaagcaccaggcgcactcgctcgccgagacccggccagaacgtgttacgagtcagtttttagtgaaaaaacattgagcta

SEQ ID NO: 14156 - DNA, 445 bp, Homo sapiens
  misc_feature 8: m=a or c
  misc_feature 172: r=a or g
  misc_feature 260: m=a or c
  misc_feature 272: s=g or c
  misc_feature 273: n=a, g, c or t
  misc_feature 274: n=a, g, c or t
  misc_feature 275: n=a, g, c or t
  misc_feature 297: m=a or c
  misc_feature 370: m=a or c
  misc_feature 382: m=a or c
  misc_feature 411: m=a or c
  misc_feature 424: n=a, g, c or t
gattcctmggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaagcaccarggcctgtgggaacacgagcgttgagactgggggcgtctagatgatccaaggggtaggcagagtgtgagcagcggcaggtatcggggamacacccgcggasnnnaaggaaggggactgaccgggamatggaagagctcggacctcaggcacatgcgaatgacccggagtgtggacaacgtccagttcctgccctttctmaccacggaagtmaacaacctgggctggctgagttatggggmtttgaagggagangggatcctcatcgtcgtcaac

SEQ ID NO: 14157 - DNA, 243 bp, Homo sapiens
  misc_feature 8: m=a or c
  misc_feature 148: k=g or t
  misc_feature 150: s=g or c
  misc_feature 151: w=a or t
  misc_feature 152: s=g or c
  misc_feature 167: s=g or c
  misc_feature 229: n=a, g, c or t
gattcctmggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgttkgswsgtccaccgccgaagsaccagggcctgtgggaacacgagcgttgagactgggggcgtctagatgatccaagggctcgnacctcaggcacatg

SEQ ID NO: 14158 - DNA, 131 bp, Homo sapiens
tctgggcagttctgatctgtgttcatgggttatttttcccattgtcagggtgaggcattcactctttggggaagtgaggaagctcatcacagacgagtttgtgaagcagaagtacctggagtacaagaagg

SEQ ID NO: 14159 - DNA, 395 bp, Homo sapiens
  misc_feature 143: k=g or t
  misc_feature 154: k=g or t
  misc_feature 158: k=g or t
  misc_feature 181: n=a, g, c or t
  misc_feature 182: w=a or t
  misc_feature 351: r=a or g
  misc_feature 352: w=a or t
  misc_feature 387: r=a or g
tgatttggagctgacagttattttgtgtaagcagagatttaattttatattgaaagtcagtgcaaaattatgaataggatatactaataaatacaaagtaataacaaaagtcaaagcagtgttctaaataaaaattctgggtkccttaaaaatkattkaaatttttatctttgaaatagtnwtcttagattaatctcaggatatgagaaagtcaattaagtgtgagtaaagttagtatcattaaacaaattgtctattaaatgcaagacgtggtaatatacagaatttatcaggcattaccaagtctaggcacatataggaaatgcagcactcagaatggtttcaatgtarwagttgatgcttgtaaggtaggggagcttattcagrcatagtag

SEQ ID NO: 14160 - DNA, 186 bp, Homo sapiens
  misc_feature 128: r=a or g
  misc_feature 130: m=a or c
attcctggcgaccactgcttctgtctctgtgaattttgactattctaggcacttcacaaaactggactcatacgatatctgtagttttgcgtctggcttctctatttaattcttaaaggggggtgggramtaagcagatcacaagggagctacccacagaggtaaagacaaggtcaggtaggctga

SEQ ID NO: 14161 - DNA, 395 bp, Homo sapiens
  misc_feature 153: y=c or t
  misc_feature 377: n=a, g, c or t
  misc_feature 379: s=g or c
gaccccgaaatggcgctgctggccgaacacttgctcaagccgctgcccgcggacaagcagatcgagaccgggcccttcctcgaggcggtgtcccacctgccgcccttcttcgattgccttgggtccccagtgtttactcccatcaaggcagayataagcggcaacatcacgatgaggaagctgagactcagaggggttgaaggactcgcttaaggtcacaagcaagtacgtggcaaagctgggattcagacccaggcctacctggctccatcgcagaggccttcgttcctggacttcttggaatcctcggaacctatttccacttgtccaccaaagcaaaacttcagatacttggtgtctgaggcagtgtcagtagntsctggagaacatgaact

SEQ ID NO: 14162 - DNA, 274 bp, Homo sapiens
  misc_feature 137: n=a, g, c or t
  misc_feature 248: r=a or g
  misc_feature 254: r=a or g
  misc_feature 258: m=a or c
  misc_feature 259: w=a or t
  misc_feature 273: m=a or c
tttcccggcggtgacttgaccccggaagtggggtgtgaagctccggtgctggtgcggcgggggactgcggggccagcctcaggtagcagcagcagcagcagcagcagcagcagcagcagcagcagcagcagcagcancatgttcacttctcagaaagcctccggaatctaaaaagccctcagtaccagagacagaagcagatggattcgtccttttaggagatacaacagatgagcaaagaatgacarcaagargcamwacttcggacatagmg

SEQ ID NO: 14163 - DNA, 59 bp, Homo sapiens
gcgatgtccttttgtgtcctacaagcagccggcggcgccgccgagtgaggggacgcagc

SEQ ID NO: 14164 - DNA, 230 bp, Homo sapiens
actctggtgtacagccagtccccgccgcggaggtgccggtggagcctgggaccgggcgagtctccgccccgcttttgcagctaggggtgtgtttcaggggggattggggcaagccaagcaggcgaggacctgggcctgtgccgctttgcctacccctcatccctcggcaccaaggctacttgagccccagggtgttttttccttgttcccgccacctcctggtccctggc

SEQ ID NO: 14165 - DNA, 196 bp, Homo sapiens
ctccaaactcattaagcaggctgagggcaggagttggctccatcagtggcgcctgagcacctcacagggagggagggatggctggagctgagtggtgctgcctcctttagacaggatatgccagttccaggctgccactgccttcccacaccccaccccaccccagcttgcttctgtcatttgttacctgccggca

SEQ ID NO: 14166 - DNA, 216 bp, Homo sapiens
agatatactgagtgagccctgagaagcagtctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagcc

SEQ ID NO: 14167 - DNA, 151 bp, Homo sapiens
ctaattcttaggagagtcttgtctgtttatcttattcagcgaaggcagttgtcagcccactagtgctgtcctgccagctgctccttcctctttgcaacctgcattctgattctctgctttttcataagcagtttactccccaacttcatgc

SEQ ID NO: 14168 - DNA, 96 bp, Homo sapiens
tgaaggatgaggccgcattcatactaagcatccaagtaaggagaagaccaagtgcaaaaagtttggtcgggatgagtgtgtgtgtgtgtgtgtgtg

SEQ ID NO: 14169 - DNA, 184 bp, Homo sapiens
ataagggcagggctcagatacaatccgagagcaggactaaagcatgagggcggccaaggcggaagggagtagggaaggaagcgccgcgcgtttccaagatacgcaggcgggctcggcgagagagcacgaagtatctgccccacgcaggaacggcaattttcccttgctcgctcctagaaaagcc

SEQ ID NO: 14170 - DNA, 260 bp, Homo sapiens
ggtgcaaaaattggctgggcagggtggtgggcatctgtagtcccagctattctggaggctcaggcgggagaatcgcttgaacctggaaggtggaggttgcagtgagccgagatggcgccattgcagttcagcctgggtgacaagagtgagactctgtctcgaaaaaaagaaaaaaaagagatagaggaagccctctgaagggtcttctcacagctgtgttaagcactatgattgaagcatgcttgatggaggaggcaaag

SEQ ID NO: 14171 - DNA, 145 bp, Homo sapiens
  misc_feature 113: n=a, g, c or t
tcttggttattctttctctcataccccacatgcagtcttatcagcaggtgctcatggctctactttgaatatgtatcctgaatctgaccactacttaaccatatccgtggctncacctagtctaagccaccattctctttcacct

SEQ ID NO: 14172 - DNA, 131 bp, Homo sapiens
agggaccccgtaagccactttgggagccacatccaccacttctctgaccccacgcaggctgcttcccaggcctcatggtactagtgtggacctcctggctgtgattaatgcagttttttagattaagtact

SEQ ID NO: 14173 - DNA, 100 bp, Homo sapiens
attttcttttagctatgattttcaaacagtcttcaggaagccataggtgagagggtgtacaggcgtggacattcccctggtatttttttaaaccacagat

SEQ ID NO: 14174 - DNA, 145 bp, Homo sapiens
  misc_feature 35: s=g or c
  misc_feature 143: y=c or t
accgcagtggctgagctgctgacaggaggcggcasggagtaggaggcgaggcaagacctgcggctcggcccggccacagccgcggtagtgctaggcaagcccacggagtcacgccggcctcagccagtctgcgaactctcgcycc

SEQ ID NO: 14175 - DNA, 228 bp, Homo sapiens
gtggaaacctcttcagcatttgcttggaatcagtaagctaaaaacaaaaccaaccgggtggcgtgcggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacct

SEQ ID NO: 14176 - DNA, 330 bp, Homo sapiens
  misc_feature 320: n=a, g, c or t
agagcattcccagaagcggggccagggcagtgcgcacagtgaggagagcaggtgtgtgtgaggttgaaacaaaacgttcaaagccccctcggaagcccatccacaggtgtgtgactgtgaaccgcatcgtaatctcctagaaagcaagaacatcaggcttacattttccacttgcctctcacggctcagagctctgcagtatatacacaatgtcagtgaagatggaaaacagaacgtggagagagatgtagcttactagagccctgtggcttcaatccccaccaggaatgtcgtttaagaggaaggtgatctagcacaanttcacatttg

SEQ ID NO: 14177 - DNA, 266 bp, Homo sapiens
  misc_feature 252: w=a or t
tataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctwtttctttaccccct

SEQ ID NO: 14178 - DNA, 110 bp, Homo sapiens
accggctggaaggaggggaagtgaatgaaaggacaggacaagccccgaacaccatgtcactctgggagggagacagcagcaactaagctgtacaaggttttttttttttt

SEQ ID NO: 14179 - DNA, 162 bp, Homo sapiens
gctgttatgggggctgaggtgttagatgggtttctctaatcactcaccattccattattggagctataagcccctagaattgctccatggcctatctcggtttcccttggatctcatctgctcctgaactgcacctgtctgtaaaaaaaacagatgcgagac

SEQ ID NO: 14180 - DNA, 449 bp, Homo sapiens
  misc_feature 163: n=a, g, c or t
  misc_feature 164: r=a or g
  misc_feature 165: n=a, g, c or t
  misc_feature 167: m=a or c
  misc_feature 172: s=g or c
  misc_feature 178: s=g or c
  misc_feature 182: s=g or c
  misc_feature 226: s=g or c
  misc_feature 332: s=g or c
  misc_feature 333: n=a, g, c or t
  misc_feature 335: s=g or c
  misc_feature 366: r=a or g
  misc_feature 380: s=g or c
  misc_feature 448: s=g or c
acttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcnrnamccggscggatsggcsgctgagcccgaatcgggcactgtgtggagccccctggagctgasatcaggatgttccgcttcatgagggacgtggagcctgaggatcccatgttcctgatggatccctttgctattcaccgtcagcatatgagccgtatgttgtcaggcsncsttggatatagccccttcctcagcatcacagrtggcaacatgccasggaccaggcctgccagccgccggatgcagcaggctggagctgtctccccctttgggatgctgggaatst

SEQ ID NO: 14181 - DNA, 97 bp, Homo sapiens
aagacaagggcggggggcggcagtcgggagagcccccaggaagccctgtagatgcccccaccccagcccatggagttgctatggttaagcagcctga

SEQ ID NO: 14182 - DNA, 185 bp, Homo sapiens
  misc_feature 158: m=a or c
  misc_feature 167: n=a, g, c or t
  misc_feature 168: s=g or c
  misc_feature 169: n=a, g, c or t
  misc_feature 176: n=a, g, c or t
  misc_feature 178: s=g or c
cccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcamccaggccansnaccagtngstcagcca

SEQ ID NO: 14183 - DNA, 129 bp, Homo sapiens
  misc_feature 121: y=c or t
tttttggcagcgtctgctgctttttggtggggtgtcgctccgggctggtggcggggccactgccccgcttgggggaagccgagcgatggtttgtgggcgccagttgtctggcgccgggagygagacccg

SEQ ID NO: 14184 - DNA, 261 bp, Homo sapiens
  misc_feature 112: s=g or c
ggtgtcgtgttctggaagcttagcggtcaccatggagctgctgggagagtacgtcgggcaggaagggaagccgcagaagctgcgggtgtcctgtgaggcgccgggtgacggsgaccctttccagggcctgttgtctggcgtggcccagatgaaggacatggtaacggaattattcgaccctctggtacagggggaagtgcagcaccgggtggcggcggctccagacgaggacttggacggtgagctctgagacggtgctgc

SEQ ID NO: 14185 - DNA, 254 bp, Homo sapiens
ttctcccaagccggcgtgggaccctctagtccgccgcccttcttgtttgtagctctgttcattgtctggtgggactttgctaagacttttggggtatattgttttccttttctcaatggaaactcaaatacctcaacttcggagtactcatcccattccctcccttaacccatccagatggtacctaagtgaaggaaccaggtaagggtctgattgttccttcctcccatccgtgaagatagctgatgcccgcg

SEQ ID NO: 14186 - DNA, 160 bp, Homo sapiens
aggcaacagagtgagactccgtctcaaaaaataaataaataaataaataaataacatgtcatgtattcctctggggctatatgacttctttgagactatgagctgtatagttgacccttgagcaacgcaggggctagggagcacaagcctacatttccaa

SEQ ID NO: 14187 - DNA, 87 bp, Homo sapiens
gtgctggcctaatgtctgtgtggactagggttacagcagcccggtttgaagcctctggtcgtgggaatggcttcttgggagagctcc

SEQ ID NO: 14188 - DNA, 136 bp, Homo sapiens
aggtagatagagttggctctttcaggagttggattcaggcacaggaatgtgcccctgggtgtttgaggtgaagcctgaagaaccagagttgagcctaggtgtatagagcggcctcccaggtcaaccccatagcatg

SEQ ID NO: 14189 - DNA, 409 bp, Homo sapiens
  misc_feature 348: n=a, g, c or t
aggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcggngtccaggagctgacaggccgctctgtggagtttgaggagatggacattttggaccagggag

SEQ ID NO: 14190 - DNA, 138 bp, Homo sapiens
ctatgttttatattatcaaggaagccttagattcactctgatctaagaaattattgaaattgaccctttttacacaaatgtctttaaaaaaaaaaacttatttctaaatgtccatagtgcatgcattttctaaaaccc

SEQ ID NO: 14191 - DNA, 131 bp, Homo sapiens
  misc_feature 128: m=a or c
  misc_feature 131: s=g or c
gatatttgtctaagccttcttaccctttctttaaataactcatatcttttagagtaacaggactacaaaagaaaaactgaaagaaaaaaaaaatcactgatttgcaggcaccattgcaaacttgtaamccs

SEQ ID NO: 14192 - DNA, 331 bp, Homo sapiens
  misc_feature 287: n=a, g, c or t
  misc_feature 288: w=a or t
taagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagggcagacactggcctcagatacctgacctggtaccctctatgaggcctgcggtgctgggctccccagaccgagcacccccagaagatgaggggcctgtcatggtgaagctagaggactctgagnwggagggtgaggctgccttatgggacccaggccctgaagctgca

SEQ ID NO: 14193 - DNA, 121 bp, Homo sapiens
acatccctatccgcaagcgagaccgccggggctgctttgcagttcccatggtgcactcgaccttcctgatcgacctgcggaaggcggcgtccaggaacctggccttctacccacctcaccc

SEQ ID NO: 14194 - DNA, 172 bp, Homo sapiens
  misc_feature 7: y=c or t
  misc_feature 69: m=a or c
  misc_feature 70: s=g or c
  misc_feature 78: s=g or c
  misc_feature 101: n=a, g, c or t
  misc_feature 162: n=a, g, c or t
agatgcytctgggtcgcggtgtgctaagcgaggagtccgagtgtgtgagcttgagagccgcgcgctagmscgacccgscgagggatggcggccaccgggancgcggccgcagccacgggcaggctcctgcttctgctgctggtggggctcacggcgcctgcnttggcgctgg

SEQ ID NO: 14195 - DNA, 201 bp, Homo sapiens
cctagccttcttcaaggcctccagggctgggcccaagcgcccgtcgacggcaccctgggcccagaggactcgcgggcctcatctccaatgattcagaactcacgtccgtcgctgctgcaaccccaagatgtcggagacacggtggaaacgcttatgttacatccggtgatcaaggctttcctgtgtggctccatcagcggg

SEQ ID NO: 14196 - DNA, 260 bp, Homo sapiens
  misc_feature 125: r=a or g
atttcttataggtgatacctgctaagcgctccccgcctacccagagactgggaggaacctggaaaatcctcacgtgaggtgaagcgcaggcgagtagggccagacatggtggctcatgcctgtartctcagcactttgggagactgagatgagaagatcacttgaggccaggagttcgagaccagactggcaacatagtgagaccctgtctctacaaaatgctggccaaggagcagggcctgcgcccgtggtctcataga

SEQ ID NO: 14197 - DNA, 142 bp, Homo sapiens
  misc_feature 104: r=a or g
acggggctgctgtaaggccgaggttgcggcggaagcggagaccatgttccgagcggcggctccggggcagctccggcgggcggcctcattgctacgatttcagrgtaccctggtaatagctgagcatgcaaatgattcccta

SEQ ID NO: 14198 - DNA, 315 bp, Homo sapiens
agtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacccgaacgtacggggtttcactatgttggccaggctggtctcgaactcctgacctcgtgatccacccaccttggcctcccaatcttatttgctttacaagtcctgcttcagggttaccttccctgaccactgctgcctccctcccagcatttgccagggactg

SEQ ID NO: 14199 - DNA, 192 bp, Homo sapiens
agccgccttgggatgtgcggagtcagtgccagcccggccccggccaagcggagtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatc

SEQ ID NO: 14200 - DNA, 158 bp, Homo sapiens
tgagccatgatgatgtggggctagggaggtgggtggtgcccaagcggcagtcccacactagcttcataagtgtggctttcgggcaagctcaggagagtgcctgctcctcccctcccaaggcacagatgcagtgggggagggagtaattggcagagggg

SEQ ID NO: 14201 - DNA, 256 bp, Homo sapiens
  misc_feature 56: m=a or c
  misc_feature 65: s=g or c
aaaaaccagctctaggcggctctgggtaagttgtcgttctgtgggctgcggaacgmgacttcggstggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgctgcttcttcatttttctcttgcggct

SEQ ID NO: 14202 - DNA, 192 bp, Homo sapiens
gaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcagtagatcctgaatgaataatataattggtatatgaggacatt

SEQ ID NO: 14203 - DNA, 396 bp, Homo sapiens
  misc_feature 234: n=a, g, c or t
  misc_feature 235: n=a, g, c or t
  misc_feature 317: n=a, g, c or t
  misc_feature 318: n=a, g, c or t
aattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagccnntctctcgctcagacgccatggagctggatctgtctccacctcatcttagcagctctccggaagacctttgcccagcccctgnnacccctcctgggactccccggccccctgatacccctctgcctgaggaggtaaagaggtcccagcctctcctcatccca

SEQ ID NO: 14204 - DNA, 126 bp, Homo sapiens
  misc_feature 66: w=a or t
actacttccgggttctagcattctggtcggaatccacctctccgcctgtgcaacacacactttacwcacgcacggggactgcaagcgggcagcatcgatcgtggctcctttaagacaaactcagac

SEQ ID NO: 14205 - DNA, 254 bp, Homo sapiens
  misc_feature 253: n=a, g, c or t
acaatccacgtcctgacccagctgatctgaagtgcggtgtgaagcgggcggccgcaagctcagcaacgcaggctctggtttctccacgctgtctttaataacatctgtcatacaaaaatcagcccggctcggtggcgcgtgcttataatcccagctactcgggaggctgaggcgggaaaatcgcttgaacccaggagggggatgttgcagttagccgagatcgcgccactgcgctccagcctgggcgacaganc

SEQ ID NO: 14206 - DNA, 200 bp, Homo sapiens
  misc_feature 76: s=g or c
gctttcacttcctcctccgagagcggacagatctctgggtgctgggcggtcatggcgctactagatgtatgcggascccccgagggcagcggccggaatcggctctcccggttgcgggaagcgggcgtcgctcggacccaggacactacagtttctctatgcgatctccagagctcgctttaccccggggaatgcagccc

SEQ ID NO: 14207 - DNA, 253 bp, Homo sapiens
  misc_feature 42: s=g or c
  misc_feature 43: s=g or c
  misc_feature 44: n=a, g, c or t
  misc_feature 52: s=g or c
  misc_feature 148: s=g or c
  misc_feature 201: s=g or c
ggcggccgagggggcatcatgaagcgggctggcggcgctgcssntcccgggsggccgcgggcgggaggtgcttcccaaggaccgtagatgcctctctagagcatgagctcaggcaagagtgcccgctacaaccgcttctccggggggsccagcaatcttcccaccccagacgtcaccacagggaccagaatggaaacgacsttcggacccgccttttcagccgtcaccaccatcacaaaagctgacgggacca

SEQ ID NO: 14208 - DNA, 270 bp, Homo sapiens
  misc_feature 102: r=a or g
  misc_feature 262: s=g or c
  misc_feature 264: n=a, g, c or t
gggcggtacttttatgcgaggaggtgctggagggtgggcttgcgctcggcgtttcagtgctggtcgcgctctggctgggcacgaacgtagaggtcaggctarggctgacgatgctggctaagcgggggcgcacgtctgggaagtcgtcgtcgtagtcaccgatgtccgtgaccttccagaggtactcttcgctgaacgtctcaggggcctccaactcctgctcttcccccaccaactcctcctccaccacctcctcctcctscncctcca

SEQ ID NO: 14209 - DNA, 129 bp, Homo sapiens
  misc_feature 124: y=c or t
agagccgcggcgtaacggcagccatcttgtttgtttgagtgaatcggaaaggaggcgccggctgtggcggcgggagctgctcggaagctacacctcgcaagggctcccccctttccccaccccytcccc

SEQ ID NO: 14210 - DNA, 226 bp, Homo sapiens
ctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccaccca

SEQ ID NO: 14211 - DNA, 114 bp, Homo sapiens
tcactactagatgcagtgctgggaccttcctcttttggagctgtcccatgtacagtggacccaagctcaggaccttcgtggagctgcttctccaacctgagaaactcaagaccc

SEQ ID NO: 14212 - DNA, 325 bp, Homo sapiens
  misc_feature 62: w=a or t
  misc_feature 321: n=a, g, c or t
agaggaggaagctcctgccggctgagcgggcctggaggaagtgagcagcggggctcctgccwcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaangaac

SEQ ID NO: 14213 - DNA, 148 bp, Homo sapiens
actcttaaaaggctcccacagccactcctagcaccagttgttgaccagcctgccacttgcctccctgcctgcttctggccgccttgaatgcctggtccttcaagctccttctgggtctgacaaagcagggaccatgtctacctttggc

SEQ ID NO: 14214 - DNA, 151 bp, Homo sapiens
gttgcccccgccgcgggccgagatggattccgggtgctggttgttcggcggcgagttcgaggactcggtgttcgaggagaggccggagcggcggtcaggaccgcccgcgtcctactgcgccaagctctgcgagccgcagtggttttatgaa

SEQ ID NO: 14215 - DNA, 392 bp, Homo sapiens
  misc_feature 229: y=c or t
  misc_feature 354: n=a, g, c or t
  misc_feature 369: n=a, g, c or t
gtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggyctctacagaaatgtgatgatggaaacctatgggaatgtagtctcattgggacttccaggatccaagcctgacataatctcccagctggagcgaggggaagatccctgggtcctggacaggaaggnggctaagaagaagcnagggcctgtggagtgactactca

SEQ ID NO: 14216 - DNA, 309 bp, Homo sapiens
aacttgttcgcgttttgttctgtactggaagcttttttttcttttggtctttgcaatgaattatgttgctgctccctttttgggcctacattgtctttataagctgtaacgctcaccgctgaaggtctgtagcttcacttttgtaagctagcgagatcacgaacccaccaaaaggaaaaaactccagacgcgccaacttaagatttgtaatattcattgtgagggtccgcagcttcattctttaagttagtgtgagaccaagaacctactaattcggaacacagtctcagctcattgcaaccttcacct

SEQ ID NO: 14217 - DNA, 235 bp, Homo sapiens
  misc_feature 16: m=a or c
  misc_feature 111: s=g or c
  misc_feature 112: s=g or c
  misc_feature 151: r=a or g
agattctggcaggacmgctggcgggcaggcaggggacagttgggccatatggtgctcttcccagtctggttcctgtacagtctgctcatgaagctgttccagcgctccacssccagccatcaccctcgagagcccggacatcaagtacccrctgcggctcatcgaccgggagatcatcagccatgacacccggcgcttccgctttgccctgccgtcaccccagcacatcctgggc

SEQ ID NO: 14218 - DNA, 437 bp, Homo sapiens
  misc_feature 282: n=a, g, c or t
  misc_feature 372: n=a, g, c or t
ctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgtnctcattattcagcgcccacttataagtgagaacatgcagtaaaacactgcctttataggcttccttcccttcactgtcttacttccccantccctactgctgctctctgggatcacctctcacagaagctgtttgtactttaatcattgtctgag

SEQ ID NO: 14219 - DNA, 358 bp, Homo sapiens
ttttaactaggaaggaatagtaaaaggtctaagcagccacgttgtcagaaagcttcagttcatactgtcctccacctgggacttgtgaatccctgtgttacctatggctggactcagtatattcattatgttcatataatgcaaatatttagaagtgaggctgacctgttttttatattttttaaagtaaatctcagaatcagagaaattatcatttcctttgatctaagaagttagtgactcactttagtaagagaaatatttttaaaggcacagaaaaaagactaagaattataataatataagaaaatatttctgactagaaatattacagtataactattgctgggtaattagc

SEQ ID NO: 14220 - DNA, 143 bp, Homo sapiens
  misc_feature 80: k=g or t
  misc_feature 99: k=g or t
  misc_feature 100: y=c or t
ttaagcttcctcagaggttttggggtttgccagcctgatccaccatggtacccaccttcatccacggtacccacccccakcccccaattcccagtgatkycactcctgtttactttgttccactttcttacaagaaaaatcac

SEQ ID NO: 14221 - DNA, 304 bp, Homo sapiens
  misc_feature 4: w=a or t
attwtttttgagaagctgaagcaactccaaggacacagttcacagaaatttggttctcagccccaaaatactgattgaattggggacaattacaaggactctctggccaaaaacccttgaagaggccccgtgaaggaggcagtgaggagcttttgattgctgacctgtgtcgtaccaccccagaatgtgcactggaggctgtgccagatgcctgggggggaccctcattccccttgctttttttggcttcctggctaacatcctgttattttttcctggaggaaaagtgatagatgacaacgac

SEQ ID NO: 14222 - DNA, 294 bp, Homo sapiens
attatttttgagaagctgaagcaactccaaggacacagttcacagaaatttggttctcagccccaaaatactgattgaattggggacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggtggacttcaaat

SEQ ID NO: 14223 - DNA, 120 bp, Homo sapiens
gcctgagagggacgctgttccgccgcgtggaagcttcgagtctcgactccactgttgacccctagacgagagtagtgcagcgacggggccgtgatgtgcgtcctggctttcttaacgaca

SEQ ID NO: 14224 - DNA, 319 bp, Homo sapiens
agaggttacagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcagggagtggagagtgtgaggtgccaaagactagtaatgccccgtatccccctaggaagccgggaagccaagctccgcgggaccgcttcatgccgctgactggtgtagagcccgccagaatgaacaggaaga

SEQ ID NO: 14225 - DNA, 376 bp, Homo sapiens
  misc_feature 124: m=a or c
  misc_feature 125: m=a or c
  misc_feature 229: r=a or g
  misc_feature 230: r=a or g
  misc_feature 301: n=a, g, c or t
  misc_feature 359: k=g or t
ttctgctggttaatgtatcttacgccacggatcatttatttttatgaagctttcaagtctttgtgtgcaagtaaaatgatgttgtggcgttgttcttggatggtaagtggactgcctagaggammtttgttaaaggtcaaagacaaattgtacacatatggagaaaattagcaatgctgtagtcttaaggaaaaaatgatttatcattcatatcaaaaagagtttagcrratggaaaaccagttaatgctttaattttaaaatgttttggttgtcttacttttccctaaaaatgacatgangtaaaaaatggatacttttaaaatcccttcccttctgctattttctggcttttaaagkgattattcaaaaatgaa

SEQ ID NO: 14226 - DNA, 489 bp, Homo sapiens
tggcctcgggaagctttgctcactttcgctcactctccggggacccctggcaccactatcatgggaatgagcctgggctggcctgttggagcatgggagaccgcgtggagccgagatgagttgtcccagatgggacatttggaccggccggtctctgccaatatcagccaggcctggcctggatctgctgagtgtggcccaaactgccaaaccagagtcacagtctaaataagtgctcatagcagcattgtttacaatagcaaaatggtggcagcaacccaagcgtccatcaaaggatgaatggttaaacagtatgtggtatctacatacagtggaatattagccagccttaaaaaggagggaaatcctgatgcatgctaccatgtgggtgaaccttaaggacattatgctaggtgaaataaagccattcacaggacaaatattgcataattccacttataagagggtctaaaatagtcaactcataga

SEQ ID NO: 14227 - DNA, 78 bp, Homo sapiens
attttcccaccctttctgtttctctgaatcacaatgactttattttagcttgttacttacacaaggaaaatgatccct

SEQ ID NO: 14228 - DNA, 263 bp, Homo sapiens
  misc_feature 224: n=a, g, c or t
  misc_feature 225: y=c or t
aaaaatttcagcagagagaaatagagaaagcagtgtgtgtgcatgtgtgtgtgtgtgagagagagagggagaggagcgagagggagagggagagagagaaagggagggaagcagagagtcaagtccaagggaatgagcgagagaggcagagacaggggaagaggcgtgcgagagaaggaataacagctttccggagcaggctcacatacactccctctctctcnycttctctccctctcctccctctccccctacctatcccc

SEQ ID NO: 14229 - DNA, 128 bp, Homo sapiens
agtcaattttaaggaattaatcttttatatataatttatcagttttcatttctaatatggtaaataccaatagttacaatccacatgaaaaaaacttctttgagtcttcaatttttaaacatgccaag

SEQ ID NO: 14230 - DNA, 318 bp, Homo sapiens
  misc_feature 307: n=a, g, c or t
agagacattccggtcgggaagggcaggaggttagaaggtgggtgccccgccaggcagtccagggagacccaaggacaggagacgctggctgcacagcacaggggcgcacgaataggacgttttgtttacaggcttttgttattaaggaaattggtgtcagtcaaggtaattctagctcagatgagcaataaatatgctcccagctaatcttgtggggattttattggcactcggagcagaggttcctttaccttgactactccctcccctcaaagcaaagtcctgctccccagcggcttccccctanagcatcgtgaa

SEQ ID NO: 14231 - DNA, 107 bp, Homo sapiens
gttttctgctctccgcccgtgtggagtggtgggggcctgggtgggaatgggcgtgtgccagcgcacgcgcgctccctggaaggagaagtctcagctagaacgagcgg

SEQ ID NO: 14232 - DNA, 136 bp, Homo sapiens
atgcgagtgggccgcgggcggggttggagcctactcggggcgactgcgatggacgccttagaaggagagagctttgcgctgtctttctcctccgcctctgatgcagaatttgatgctgtggttggatatttagagg

SEQ ID NO: 14233 - DNA, 88 bp, Homo sapiens
tcaaggagcagcgcccccaaaggtctttagctgttttttaaggggagaacagcctttaccctctttggactttttcttcgtttttttt

SEQ ID NO: 14234 - DNA, 199 bp, Homo sapiens
  misc_feature 48: r=a or g
  misc_feature 139: r=a or g
aacttccggccctgcgcactcagggtctgagcagctagtagccggagrgtcaccatgaagttcaatcccttcgttacctcggaccgcagtaaaaaccgcaaacgtcacttcaatgccccctcacacgtgcgcaggaagrtcatgtcatccccgctctccaaggagctgcggcagaagtacaatgtccgctccatgcccc

SEQ ID NO: 14235 - DNA, 602 bp, Homo sapiens
  misc_feature 123: w=a or t
  misc_feature 124: r=a or g
  misc_feature 129: w=a or t
caatgagaactagagccaggctgtggtccctggccatcaacagtgttggtgacggcagggagtccctttggtttaataaatccagtttttctttgggtatccaaattctcccctccttttgtwrgaggwaaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtcc

SEQ ID NO: 14236 - DNA, 107 bp, Homo sapiens
gttgaggctgcggtcatggagggagcaggagctggatccggcttccggaaggagctggtgagcaggctgctgcacctgcacttcaaggatgacaagaccaaagtgag

SEQ ID NO: 14237 - DNA, 106 bp, Homo sapiens
tttgtcgggctgctgctctcagcggcggggctcgccagcgcttcagtgggcggggacgcggcaggtgactccagaccaaggaggatgagctgctgtccctggaaga

SEQ ID NO: 14238 - DNA, 234 bp, Homo sapiens
ctttgttggtttctccaccataaatccacatccaggaaggagtcctcaaatctacagatagcctcaacataggacaagaggctcaatgtcattcattattggtgaaatgcagatgaaatcacaataggattaataaaaatacaaacaaacaatgataccaagtactgagcaacgatgtggagcaactagaactcccatgcatcaggaaacatgcacggaaatgtccactgcagc

SEQ ID NO: 14239 - DNA, 104 bp, Homo sapiens
tttaacaacaaattagcagaacaactggatgttctggaagttgagatcccttcacttcattttttttccttcccccgctgccaaggagttatcctgtggactgc

SEQ ID NO: 14240 - DNA, 234 bp, Homo sapiens
  misc_feature 226: s=g or c
accagaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggasccacactg

SEQ ID NO: 14241 - DNA, 222 bp, Homo sapiens
tattgtaattgggaatccaggaagaattataatttgttttgattttgatttttagaaagaggagttaaaactgacacaagagttagagataatgatttagttgggacactttcacactgacgtatccaaggatatattcaggcacttggataaatgagtgtgaaactcataaaggttagaaggaataattgagttattagtatctgtttttttttttttttt

SEQ ID NO: 14242 - DNA, 184 bp, Homo sapiens
acttcatggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagacc

SEQ ID NO: 14243 - DNA, 112 bp, Homo sapiens
  misc_feature 10: k=g or t
  misc_feature 85: s=g or c
  misc_feature 87: m=a or c
  misc_feature 103: k=g or t
gatagggcgkttctatgtagatgaggcagcgcaggggctgctgcttcgccacgaaggatttcccgtgccgtgggagcgggttcasgmccgctggtcggacctkagagtccca

SEQ ID NO: 14244 - DNA, 92 bp, Homo sapiens
taagacgaggctgcgcccggattccggtccgcagggagaccgaaggcacagctccccgcgccgcgcacgccgcccgagcccggagtgcggtc

SEQ ID NO: 14245 - DNA, 132 bp, Homo sapiens
tttgtttccaaggcagaatagttcccttgaatatttaatagcttctgatggtcttcttccagctggtcccacacgtggcagcctcacggaggggctccctgaggcaggaccctcatgcctgccttttccctg

SEQ ID NO: 14246 - DNA, 715 bp, Homo sapiens
  misc_feature 344: s=g or c
  misc_feature 477: y=c or t
  misc_feature 654: k=g or t
aagacacaatggggcacggtaaccagactggtccgtaagggttccaggaaggaatgcagtttcaagagaacagtttgaatctttattcgaatttgaattttggtacaatgaagagagtcagctgcaacttgacaatcgaaatcttcagaaaagcgacacaaatacgttcgcctcgaggaatattgggtcttctgcgcggccgtagagctccgccaagtgcgcctgcgcggaggagaagtggcgtcgagtccggccgggcagtagaggaattgcggtagtgaccctcgggcctcgccatgaagagccgctttagcaccattgacctccgcgccgtactcgcggastgaatgctagcttgctaggaatgagagtaaacaatgtttatgatgtggataataagacataccttattcgtcttcaaaaaccggactttaaagctacacttttacttgaatctggcatacgaattcatacaayagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggkaagttaaatttgtgggatatggtgaaggaaaatttcttattaatcattttgtaatagtgct

SEQ ID NO: 14247 - DNA, 65 bp, Homo sapiens
gcttaggcggcggtggctgagaaggcagcggggcggcggcggcctctgggagtctggaaaagggg

SEQ ID NO: 14248 - DNA, 269 bp, Homo sapiens
  misc_feature 37: w=a or t
  misc_feature 90: m=a or c
  misc_feature 258: m=a or c
cttttcccccgagcgcgcagtggcagcggtggttgtwtctgttcggggaggattccgagggtttcagctgttgacgctttacgcgttgcmggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggmacgtcgaaggg

SEQ ID NO: 14249 - DNA, 328 bp, Homo sapiens
  misc_feature 110: w=a or t
aggagtgaaaaggaggcggcggccgcagctgcgagcaacagatccggacgccgcgagctgacccgctctgctgttgggcgatttttttttaattgcagaaaaatttattwaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggc

SEQ ID NO: 14250 - DNA, 183 bp, Homo sapiens
accccatctcgattatgtccagctagcccctgataagtccccttctgggccagaggagtgcagccacaaggccaggtggaggcaatgtagccactgatcttttcttgctgtcagtgggcagcatctttaaggagactctcagtgagttgcatttcttttttcttttttcttttcttttttttt

SEQ ID NO: 14251 - DNA, 311 bp, Homo sapiens
agcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggagga

SEQ ID NO: 14252 - DNA, 104 bp, Homo sapiens
tttggaaggggaggtggagtccagggaaggccgcagagctccaggctgtggaatgcacgtgccactgcagaagggtttccaggccaggagactgcccaaatggg

SEQ ID NO: 14253 - DNA, 235 bp, Homo sapiens
agcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctgatggagtttcactcttgttgcccaggctggagtgcaatggcacgatctcagctcactgcaacctctgccg

SEQ ID NO: 14254 - DNA, 221 bp, Homo sapiens
acctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgaccccc

SEQ ID NO: 14255 - DNA, 386 bp, Homo sapiens
  misc_feature 12: y=c or t
  misc_feature 13: y=c or t
  misc_feature 37: n=a, g, c or t
  misc_feature 38: n=a, g, c or t
  misc_feature 39: n=a, g, c or t
  misc_feature 177: s=g or c
  misc_feature 179: n=a, g, c or t
  misc_feature 228: s=g or c
  misc_feature 385: r=a or g
gaaagaacccayygctggggctggccggcgtgtgccnnngagcctctaaggagatgaaactgcactcaaccaggatgagaggctgcccggccaatgcagctgccgccccgtctgctgcggaggctttgctttttgactccctggcgacagtaaagttgaagagcttccggccggagsanatagatgggacccccggaaggcggaagttctagggcggaagtggccgasaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacgrc

SEQ ID NO: 14256 - DNA, 352 bp, Homo sapiens
  misc_feature 122: r=a or g
  misc_feature 128: y=c or t
  misc_feature 144: n=a, g, c or t
  misc_feature 155: s=g or c
  misc_feature 236: n=a, g, c or t
accaaaaacagtctcaaaaacaaccatttcctctctgctgagagccagggaaggcgagctctgcgcacacgggcgtccctgcagcagccactctgctttccaggaccggccaactgccctgraggcayccacacaggggcccangcagcacagasgagctgtgaacccgctccacaccggccaccctgcccggagcctggcactcacagcaggccggtgctaaggagtgtggcgcnggctcgactcccactgctgccggcctcccgagtgactctgttttccactgctgcaggcgagaagaggcacgcgcggcacaggccggcctccgcttcccgggaagacggcgcactcc

SEQ ID NO: 14257 - DNA, 127 bp, Homo sapiens
  misc_feature 107: y=c or t
aatttagcgcggagagtttcccgggtggacgcggctcctctctcggccactccgcacccccatcttcggtgacagaaggcgcctggtgggggtggctgctcttttcyctccctgttccccctcacag

SEQ ID NO: 14258 - DNA, 268 bp, Homo sapiens
  misc_feature 12: s=g or c
  misc_feature 126: s=g or c
  misc_feature 133: s=g or c
  misc_feature 135: r=a or g
  misc_feature 137: r=a or g
  misc_feature 144: s=g or c
  misc_feature 152: r=a or g
  misc_feature 155: s=g or c
  misc_feature 156: s=g or c
  misc_feature 173: s=g or c
gcaccgcgccascgggctgcagcggccgcgcaccaaggctgcgatggggctggagacggagaaggcggacgtacagctcttcatggacgacgactcctacagccaccacagcggcctcgagtacgscgacccsgrgragttcgsggcactcrgassaggaccgggatccccascggctcaactcgcatctcaagctgggcttcgaggatgtgatcgcagagccggtgactacgcactcctttgacaaagtgtgaatctgcagccatgc

SEQ ID NO: 14259 - DNA, 269 bp, Homo sapiens
gttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaa

SEQ ID NO: 14260 - DNA, 588 bp, Homo sapiens
  misc_feature 275: s=g or c
  misc_feature 318: n=a, g, c or t
  misc_feature 319: m=a or c
  misc_feature 320: w=a or t
  misc_feature 390: m=a or c
  misc_feature 393: s=g or c
  misc_feature 408: m=a or c
  misc_feature 409: m=a or c
  misc_feature 429: n=a, g, c or t
  misc_feature 476: m=a or c
  misc_feature 544: w=a or t
  misc_feature 566: r=a or g
  misc_feature 569: m=a or c
  misc_feature 588: m=a or c
aatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaascaaagtagtctacgccgccagaagagagagaaggaaacatcgnmwagcaggggtatttctcggttcataccgccatggcttaagaagcaaaagtcatataccttagtagtggccmaasatggaggagataaammaagagcctacccaagctgtngttgaagaacaggtcttagataaagaggaaccccttccagaagaacmgagacaggctaagggtgatgctgaaaaatggctcagaagaaacaagagattaaagttgaagtcaaggwagaaaaaccctcagtgagcaargamaaaaccctcagtgagcaam

SEQ ID NO: 14261 - DNA, 203 bp, Homo sapiens
  misc_feature 22: s=g or c
  misc_feature 23: s=g or c
gtggttccccgcggcgctgcgssggcggtaattagtgattgtcttccagcttcgcgaaggctaggggcgcggctgccgggtggctgcgcggtgctgcccccggaccgaggggcagccaacccaatgaaaccaccgcgtgttcgcgcctggtagagatttctcgaagacaccagtgggcccgttccgagccctctggaccgccc

SEQ ID NO: 14262 - DNA, 350 bp, Homo sapiens
  misc_feature 184: s=g or c
ggaagtggcacgtggaggggccggtggaggcgccggtgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggasgacctgcggaggctgagccccgctttctcccagggtttcttatcagccagccgccgctgtccccgggggagtaggaggctcctgataagaaaccctgggagaaagcggggctcagcctcttgcacgctccgttgcacgcctgctcacctctctcccctcccggccc

SEQ ID NO: 14263 - DNA, 383 bp, Homo sapiens
  misc_feature 184: s=g or c
  misc_feature 187: n=a, g, c or t
ggaagtggcacgtggaggggccggtggaggcgccggtgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggasgancctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagagg

SEQ ID NO: 14264 - DNA, 354 bp, Homo sapiens
  misc_feature 121: s=g or c
  misc_feature 347: n=a, g, c or t
  misc_feature 348: n=a, g, c or t
agtcgcgcccctccctctccgcccccaccccctgtcggcgtctgggcctcgtccccttctctctgtctcccttgcctcccccatcacgtcccctgacaccgacaccccattgctcccacastctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgnngtgcac

SEQ ID NO: 14265 - DNA, 238 bp, Homo sapiens
ctggagttcccagccaagccacagacctgcctctgaggaagggaatcgagcagggagtaggaggggacctctggggactcgggcctggagctcctgcctgcctggatgaagaggaggtcaagactttgtcccccactccgcaagataccctctctgttccggagcggtgagacgggatttcaccatgttagccaggatggtcttgatctcctgacctcatgatctgcccacctcggcc

SEQ ID NO: 14266 - DNA, 405 bp, Homo sapiens
aaaggcggggcccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgcc

SEQ ID NO: 14267 - DNA, 417 bp, Homo sapiens
  misc_feature 138: r=a or g
  misc_feature 236: m=a or c
  misc_feature 388: n=a, g, c or t
ttaatccccaatgtggcagtattgtgtggtgggccctttaagaggtgattagatcatgagggtggagcccttatgaatggattaatctcttcatggattcatggattaatgggttaatggattaatgggttacttggragggggactgatggctttataagaagagggagagagaccttagctagcaagggagcagctcagcaccccctccatatgatggcttgtactgcctgggmactctgcaggtgtcccccaccagcaagaaggccctcaccagatgacactcttgaccttggacttctcagactccataactgtaagaaataacttccttttctttacaaattacccagtttcaggtattctgttataagcaacagaaaatggnctaaaacactatatatctttctagatctt

SEQ ID NO: 14268 - DNA, 210 bp, Homo sapiens
cagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggac

SEQ ID NO: 14269 - DNA, 301 bp, Homo sapiens
  misc_feature 236: y=c or t
gggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggygaggactgccccaaggtggattttcctacagctattggtatggtggtagaaagagatgacggaag

SEQ ID NO: 14270 - DNA, 113 bp, Homo sapiens
aagtgtggctgagctccggggtgtgtggacgccgctttgttgcctgagatgaagttggagcccttgtttttgacattggatcctatactgtgagagctggttatgctggtgag

SEQ ID NO: 14271 - DNA, 302 bp, Homo sapiens
  misc_feature 53: s=g or c
  misc_feature 209: s=g or c
  misc_feature 210: n=a, g, c or t
agactacgtggcggcgctggaagggatgtcgtctcagcagtgctcgggcgcastccagctgctgctggttcctagaacccagaccacccatcgggggctggaaaggaagccaaatggccccagcatttcccaggaatgttacattttgacaatcaattacccactttaggtgtgacctcctcttctccctcccagctccccgcaggaasntaattagaattatccccattctacaggactgggaaatgaggctgtgagagtgaggaactgaggaacttgctgggatttgaacaaaggcaaag

SEQ ID NO: 14272 - DNA, 127 bp, Homo sapiens
acgggggcaagggccgcctcccttcggccgcgcgccactcaagtacggcagacaggcagcgaggttgccgaggccgaggctagcctgcagcctcctttctcccgtgccctgggcgcggggtgtacgg

SEQ ID NO: 14273 - DNA, 383 bp, Homo sapiens
  misc_feature 7: n=a, g, c or t
  misc_feature 8: s=g or c
  misc_feature 9: y=c or t
  misc_feature 72: y=c or t
  misc_feature 290: k=g or t
  misc_feature 291: k=g or t
  misc_feature 329: r=a or g
  misc_feature 330: s=g or c
agccagnsygaccccgccaggccttctcggttgggtgagcactctctctgaccaggccatgaaaagaaaaayctgtgcgatgcctccccacatgtcacgggactctgacttgcctttgtcgtcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaackkgtttttccagcctagttggaaacttgtggatgctgtgrsctcaagaagacttggcattttatttggaagatagacatctatttgcaactgtc

SEQ ID NO: 14274 - DNA, 235 bp, Homo sapiens
  misc_feature 234: r=a or g
aaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggacctccgaccccccaagggctagaggagcgctcggcggaccaaagaaagcccgcgagcggctgcgcrc

SEQ ID NO: 14275 - DNA, 346 bp, Homo sapiens
  misc_feature 40: k=g or t
  misc_feature 63: m=a or c
  misc_feature 64: s=g or c
  misc_feature 65: r=a or g
gacattcgggccgcggcggccgctgggtgcagccgagcgktgtggagcggagagaatactcamsrgggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtaggttgggggtatatttttgttttgggataaaaagaaactgaatcttataaatattaaatgggttaagatgtgagtaaatttttgggtttagac

SEQ ID NO: 14276 - DNA, 312 bp, Homo sapiens
aatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcaaaaacctacccaaacagcttgctgttataagccctgaga

SEQ ID NO: 14277 - DNA, 318 bp, Homo sapiens
  misc_feature 15: r=a or g
  misc_feature 124: m=a or c
  misc_feature 185: y=c or t
  misc_feature 186: w=a or t
tgaccgagaggaccrggaagcacctgactcagatgccgaggtggatggtgtggatgaagaggaggaggacgaagaaggagaagatgaggaagacgaggacgatgaggatggtgaagaagaggamgtttgatgaagaagatgatgaagatgaagatgtagaaggggatgaggacgacgatgaagtywgtgaggaggaagaagaatttggacttgatgaagaagatgaagatgaggatgaggatgaagaggaggaagaaggtgggaaaggtgaaaagaggaagagagaaacagatgatgaaggagaagatgattaagacc

SEQ ID NO: 14278 - DNA, 167 bp, Homo sapiens
  misc_feature 36: s=g or c
  misc_feature 37: n=a, g, c or t
gagcgtgtttacatccgccgggtgcgcggcttcgcsnccgaggtcgttcggctcgggtaccatcctccgcgccatggacaccagcgacctgttcgccagctgcaggaagggggatgtgggccgagtgcggtacctgctggagcagcgagacgtggaggtgaatgtac

SEQ ID NO: 14279 - DNA, 187 bp, Homo sapiens
  misc_feature 129: s=g or c
  misc_feature 158: r=a or g
tttttttgtggcccgctatggcggcggtgttgaggttgggtccgggatgcggggtctttgactgaaggggtaggccaagtggaggtatcagggacgtcgcgcggcacagaagaggaccagcctggacgscggggacgctgtcatgtacggcgcgagcrggggccgcgccaaaccagaggaaaagcgg

SEQ ID NO: 14280 - DNA, 191 bp, Homo sapiens
acaatggcctcagaggtcactgagggtggccagatgtctgggtggaagggtctcatcctgttttccagctccattccaggcagcatcctcacgatccaaagaacggcataaggggcccctgtttcctgagacccagtcagagctcctatactctcccaccttgttcctctgagctgacaaatgacatcgga

SEQ ID NO: 14281 - DNA, 235 bp, Homo sapiens
tggtctcaatctcctgacctcgtgatccacccgccttggcctcccaaagtgctgggattacaggcgtgagcaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaatagg

SEQ ID NO: 14282 - DNA, 129 bp, Homo sapiens
agactgaggctagttaccacgtcagtgagctgacagggaaggtacccggctctactgcccgtcccggacgactcatcctggcggactgtgcagtcccaccctgacttcagcctcaatttccaggaaaca

SEQ ID NO: 14283 - DNA, 220 bp, Homo sapiens
tacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggg

SEQ ID NO: 14284 - DNA, 287 bp, Homo sapiens
ataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccacccc

SEQ ID NO: 14285 - DNA, 407 bp, Homo sapiens
tgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaaga

SEQ ID NO: 14286 - DNA, 121 bp, Homo sapiens
atagcgcagatggaaagtgggaccaaggtcacagggttcatgagtgagcagtgaggccaggaaacacatgcctgtctgtctgcatccgattcctcttcctgccacactcagcaccacctcg

SEQ ID NO: 14287 - DNA, 95 bp, Homo sapiens
ttttttttttgcgccggctgtgacaagcgctgcggcatttgtccccgcgacagcaccgctgccgccgtctctaaggtcgcccgggtcccaccgcc

SEQ ID NO: 14288 - DNA, 472 bp, Homo sapiens
  misc_feature 220: k=g or t
  misc_feature 221: n=a, g, c or t
  misc_feature 222: n=a, g, c or t
  misc_feature 223: k=g or t
  misc_feature 456: r=a or g
  misc_feature 457: r=a or g
ctaaggtcaagagaagtgtcagcctcacctgatttttattagtaatgaggacttgcctcaactccctctttctggagtgaagcatccgaagaatgcttgaagtacccctgggcttctcttaacatttaagcaagctgtttttatagcagctcttaataataaagcccaaatctcaagcggtgcttgaaggggagggaaagggggaaagcgggcaaccacknnkccctagcttttccagaagcctgttaaaagcaaggtctccccacaagcaacttctctgccacatcgccaccccgtgccttttgatctagcacagacccttcacccctcacctcgatgcagccagtagcttggatccttggtgggcatgatccataatcggtttcaaggtaacgatggtgtcgaggtctttggtgggttgaactatgttagaagaaggccattaatttgcctgcrrattgttaacagaagg

SEQ ID NO: 14289 - DNA, 371 bp, Homo sapiens
  misc_feature 89: y=c or t
  misc_feature 282: y=c or t
  misc_feature 319: n=a, g, c or t
  misc_feature 342: r=a or g
  misc_feature 343: k=g or t
gcgggagcttccgggagggcggctcgcaggcaccatgactcctgtgaggatgcagcactccctggcaggtcagacctatgccgtgcccytcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatccyggtcctggggaaccatctggtttccctgtgtgggagnggctgaagtgagagcccaacttrkaagcttttactcctgggagtccgagagc

SEQ ID NO: 14290 - DNA, 186 bp, Homo sapiens
  misc_feature 88: s=g or c
  misc_feature 182: s=g or c
agtgacaatcaggaagtcggcgtgtcgagtggctcttcctggctgctgaggcgggttaaggtctgagggtcttgtggggccacggcgstgatcaccaggtgtttggcttggtcggttcttatttctcgcctggcaatggcgacgtacacctgcataacttgccgggtggcgttccgcgacgsgaca

SEQ ID NO: 14291 - DNA, 442 bp, Homo sapiens
taattatatcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtgggatttttttgtttgctttattaccattcagctatccttttcaggttgcctgaagctagaaagatcttaaattctcaatttgtttgaactttaaaaacctagaaaattgctcattgccattctgtgtttcctctaaaaactgagttttcacaattttggatttagtaaaaatgtatgttcatcattggattataaagtaaaacaaacattctggaaagaatctggaa

SEQ ID NO: 14292 - DNA, 141 bp, Homo sapiens
  misc_feature 34: s=g or c
tacagtttagtcattgactaacttggacaactgsgtgcctatcattgaatagttgtgaatattcaataaggtgaagagatgctacctgtagtaagggtgcagtagataccagctgctgctgctcaccttactgctgctcct

SEQ ID NO: 14293 - DNA, 116 bp, Homo sapiens
agcagaactgggaggaggagttggaggccggagggagcccgcacccgggacacctgaatgcccccggccccggctcctccgacgcgatggggaaggtgctatccaaaatcttcggg

SEQ ID NO: 14294 - DNA, 185 bp, Homo sapiens
caggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacaccc

SEQ ID NO: 14295 - DNA, 153 bp, Homo sapiens
  misc_feature 126: r=a or g
  misc_feature 127: k=g or t
ggccagaaggtgtggcttgttaaagcattgagattcagagtattttgttttgctggtgtagataggcatgtatttatgcatttttgcatttgtaaaatcaacttttcaaataatgtaaatgtaatrkactagtttacttaaaggtacttgggc

SEQ ID NO: 14296 - DNA, 328 bp, Homo sapiens
  misc_feature 57: n=a, g, c or t
  misc_feature 118: r=a or g
  misc_feature 122: m=a or c
aagccccttggcatgccctgacctgatctagagggagtctactgctcttaggaatgntccgggagaaggttattttcaaagctttgtcaccaccatacgatacagagaacccttacartgcmaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggcc

SEQ ID NO: 14297 - DNA, 204 bp, Homo sapiens
aaaaacctatactaacatgtcaaactggtataaagacatcacatacacacacatacacatatgtgcacacatttctctgtaatttcttccagatggatagggagcactaagaggttcaaggaataggaattattgcttctgatgtggaaacttctaaggactcagtgatgtcagaaaaaggaagattttttgttttaaagagaa

SEQ ID NO: 14298 - DNA, 379 bp, Homo sapiens
  misc_feature 170: r=a or g
  misc_feature 175: r=a or g
  misc_feature 269: m=a or c
cgtttccggccgaggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccaggrtaatrtcaaaatatatgttcctaaaacatccctgagttcaccaccttggccagaagttgttctgccagacccagttgaggagaccagacaccatgcacmggtcgtgaagaaggtgaatgagatgatcgtcacggggcagtatggcaggctctttgccgtggtgcactttgccagccgccagtggaaggtgacctctgaagacctgatct

SEQ ID NO: 14299 - DNA, 157 bp, Homo sapiens
  misc_feature 25: n=a, g, c or t
acacacaagaggagagtgttgagcngccatatctgctgctgccgccgcagttgcgaatgcagcatcggcgcttagctgcctccgcggtgcagctaaggttcgtgtcgctaccccttggcccttcgctcttgctgccttaaccccgccggtggagccc

SEQ ID NO: 14300 - DNA, 180 bp, Homo sapiens
agattgtctacatcagtgaatttgaatttaggaaacagtatctttaaaaaaaagcatattggaaaactgacataaggttgacatctttaaattttaatatgtaaggacactaaggatatttaaatagcaaaaaatgcaaggaaaatgtatattttttacatttcctacatattgtcaaca

SEQ ID NO: 14301 - DNA, 108 bp, Homo sapiens
ttatgtaagtacttaattggtgatgtgtgagattttggtgcatccatcaccccagcagtatatgctgcaccctgtttgcagccttttatcccccatcccccatccccc

SEQ ID NO: 14302 - DNA, 266 bp, Homo sapiens
ttgccatttagtcacctactgtggccattctagtttatacttttctagtctttattctatacacatctacatacatatatgttagtgtggctttggaagtagaagttagataatagtatgtgttttgtttaattgctgttttctcattgccagtatagatattttcagtgtttagtaacatggaatgtatataatttttttccggtctcagagaattccattgtatgggagtaccatacttattgtcaccacttctctttgggagg

SEQ ID NO: 14303 - DNA, 247 bp, Homo sapiens
cttttagttcagtttgtccttaactctaaagcaagtctcttgcaaatagcatatagtggatcttgcttttctcatcctttcagcttctctgcatcttttgaatgttaactttaacctatttatattaaaatattattgctagggaagacttacattgcaattatattgttttctctctgttttatagctgtgccctatcaagaaaaacctatatcagacacaaaaaagatgaaaaggaaataaagta

SEQ ID NO: 14304 - DNA, 275 bp, Homo sapiens
  misc_feature 58: s=g or c
  misc_feature 96: k=g or t
  misc_feature 97: k=g or t
  misc_feature 115: n=a, g, c or t
actatcgatacagaaagcaaaagtatttccagtctcctactgaactgtcacggcagasctctctgtatctatatttagagctgtatgtccatatakktgcctgaatgtgtgagtncttggaagtatggattcattgccaggagctggtgatttcctaagcagaggtcgctaactacaagaaatgttacactcggacaagtcctgcgcttggggatcctctgtacgcccgttcactgaatctttcacaaaagtcctgtgtcgtcctcgtcctggcc

SEQ ID NO: 14305 - DNA, 196 bp, Homo sapiens
gttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacacccgcc

SEQ ID NO: 14306 - DNA, 136 bp, Homo sapiens
aggatatcctgttaagtcatggactatttcttatcattatgttatcatgaatgcaataatgtttcaaattcattccactccaggtttagacatttgtatcacaattgcagtggattcttttttcttttcttttttt

SEQ ID NO: 14307 - DNA, 87 bp, Homo sapiens
tttgaagtccattgccctaaaccattccatgttttcactgagggaaaaatgaaggactgaaggagcctgagtctttttttttttttt

SEQ ID NO: 14308 - DNA, 110 bp, Homo sapiens
tgtgagcatctgttggtggcacggagtataccttctccgtgtttgaagtcccagtctggaacagaggagggacctggtgaataaatgaatgtgtaaatgaatgacgaagc

SEQ ID NO: 14309 - DNA, 225 bp, Homo sapiens
  misc_feature 133: k=g or t
tgatttacctattatagcaattatataaagtatagaaaagaaatagcattttacatatactattgtattagtccattttcatgctgctgataaagacatacctgagactgggcaatttacaaaataaagaggkttaattggacttacagttccatgtggctggggaagcctcacaataatggtggaaggcaaggaggagcaagtcccatcttagatggatggtag

SEQ ID NO: 14310 - DNA, 448 bp, Homo sapiens
  misc_feature 181: r=a or g
  misc_feature 354: m=a or c
agattccctttcaacctcaggctcaaatcatccatcactgtgaacttagactgagtgaaagaggagacgacaacccggagaatttgtggctgtgggaagcctcctcttacaacgcttaaaaatgatgaagaccctgctgttggtagagtgaagagagggccttctttgcgtgaaaaacctrtccatcacaatggttggttggtcagatgtgattctctattaccgtttaatgttgcagctaatcttctctcttctgctcctcatcacattagtgtcacgcatggtcttccaaatttggaaacaacgttggacaacttaacctcaggagatgaaagattttcaaacttagtggamatctgcaactttcagaagaagagaacaaataatggactaaaagggaaaaggacatgtacttcattattgcctcttggcatttaatagctggctc

SEQ ID NO: 14311 - DNA, 116 bp, Homo sapiens
  misc_feature 93: r=a or g
ctttctagtattaggattcattaaatgttcaattcatttcatattctaaggaattaggttatttacttactaattcaggatgttaaaataacrtccaagtcggacaaccaccacca

SEQ ID NO: 14312 - DNA, 461 bp, Homo sapiens
  misc_feature 103: m=a or c
  misc_feature 153: y=c or t
  misc_feature 158: y=c or t
  misc_feature 181: m=a or c
  misc_feature 203: m=a or c
  misc_feature 213: m=a or c
  misc_feature 290: r=a or g
  misc_feature 291: w=a or t
  misc_feature 294: r=a or g
ttatcactctagattcaacatattaaaatgtattcaagctcacagatttttaatcagtaaggcctatctatattagttgtcttttatttcttctccttgtggmcagttgttaatgaaaggagtaaggatttccctttttttgttttgtttgtyttgtyttttttaaccaaattcttagagmtactatagaatccaaatgagamctgaattggmcctcaagtcttctattcctactaatagagttctttgtgatggtaactgctgtgtcgtttgttttccacaagttgggrwggrattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccct

SEQ ID NO: 14313 - DNA, 170 bp, Homo sapiens
ttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccacccc

SEQ ID NO: 14314 - DNA, 167 bp, Homo sapiens
taaattcctgggctcaagcagtcctcctgcctcagcctcccagagtgctgggcttatagccactgcacctgaccagtaaagatattttgagctttgagtagtacctggttattatcggttaaaaatgaaacattttataagtcttttgttctattgaaaaaccacag

SEQ ID NO: 14315 - DNA, 635 bp, Homo sapiens
tatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccc

SEQ ID NO: 14316 - DNA, 445 bp, Homo sapiens
  misc_feature 199: s=g or c
  misc_feature 299: n=a, g, c or t
  misc_feature 300: n=a, g, c or t
  misc_feature 301: n=a, g, c or t
  misc_feature 304: n=a, g, c or t
tgggatttggcgcccccctcctcggtgcaacctatataaggctcacagtctgcgctcctggtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggasacccagtggagaccgcgcctggctcaggtgtgggaccccatccttcctgtcttcgcagaggagtcctcgcgtgaaataagcgggttttgaaaacaaaaannnganggagtggaagagggggccaggatccaggcctccatccccacagaagtgaagctacagctgggaggtctcctcccaccccaaccgtcaccctgggtcccgactgcccacctcctcctcctccccctccccccaacaacaaca

SEQ ID NO: 14317 - DNA, 312 bp, Homo sapiens
tgcttggtgtggtcatgaggaagcaggttggaaaaagcaaaaactgtttttttgactggtggcttcttggaagtgataatcatttcttaggatgccgggttttgtgagagggtggagggcatttgcaggccaaagcagccaagcctttctacccatccccttcattaaacacagcgccaggtctctcatgttgtgtttttatccacattttctctgcttatgcgacacccgcctttcttttttttgttgttgttgttacgaagtttccttaagattttacaagtgaagtactgagctgtgcgatgtgaacca

SEQ ID NO: 14318 - DNA, 103 bp, Homo sapiens
tcattatcttatgctgcctacactcctgttactgcgaccctgatctgagttttttgaaaactaagctttctaagtgatttcctttactcttactcttaccttt

SEQ ID NO: 14319 - DNA, 139 bp, Homo sapiens
  misc_feature 112: n=a, g, c or t
agtccctctccgcgccgcctgtgggtgcccaggaatttcaggacgctccctgcagtcattccagtcaagtgcctgggcatgagccatgagcccaagtccccttcgctagggntgctttccaccgcgaccaggaccaccg

SEQ ID NO: 14320 - DNA, 440 bp, Homo sapiens
ttttattttgagatggagtcttactctgttgcccaggctggagtgcagtggcgccatctcggctcactgcaagtcctgcctccaggttcacgccattatcctgcctcagcctcccgagtagctgggactacaggtgcccgtcaccacgcctggctaattttttttgtatttttagtacagacagcgtttcaccgtgtttgccaggatggtctcgatctcctgacctcatgatcctcttgccttggcctcccaaagtgctgggattacaggcatgggccaccgcgcctagcctaagacttatcctttattactgttttttagcagtttgattatgatgtgctttgcatggttttatttagaagtgctatcttcagagattattgtggttcttcatctttggcttatagtttttattaaagttggaaaacttgatcattagt

SEQ ID NO: 14321 - DNA, 477 bp, Homo sapiens
  misc_feature 238: k=g or t
  misc_feature 244: k=g or t
taccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagttcattgccttatagctatgtcagatcacagaatccttccaagtgctctatcacagtgtgccttatgggaagtttctgactggaaaatctkgtcatkctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcatgctttgcgaacttgtccctgtgactagtagattccccc

SEQ ID NO: 14322 - DNA, 340 bp, Homo sapiens
  misc_feature 14: w=a or t
  misc_feature 304: n=a, g, c or t
  misc_feature 305: m=a or c
gtttttgtactgcwtgttggttgttttgccatttaaattaacccccaagcatagtgctgaagtgctgcttagcattcacaagtccaagaagtctgtgatgtgtcttacagagaaaataccaagggaggctgaggcgggcggatcatgaagtcagcagatcgagaccatcctggctaaaacggtgaaaccccgtctctactaaaaatacaaaaacttagctgggcgtggtggcgggcacctgtggtcccagctacttgggaggctggggcaggagaatggtgtggacccgggaggcagagcttgnmgtgacccgagatagcgccactgcactccagactgg

SEQ ID NO: 14323 - DNA, 295 bp, Homo sapiens
  misc_feature 245: n=a, g, c or t
  misc_feature 246: s=g or c
  misc_feature 259: r=a or g
tccttctctgtctcactctctctctttctctccctctcctatcggagcacaatgaaagcctgtgtatcgccgtgactccgggcgggagccagtgtcagcaaagcggctaacaacagacgagaaagagaaaggaaaatacaagctactttttttttccatctataaagcggagaaatacaggagatagaaccagattgcttattgcgagtccagacctcagatccactggccggggatggaatgtnsaaaagtggacagraaagtggctggacatgactcggtgcaatttgctgga

SEQ ID NO: 14324 - DNA, 304 bp, Homo sapiens
  misc_feature 301: w=a or t
tttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgtgtttgtgcttgtttggagatcagttcaaaaactatctgtactatctgtactgcctctgatgttaagattttatgtatagcataaggaagctagctctgactatattttcctaagaatawaga

SEQ ID NO: 14325 - DNA, 354 bp, Homo sapiens
  misc_feature 87: r=a or g
acacataggcggaagtggcctgcgggcgccggagttgagagtgctttccggggaggcgaccgccgcggtggaaagtgcaggagtggrcgaggaggaggaggaagaggaggtgatggcgacggaccaggggagggggagatgctccgtctagctcagacgccacgcaggctgccgtcacccttccgggtgacataccggccttggggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaa

SEQ ID NO: 14326 - DNA, 258 bp, Homo sapiens
acacataggcggaagtggcctgcgggcgccggagttgagagtgctttccggggaggcgaccgccgcggtggaaagtgcaggagtgggcgaggaggaggaggaagaggaggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaa

SEQ ID NO: 14327 - DNA, 190 bp, Homo sapiens
  misc_feature 12: s=g or c
  misc_feature 147: m=a or c
  misc_feature 148: s=g or c
acactcacaaasagccgaggggagagagggtgcgcagacggccagccgggccgcgccagggacatactggagacaggaagtggctgagagggggagagagttggagagagacggccgcggaggacacggggacgggaaagtctgagmsacggggagagcctgacccggcgggacacaggcaaaaagaaac

SEQ ID NO: 14328 - DNA, 240 bp, Homo sapiens
  misc_feature 12: s=g or c
  misc_feature 68: y=c or t
  misc_feature 102: n=a, g, c or t
  misc_feature 197: m=a or c
  misc_feature 198: s=g or c
acactcacaaasagccgaggggagagagggtgcgcagacggccagccgggccgcgccagggacatacyggagacaggaagtggctgagagggggagagagtnggagagagacggccgcggaggacacggggacgggaaagtctgagagagtcggagagagacggccgcggaggacacggggacgggaaagtctgagmsacggggagagcctgacccggcgggacacaggcaaaaagaaac

SEQ ID NO: 14329 - DNA, 191 bp, Homo sapiens
gtcgccgcccgctgcctcgaacgggactgggcacgggaggaagaggctgggtggtaaacaggaagtgggcgctcagagctcgggggcggcgctcagaaaacatctggagaaaatgacccattggtttcataggaacccattaaaagccacagctcctgtgtcttttaattactatggtgtagtcactggcc

SEQ ID NO: 14330 - DNA, 178 bp, Homo sapiens
gcatgttcttgaagtgggtttattcctcctttgactgccctcaaggttttctctttctctctcctccttgagcctttgatttctggcttattcactgtctcaagttccaatttctccctcctccagcagatcccctttctgcagatctttctataattgtgcttgttgttttcctctg

SEQ ID NO: 14331 - DNA, 485 bp, Homo sapiens
  misc_feature 94: r=a or g
  misc_feature 393: k=g or t
cgatacacagaatcgccagatcgacaggatcatggagaaggctgattccaacaaaaccagaattgatgaggccaaccaacgtgcaacaaagatrctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgckgaataacaacaatttaggaatgctcaatgtgctgttgattctttcaatccacagtattgttcttgtaaaactgtgacattccacagagtact

SEQ ID NO: 14332 - DNA, 495 bp, Homo sapiens
  misc_feature 459: m=a or c
ccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgamaccaagcaataccgtcatgtttcagccaagcccaga

SEQ ID NO: 14333 - DNA, 132 bp, Homo sapiens
  misc_feature 117: r=a or g
agtgttttcaggaagtgtgtgtgttggccacggctgcaggaggtgggggagacacaaagcaggaagcctccgggagaccagagctgggtgcagacatacacacacacatacacacaracacacagagtcaca

SEQ ID NO: 14334 - DNA, 157 bp, Homo sapiens
cattttttatggtgttctgatgtatgagctgcttcaagtgtttttggacatagcttgggtataaaatgtaaaaagtggatattttcaatttgtagctttcttttttgaaacttactgaaatttgttctaaatatatctccttctttctcacccaccc

SEQ ID NO: 14335 - DNA, 140 bp, Homo sapiens
tgtttcccagtttgagctatatttatgtccatccattttttccttttgttccatgaaatttagtagccctgtcacattggcctaagttaaacaactgcagctttagttttccttaacatgaaaaaaggaaagccaaatgg

SEQ ID NO: 14336 - DNA, 183 bp, Homo sapiens
ttgacatatcctcaagttcagagattcttttcctcagctgtgtccagtgtacagagtctatcaaagtcattcttcattgctgttgtagtgttttagatctttagcatttgtttttgattctttctgcatctctgcttacattacacatgtatttttgcatattgtctacttttttccttagag

SEQ ID NO: 14337 - DNA, 106 bp, Homo sapiens
gtgtgtgtgtcagagagtcagagagaagttcattgttcacacctcccggctgccggcagccttctggaggatccgattcaatgtggttgtacggtctcgggcaggt

SEQ ID NO: 14338 - DNA, 138 bp, Homo sapiens
cataaatcatcgaggtggataccatggtggaagttcccgttctcgtagcagtattttccatgcaggaaaaagccaaggactacatgaaaacaacatacctgacaatgaaaccgggaggaaagaagacaagagagaacg

SEQ ID NO: 14339 - DNA, 170 bp, Homo sapiens
aattaaaaaaaaatttttttttggtttgggcgtgatgacttacacctgtaatcctagattagaaatggccacaagttctatgccactctttccttgcagaggtgagtctgtgcccttttccctgaatctgggtggacctccccttcagctgctcccttcttgtgttcgcc

SEQ ID NO: 14340 - DNA, 420 bp, Homo sapiens
  misc_feature 311: m=a or c
  misc_feature 317: r=a or g
  misc_feature 332: k=g or t
agacactagagtaacctatgtgcacagcctctccatataccatgtgctgttgcgcctgctagtaatcgacgacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcmaagaaraccttctaaatttakattaggttgacatgatgaaagaagcattagaaaaacttcagctcaatatagtagagatgaaagatgaaaatgcaactttagatggcgg

SEQ ID NO: 14341 - DNA, 202 bp, Homo sapiens
gacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagg

SEQ ID NO: 14342 - DNA, 426 bp, Homo sapiens
  misc_feature 381: m=a or c
atttcaaactgattgatgcatctctacaagttgctaggcttggacccgctggagtcgcagggacacttctgagagctcaccccgggctcttggcaccgcgtgtgggggctcagtctccctctcggaaggcgatcggagactgacatcggcccatccaggagttggagggatccatttgaaagtgattgtttcccctcccgctctccagccgaacagttgggttggcgtcgtcttgcaggtttaggaatcccagctctgccaggccggctggtcttaacctctgctcttcattcactgtggtgcacccacacccagccaaggaaagcacgcgcgagaaatccccgaggctcggccagcccccggggtgccctcttccgctamcgccgcgttccgactctgctgggggacctgccggaagacgcgaag

SEQ ID NO: 14343 - DNA, 140 bp, Homo sapiens
  misc_feature 96: r=a or g
tctgctgtaagtttcccccactgccccggacctgttgcaggcgctgcgggcttcaggggctgcttcggctgcaggggtgtgttcgcgaggggagtrgaagcaatgtcagtcagtgtgcatgagaaccgcaagtccagggc

SEQ ID NO: 14344 - DNA, 253 bp, Homo sapiens
  misc_feature 46: s=g or c
gtttggcttcccggccgcggggctcaggttacattcgcgagcggascgagcgcgggagaccggacccgagagcagagctgctgtttcggcgcgggtcggctggcggccgactgcccagcaacctgccagctacaggagccccctgcgtcccagagactccctcacccaggcaggctccgtcgcggagtcgctgagtccgtgcccttttagttagttctgcagtctagtatggtccccatttgcccttccactc

SEQ ID NO: 14345 - DNA, 148 bp, Homo sapiens
  misc_feature 46: s=g or c
gtttggcttcccggccgcggggctcaggttacattcgcgagcggascgagcgcgggagaccggacccgagagcagagctgctgtttcggcgcgggtcggctggcggccgactgccccagagcccccacccggcaccacacagacctca

SEQ ID NO: 14346 - DNA, 164 bp, Homo sapiens
  misc_feature 46: s=g or c
  misc_feature 121: n=a, g, c or t
  misc_feature 122: k=g or t
gtttggcttcccggccgcggggctcaggttacattcgcgagcggascgagcgcgggagaccggacccgagagcagagctgctgtttcggcgcgggtcggctggcggccgactgccccagankccccatttgcccttccactccaccccaccctaaaccatgcgc

SEQ ID NO: 14347 - DNA, 113 bp, Homo sapiens
actgcctccgccagcagccggggtaaggctgctgcttcctcatttctgttactggaagtttgggacatgtgaagccagacggggagaaacgtgcgcgccttgttgagcagggg

SEQ ID NO: 14348 - DNA, 463 bp, Homo sapiens
  misc_feature 289: y=c or t
acacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagyactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagca

SEQ ID NO: 14349 - DNA, 362 bp, Homo sapiens
ctgtttgattttaaaaagtgtgactgtcagttgtatctgttgcttttctcaatgattcagggatacaaatgggcttctctcattcattaaaagaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtccaggttctaaattaactaaatgtgtacagaaatgaacgtgtaagtaatgtttctacag

SEQ ID NO: 14350 - DNA, 324 bp, Homo sapiens
ccatgctatcatgtgcagctgatttttacagtttttggtagaaatggggtgttgtcatgtagcccagttttgtgtcaaactcctgagctcaagtgatctgcctgcttcagcttccggaagtgctgagattacaggtgtgtgccaccatgcccgactggtgtaaccactttggaaagcagccactgagcccggccttcaccagtataccaatatttgttaatatcgttttattttttacaatttttccatttttagaaacttattcttttacctgtattattgtttataataaacaacgaataattttgcagtagagttgagtcc

SEQ ID NO: 14351 - DNA, 260 bp, Homo sapiens
  misc_feature 123: m=a or c
  misc_feature 124: m=a or c
  misc_feature 129: w=a or t
  misc_feature 131: s=g or c
  misc_feature 138: r=a or g
  misc_feature 148: n=a, g, c or t
  misc_feature 149: n=a, g, c or t
  misc_feature 220: s=g or c
  misc_feature 221: s=g or c
  misc_feature 229: m=a or c
  misc_feature 255: r=a or g
aatacaggagtgtttatggttgggttgagcacattcagtagctgagtgattgacagcaagaggagcaagacatgaggttaataattatcaaatatatggcaatgcttggactttagcttgatmmatcgwgsttctggraaaacaacannaaattgagatatctgttcaccactttgtgtgtccaaggaccacctactttttacatgtgacaagaactacssacctccamtcttcaggatagaacatgctgaagaraagag

SEQ ID NO: 14352 - DNA, 525 bp, Homo sapiens
  misc_feature 392: n=a, g, c or t
caggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaantttgaatttttttttcaacactcttacacctgttatggaaaatgtcaacctttgtaagaaaaccaaaataaaaattgaaaaataaaaaccataaacatttgcaccacttgtggcttttgaatatcttccacag

SEQ ID NO: 14353 - DNA, 359 bp, Homo sapiens
tttcagaattttgtgcaggaatatctgagtatttctaattagattagaatgtcagaatacattcatggacatatgaggggttttttaaaattttttttagatatccttcaccttgaacatttattatttctttgtgttgggaacaatccaaatctctcctagatgttttgaaatgtgcaatgtattgttagctgtagtcaccctactgtgctattgaatactagagcttgttccttctgtctaactgtatgattatactcattaaccaacttctcttcatctgtcccccacctccacccatctcagcctctagtaactaccattttactctctacctccatgacattaacttttttagc

SEQ ID NO: 14354 - DNA, 85 bp, Homo sapiens
tacaccggttgggcaggaggagggtaatttttatttagccgtttctccaatcatgtggggaataccattagctgttgatagcggg

SEQ ID NO: 14355 - DNA, 346 bp, Homo sapiens
  misc_feature 32: n=a, g, c or t
ctttatttatgcttacccgttaattacaaagnatccaggtgaatacccagatggaagcaatgcacagggcaagggatgtggggaaggggtagcttccatgccctctcccaaacacccaccctccaggagtctttacctgtttagctatttggatgtgccccaaacccaattgtttgatttgttttgttgttgttgaagaagtctcactctgttgcccaagctggactgcagtggggcaatctcggctcattgcaacctccaccttccgggttcaagcagttctcctgcctcagcctcccaggtagctgggactacaggtacgcaccaccatgcctggctaattttt

SEQ ID NO: 14356 - DNA, 313 bp, Homo sapiens
cctttttgactgtcttattttacttaacagaatgttttgaagatttgtccttattgtagtacttttcaagatttccttatttttaaggctgaatgctatcccagtgattgtacgtgccctgtttgctgaatctactcatccttaagggtacatttgcttccaggtaacatgtgtgagtaatactacaatgtgcatatatctattccatgttctgctttgtctgtttgggatatttttcatacactgattcagtaccatgtgtattcccttgcttttgttgtctcatccgtgatgctacgtcccccaaattatt

SEQ ID NO: 14357 - DNA, 179 bp, Homo sapiens
ttagctaatgcctctagctgcatcctcatcaagctccttccggcctcatttataagggcactaatctaactcaggagggctctgtcctcatgacccaatctcctgctaaaggctcttaatactattccactgccgattaagtgtcaacatatgaattttggggggacagaaacattcag

SEQ ID NO: 14358 - DNA, 190 bp, Homo sapiens
  misc_feature 127: m=a or c
  misc_feature 136: w=a or t
  misc_feature 137: m=a or c
  misc_feature 181: r=a or g
  misc_feature 186: s=g or c
cagagactattacacggatttcctaattacactggctgtgccctcggcagtggcactggtcctttttctaatacttgcttatatcatgtgctgccgacgggaaggcgtcatccaactggtccatcamagtgctatwmagaaatctaccaaggagcttcgagacatgtccaagaatagagaratagsatgg

SEQ ID NO: 14359 - DNA, 435 bp, Homo sapiens
  misc_feature 413: n=a, g, c or t
gatataattaaaacgctgaagaccataaccttttgggtcaactgttggtcaaactataggagagaccagggaccatcacatgggtagggattttccatccagagccaataaaaggactggtgggggccgggggtggctattgtgggaagtcatagcccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgtcttttgcatatttccttcattctaaagttgttccctggccgggagcgttggctttcgcctgtaatcccaacactttgggaggccaggacagatcagntgaggtcaggagttcgagacca

SEQ ID NO: 14360 - DNA, 141 bp, Homo sapiens
ctgaactttttacaaagaaaaatggaaaaactttgtatggtagcttcatgttgaagtggttttttgtttttgtttttgtttttttaatttgtaaaatctggaaagttagcttgttctaataggggctatgctctgcaattc

SEQ ID NO: 14361 - DNA, 403 bp, Homo sapiens
  misc_feature 192: s=g or c
  misc_feature 326: r=a or g
  misc_feature 371: k=g or t
  misc_feature 377: r=a or g
  misc_feature 394: r=a or g
ctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgascaaaggaaaaaaaggaagaatgttcaaggtgtctgtgcaagagaacagttagaccaggctggctagagcagtgtttatagggacgtaacaggagatatgtgtggcagatttagggtagattcagagtgccagtratatgccaagccaaggcacgttgccccttatacattgggaaaackgttgargtttttaacattgggargtcgatcgc

SEQ ID NO: 14362 - DNA, 320 bp, Homo sapiens
  misc_feature 129: m=a or c
  misc_feature 132: m=a or c
  misc_feature 135: w=a or t
  misc_feature 136: k=g or t
  misc_feature 140: y=c or t
  misc_feature 232: r=a or g
  misc_feature 237: y=c or t
  misc_feature 241: k=g or t
  misc_feature 243: w=a or t
aagaaggggaagaagatcaaaacccaccatgccccaggctcaacgaggtgctgatggaagcagaagaggctgaagtcttgcaggactcactggatagatgttattcgactacttcaacttactttcaamtamcawkcctycattccagcagtacagaagtgccttttactcatttgaggaacaggacgtcagcttggcccttgacgtggacaataggttttttactttgacrgtgayaagkcwccacctggtgttccagatgggagtcatattcccacaataagcagctcttactaagccgagagatgtcattcctgcag

SEQ ID NO: 14363 - DNA, 103 bp, Homo sapiens
  misc_feature 67: m=a or c
  misc_feature 90: y=c or t
aatagtgatatttctcatttgaaggatacattatttttaaactgtagaaattattggtatatttgamatggaaataatgctttgaatttygtcagtcattaat

SEQ ID NO: 14364 - DNA, 265 bp, Homo sapiens
tttgttcttttttagtctttctaattacggtaggaatagtgtacataccacggatacagtgttacaataatctggttttctgtgcacttactattgcccgtgagttttgtagcttcgattatttcttttttgttttcttttttcttttttgagacggagtcttgctccatcacccaggctggagagcagtggtgtgatctcggctcgctgcaacctctgcctcccggttcaagctattctcttgccttagcctcctgactagctg

SEQ ID NO: 14365 - DNA, 394 bp, Homo sapiens
  misc_feature 325: n=a, g, c or t
cacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgtnttgttttgttttgctttttgttaaaacatgtctatagagttggcagttaatgctgaatttgtcaaatac

SEQ ID NO: 14366 - DNA, 301 bp, Homo sapiens
  misc_feature 7: n=a, g, c or t
  misc_feature 8: n=a, g, c or t
catctcnncttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgcaacctccgtctcctgggttcaagtgattctcctgcctcagcctcccgagtagctgggattacagatgcccgccaccatgcc

SEQ ID NO: 14367 - DNA, 256 bp, Homo sapiens
  misc_feature 139: w=a or t
  misc_feature 140: y=c or t
  misc_feature 142: y=c or t
  misc_feature 144: m=a or c
  misc_feature 150: w=a or t
tataaagttttgctttattaaaaagctaataaacagctattaatcacagtgtattagtatttgttacatttttgtatttcactatctttatactatataatatggtaacttgggtaccgggggaactttaaaatttcawycycmaaaaawtaatttttaaaaagcctgaggtatgatatagcataaaagattgagatgaaaatatatttccctgtaagctgaattactcatttaaaaattttaacttctatatggg

SEQ ID NO: 14368 - DNA, 218 bp, Homo sapiens
  misc_feature 7: k=g or t
  misc_feature 109: k=g or t
aaacctkcacgttgtgcacatgcaccctagaacttaaagtataatttaaaaaagaaaagaaattctatgagattaataagctatatgatgtaatacatggctcttgtakattcatgaactcttcacttagctctttggcttgtgaatattatgtacatcaaaatttaatttttcatttgatctattttactagactcctgccccatctagtctacctg

SEQ ID NO: 14369 - DNA, 189 bp, Homo sapiens
agggccctccccgggaagtcccataggacacaatattcatctggtgttgttgcctagagtttgtcccagcggagggttggcttcggatctgcagaggctttagggacctgctccagccactgagcacactagccgtctgagacggcagctgagttgcactgtgcgacgcgacagagactacatttccca

SEQ ID NO: 14370 - DNA, 100 bp, Homo sapiens
tcgttaatgattccacttgattttcagaatattgtcctggttgattttgatttgacagcatacattatgaaatttgaaagtaggttaccattttgaggca

SEQ ID NO: 14371 - DNA, 341 bp, Homo sapiens
aaccaatctacaagagaaggctgagcaggggacctgagatgattttctccaatatttagtcagactgattttctggatccaagtttctcaacttaccaaatgtgggcaaatcattatattgctcccagccttaaaaatcttcaataagttaaagagaggactcaggcttaatggcaatcctgttatcttaccaatgaggagactaaacacctagttggagatcacctccttactggctcagagcttcaggaaatagctcaaggatgtgcaaatactaaacagtagagctgggatttagatccacatctacttaattttagtgcgtatgctctaactgctgc

SEQ ID NO: 14372 - DNA, 219 bp, Homo sapiens
catgagttcccaatgaatatttagtgctatgttttgaatgtgtcctccaaaacttatgtgttagaaacttaatccccaatgcaacagtgtttagaaatgggacttttagaaggtgattaagtcatgaggcctctgccctcatgaatgaatgaattaattaatgctgtgggagtgggtttctttctcttttttcagaggcagggtcttgctctgttgccc

SEQ ID NO: 14373 - DNA, 87 bp, Homo sapiens
aatcaagaaaataccataaaagtggccaaccagcagttctcaaggctgctctagctatggaatagccattctttttttttttttttt

SEQ ID NO: 14374 - DNA, 230 bp, Homo sapiens
  misc_feature 26: k=g or t
  misc_feature 120: r=a or g
gacttggttcaccggttaaaacgcakagggagatggaaatgaccaggagtcgaaaggagaagataagagtgcagtggtgcagtcatggctcactgcagcgtctgcctcctggactcaaaraatcctcctacctcagcctcccaagtagctaggaccacagagttgtgctctcctgcagcgttttgcggacggctggctatcttacccagaatcaatcacactgggacact

SEQ ID NO: 14375 - DNA, 89 bp, Homo sapiens
aatcacagcagtgccgacgtcgtgggtgtttggtgtgaggctgcgagccgccgcgagttctcacggtcccgccggcgccaccaccgcgg

SEQ ID NO: 14376 - DNA, 289 bp, Homo sapiens
  misc_feature 103: m=a or c
attgtgttttagtcattggcccttcacttttttcttaatcagagctagatgtgaaactgcaggctaaatagaatcaaggccagaggacttcttttccattccmtgcaggatagagagttgattggataaagtgttgagatagatccagcaggaaggaatggggctgttgtagattttggggcaggagtgagaaggtggaaatactgtttgaggaagagtggcctagacctggggagggcaccagagggagaaggctgctgccgtgtagcctcggcaagggaagatggga

SEQ ID NO: 14377 - DNA, 312 bp, Homo sapiens
  misc_feature 11: s=g or c
tgtgaatgatsggcattccagtgaggcatcgaatgccttctgagggctttgtaggttccagctcaaatccccctctggctcttgttctttggtgtggcagccatctctcctcccaggggtcctgagggtttcagcaccagttctctgcagccacacaatcagcccggctcgggagcaaactcccctggaagaacggagttatgagttggtcagcagaggaggctggggacaggcagtttttggtcttttacctctgatcttgtccccaacctaagccagctagctgcgtgtcccactccctctgccgcacac

SEQ ID NO: 14378 - DNA, 240 bp, Homo sapiens
  misc_feature 210: r=a or g
tgaatcatcttcagttgtctttgggttactcttgactgaacaaaggcagaggggagagaaaaaaggaaaataggaagaaacatgaatctatctatagaaaagtaggctgggtgtggtagctcatgcctgtaatcccagcactttaggaggccaaggtgggaggattgcttgaccccaggagttcaagaccagcctgggcaacatagggaraactggtctttaaaagagaaagtaaaaagg

SEQ ID NO: 14379 - DNA, 167 bp, Homo sapiens
ttacattgaatcattattcaattcatgaagatgttccattttgttctaggtacccttttctgttgattttataaatgatattctaaattatgttttctaattattttatgcactatatacatatgtgatttcttttcttttcttttctttttttttttttttttttt

SEQ ID NO: 14380 - DNA, 164 bp, Homo sapiens
actcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctg

SEQ ID NO: 14381 - DNA, 103 bp, Homo sapiens
  misc_feature 88: s=g or c
agaggatcgcctcgctggcctactctctcctcccgtacggcgccggaatcccagctccacttaccaggccgcggctaccccgccgtcscccccgactcccgcc

SEQ ID NO: 14382 - DNA, 82 bp, Homo sapiens
aacttgaaaggggggttgtgtaatgtaccttttccaatcccgggctgtatatggagatttgggattctttaaaccggcgcta

SEQ ID NO: 14383 - DNA, 138 bp, Homo sapiens
atttttattggtctgcaaatccggagaccttgcggcctcactggtcctccttccctctgagctatctccacacccagccttcgatcagaaggagatttagaagcagagctgcccgcagcgaatacttttaatgcccgg

SEQ ID NO: 14384 - DNA, 283 bp, Homo sapiens
  misc_feature 208: n=a, g, c or t
gacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggnaattaggaacctgttggcagatgttgaaacatttgtagcagatatactgaaaggagaaaatttatccaagaaagc

SEQ ID NO: 14385 - DNA, 307 bp, Homo sapiens
ctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaa

SEQ ID NO: 14386 - DNA, 383 bp, Homo sapiens
  misc_feature 375: k=g or t
tgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcgttgttcagttttcatgattattgtgtaaggaagactgatgtagatgttctgtgctgtcctggaccatgttaattacacttacgacgtatttkagttccac

SEQ ID NO: 14387 - DNA, 215 bp, Homo sapiens
ccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcttttcgcgcac

SEQ ID NO: 14388 - DNA, 125 bp, Homo sapiens
tgaggtgcttgtgtttttgtcggtacaggagagtcgctatggcggcggtggattcggatgtcgaatcgctgccgcgtggggggttccgctgctgcctctgccacgttactacagccaaccgaccc

SEQ ID NO: 14389 - DNA, 405 bp, Homo sapiens
caatttttaagaacttttgtgtaaaatgcagctccatgtttagcataatctaaaaataatttcaagcaatccagaatcttccaagaatttattaaagctttaaaacaaagcaaaacaaaaaggcccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagc

SEQ ID NO: 14390 - DNA, 428 bp, Homo sapiens
taattgtgctccagggtaatttggtaattttataatttctacgaatgtttccaacaccatatgacctaatccagcaccatataaatggatccactcattctcatttgtatgtaatctagcactccctgcaagcaagttgatgttgttaatttaatcatgctacctgaacaaggtatattgctatgtagaaaaatacaagttgaaacagtcaaaatactgtgtaattccatttatatgactctgtagaaaaagaaaaagtgtagtgatagtaaagagttcagtggtaacaaggggcttggaagacagaaaggtgtaaacggtgaagtaccaaagatttcttttgggcagtgaaattcctctttgatactgtaatggtggatacatcataatgttttccaaatcctgaagaactttgtaacacaaagagt

SEQ ID NO: 14391 - DNA, 107 bp, Homo sapiens
cagctgactgtaatctcccctccatggaattccccatgagtttattgagatcctaccttgagggatttaccacttttctaccctttggtatcttttttttttttttt

SEQ ID NO: 14392 - DNA, 247 bp, Homo sapiens
tcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcc

SEQ ID NO: 14393 - DNA, 219 bp, Homo sapiens
ccccttttttcgtgccttgaggttgcgggtcagcgcgagccgctgcagtgagtccgtcacggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccc

SEQ ID NO: 14394 - DNA, 209 bp, Homo sapiens
  misc_feature 39: s=g or c
  misc_feature 41: n=a, g, c or t
  misc_feature 103: r=a or g
ccccttttttcgtgccttgaggttgcgggtcagcgcgascngctgcagtgagtccgtcacggctccggcgcgagcgcgaggctgcagcccccgagtttcccgrcctcttcaccatcatcaccaccatcaccaccaccatcaccatcaccaccaccaccaccatcaccaccatcatcatcatcatcatgatcatatcatgaccaacacca

SEQ ID NO: 14395 - DNA, 260 bp, Homo sapiens
  misc_feature 8: s=g or c
  misc_feature 221: r=a or g
agagcaasggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggagraaaagaacaggcagaacagcgagaagaataaagggaaag

SEQ ID NO: 14396 - DNA, 166 bp, Homo sapiens
catcacttcccaccaggtccctcctatgatacctggggattatgggaactacagtttaagatgagatttgggtggggacacagccaaaccatatcattccatccctggcccctcccaaatttcatgtcctcacatttcaaaagacaatcttacccttccaacagtc

SEQ ID NO: 14397 - DNA, 277 bp, Homo sapiens
  misc_feature 26: m=a or c
taagaataattcttttggggaaagamattatgaatcttcaggacagtctacaatggtttagagttacattctgcctagacttttatgacttgctgctattgttttaaaaaccccacttagtctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacaccca

SEQ ID NO: 14398 - DNA, 403 bp, Homo sapiens
  misc_feature 146: y=c or t
  misc_feature 150: w=a or t
  misc_feature 151: n=a, g, c or t
  misc_feature 154: r=a or g
  misc_feature 166: r=a or g
gttaaagagaatgttcaaggccgaggacacataaaaaagagcagcattgctggctctgttatttagctgtgtgttcttgaaaaagtcacttctccagacatatctcagcatttataacctaagactgaatcactgcattttacccytaawnggrggtacgcttacrctaatctttttgaaacagtacttaaattgtagcaggacaagccgcagacaaaacccctcagccagcgagtttaagaaagaagggctttattcggccgggatcttcggcaagactcacgtctccaacaaccaagctccccaacaatggactcttgtggctgacttcactcaccatgctcacactgcctccttgtcagcagtagctgtaaatagtcgttttgtggtcactgggagcaaa

SEQ ID NO: 14399 - DNA, 297 bp, Homo sapiens
  misc_feature 223: m=a or c
  misc_feature 237: m=a or c
  misc_feature 267: k=g or t
catttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgcatgagagggaaaagattgactggggagggcttaaaatgatttgggaaaacaattgcttttgaggctcagtgacaacggcamagattacaacttamaaaaaaaaaataaataaaaaataaaggaakttgcacggttattttgcaacacaagggggc

SEQ ID NO: 14400 - DNA, 238 bp, Homo sapiens
acagccatggcggagctgtgcaggaggagctctcggtcctggccgcgattttctgcaggccccacgagtgggaggtgctgagccgctcaggtgactacccgcgcgcgggagggacagggcgccctcaggggccacccgcgttcgctttgcgtctcctccccaccacggagcctgggcaccccgcctgggcccacgtatggggaccgggttagttgaatgatggaatgacacgcccgga

SEQ ID NO: 14401 - DNA, 241 bp, Homo sapiens
acaatgagaccaggattaaaaaataaatgaaaggattgcatgttttggggttatcactgagattttgaatttcccagtgctcagttgttagtttttatttatttttttgggatggagtttcgctcttgttgcccaggctggagtgtaatggctcattgcaacctccgcctcccagcttcaagtgagtctcctgcatcggccttccgagtggttgggattacaggcatgcgccactatgccc

SEQ ID NO: 14402 - DNA, 279 bp, Homo sapiens
  misc_feature 15: k=g or t
  misc_feature 25: k=g or t
  misc_feature 26: y=c or t
  misc_feature 37: k=g or t
  misc_feature 38: y=c or t
  misc_feature 46: k=g or t
  misc_feature 47: y=c or t
  misc_feature 53: m=a or c
  misc_feature 54: w=a or t
  misc_feature 86: s=g or c
  misc_feature 128: k=g or t
  misc_feature 130: k=g or t
  misc_feature 131: s=g or c
  misc_feature 132: k=g or t
  misc_feature 251: k=g or t
cttttttagcgccakctgctcgcgkygccgcctcctkytcctccckytgctgmwgccgctgccgccctgagtcactgcctgcgcastccggccgcctggctccccatactagtcgccgatatttggaktksktacaacatggcagacattgacaacctgcctagggtagttaaaagacgagtgaatgctctcaaaaacctgcaagttaaatgtgcacagatagaagccaaattctatgaggaagtcatgakcttgaaaggaagtatgctgtctctatca

SEQ ID NO: 14403 - DNA, 259 bp, Homo sapiens
  misc_feature 140: w=a or t
  misc_feature 144: r=a or g
cttatttcccctgctgtgggactcgacactgtcggaatgagccttcctagtgacgcaggactaaactcctgaatataaaaggagcccagagctgttgagtacatctactatgctttactcgaaatatcttaaatgaaaawtggrgaaatgtgaaattaaaataattcaaacttaaagctgttagaattttaaagtattccagccttaagaggaatacggctatgtggcttgagtcacttgatgtacaactgcaacttct

SEQ ID NO: 14404 - DNA, 330 bp, Homo sapiens
aatcctgggtgccttcaactttctcaatttctccttcctgctggctagaatgaggacgatggaaagaactactgtggactatgtgaattaagcaacacactggtgatggcagagaaaacaggtaaaaggaaactagaaccttgagactgtggaaccgccataccagccctgcaattttgtgcccagaattgagaattttctgttgggtattgctgctcatctagaaaacaccagctaccaatagatgtcctctctgtgccgaaatactgcttacctcaggggatattggcttgcttgcttccttttctgccaccgccctcccccacaccc

SEQ ID NO: 14405 - DNA, 216 bp, Homo sapiens
tggtagttggaattttcattactaatgatgcccctgcctgtggtcattcctgcctgcctcttgatgcacacaggcacgcatttctgctgggtatgtcctagttccagactcactggttatacggtatggatgtaattattgttagttttccagtgtgattaaacatcagattagcgcccattagcaatgtctgaggctgcctgttgctccactcgg

SEQ ID NO: 14406 - DNA, 133 bp, Homo sapiens
cacagagagattagataaattgttcaaggtcacatggcaagtgaatgatggaattgagttttggacccaggtgggctgatttgagccttacctgtgctcttaacgacttttctaaactgcctccctgccaaga

SEQ ID NO: 14407 - DNA, 77 bp, Homo sapiens
attcgggctcccgcctctgttcaggacactgggtccccttggagcctccccaggcttaatgattgtccagaaggcgg

SEQ ID NO: 14408 - DNA, 118 bp, Homo sapiens
ctaaatagcgtcacacctttagtctctaccattctctagacaggatttcaggatccatagtctaggctcccagttcctggactatcgccactgtaatgattgtccccctccatgccac

SEQ ID NO: 14409 - DNA, 325 bp, Homo sapiens
  misc_feature 150: r=a or g
agtggattagtttctttttctgtaaagtaagagaatgatttttattatcctgtccagcaagacatagttattatgaacaatttttgctcgtgagtgtctacaaaatataataatggccgggtgcggtggctcatgcctgtaatcctagcrctttgggagaatgaggcgggaggatcacgaggtcaggagatcgagaccatcctggctaacagagtgaaagcccatctctactaaaaatacaaaacattagctgggcatgctggcaggagctgtagtcccagctacttgggaggctgaggcaggagaatggtgtgaacctgggagg

SEQ ID NO: 14410 - DNA, 116 bp, Homo sapiens
cgtatttattgcatttttgttttctgttcatttcgttttttgttttctcattgagtggtgtcacttgtctggaggctattgttatgaatgcctgtcctttctaatacatctgtgtg

SEQ ID NO: 14411 - DNA, 120 bp, Homo sapiens
ttggcctttgtccacctagtaatgctcttcactgcaatggagtttttgtctccagacatgtttgagccactgaattttcagaataactttagatgtaaagctttctttcctttttttttt

SEQ ID NO: 14412 - DNA, 168 bp, Homo sapiens
aatgcttggcagagtctcctcctgggtggcactgtagcagttgctcttgcgatggagcaggggaggcacatcccccacattctccttcctcccaggctgtcctgagaatctatcatgtttaccacaggctccccaccctttggcaccatgggtgcctgctaccactgt

SEQ ID NO: 14413 - DNA, 139 bp, Homo sapiens
tactagattgggtttcttttatgtgtgggcttttaatgcttggtatctctggtcttcctaatatgtaatgcttagcataataattttagccattattcatttttgtagtaggcttcactagcttcctgcttctcaaatc

SEQ ID NO: 14414 - DNA, 115 bp, Homo sapiens
acacgcggcctaatggacgccctcctcgagatcccacggctgcgcggagaaccgaacggagggagggagtttggggagggggaagagcaggaggaggagaaaagggagggggaag

SEQ ID NO: 14415 - DNA, 63 bp, Homo sapiens
  misc_feature 31: s=g or c
actgggttcctggctggggttgggggcagasagagaggcaatggagacccagacaccctgcag

SEQ ID NO: 14416 - DNA, 288 bp, Homo sapiens
cattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataa

SEQ ID NO: 14417 - DNA, 102 bp, Homo sapiens
aaattcaggaatggattttggagtttctgggtgctgaagaaatagggcctttccgcctgcgggcccagtgagtcgacacggtgggggcccgcgatccccggg

SEQ ID NO: 14418 - DNA, 196 bp, Homo sapiens
  misc_feature 152: n=a, g, c or t
  misc_feature 155: r=a or g
  misc_feature 158: s=g or c
  misc_feature 160: n=a, g, c or t
gtcacctaatggcgcctggcaatggccggcggccccggcccttcgctgtccctcggtcctcggggtgtcagggacagctccgcgtcgccttgtctcgcttcttcggggccacgggtccagctagacacgcttagcctttaacactcaagccnggrttsgnaagaccgctccttcgctctgcgaccacggctgccct

SEQ ID NO: 14419 - DNA, 194 bp, Homo sapiens
ttagttgccactgacttttgggtgggggagtcagctgtggtgtcctcagcaaatggttagctggaaaactgagagctgccgagattaccggcctccccccttctttttgaacacactgacaaaacgatctgagtaatggcctttgttcacctgttcaaagcgagccaaaatttattgagcacctactctgtggc

SEQ ID NO: 14420 - DNA, 94 bp, Homo sapiens
ttcttctgtgcgctcgggctcctggtcccggctccccggttaccggggcgcgagtatgaccacaatggcggccgccaccctgctgcgcgcgacg

SEQ ID NO: 14421 - DNA, 73 bp, Homo sapiens
aaatctttctcagcttctcctagaatggctctgcttccctggggccccaggacctatgggaaactaacgtaga

SEQ ID NO: 14422 - DNA, 61 bp, Homo sapiens
gttgttagctgatatccatggcagctgcagtggcaggtaatgtcttacaataacagaatgc

SEQ ID NO: 14423 - DNA, 260 bp, Homo sapiens
  misc_feature 177: k=g or t
  misc_feature 178: k=g or t
  misc_feature 259: k=g or t
attacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaakkataactatcctgtgttcattttttttttataaacaataagaaaaagttgttggatttttttttaatgatttcttttttggkg

SEQ ID NO: 14424 - DNA, 97 bp, Homo sapiens
  misc_feature 3: y=c or t
acyctcccccggcccggcctggcccggcctggccagtccccgcggtctctgcccgggctgacgcccaggaatgtggtcgacgagaagccccaacagc

SEQ ID NO: 14425 - DNA, 119 bp, Homo sapiens
caatgtgtgagcgtaccaccccatatctatgagtgtgtgtctatatgtgtgtgaatctatgcatgtgtttgagtgtgtctatgtgagtctatgtatgtgagtccgtgtatgagtgtacc

SEQ ID NO: 14426 - DNA, 200 bp, Homo sapiens
cgccccggggaggttttgattttagtggctttcttccttttattttccgtcgtgtgcggatttcgctgcagagcgaacttgcggctcgtcggagtacatgtgagcggtaatcgcccctgcagctggttatcctgacactatgcactccgaagcagaagaatccaaggaaggtaggattctggtttttcctgggggccggc

SEQ ID NO: 14427 - DNA, 340 bp, Homo sapiens
  misc_feature 139: w=a or t
  misc_feature 166: r=a or g
  misc_feature 170: r=a or g
  misc_feature 208: k=g or t
  misc_feature 221: r=a or g
cgccccggggaggttttgattttagtggctttcttccttttattttacgtcgtgtgcggatttcgctgcagagcgaacttgcggctcgtccgagtacatgtgagcggtaatcgcccctgcagctggttatcctgacatwatgcactccgaagcagaagaatccaargaartgggcacagaatgtctttaattccaaaaacctggccgktcaggcacaaaaraagatcttgggtaaaatggtgtccaaatccatcgccaccaccttaatagacgacacaagtagtgaggtgctggatgagctctacagagtgaccagggagtacacccaaaacaagaagga

SEQ ID NO: 14428 - DNA, 333 bp, Homo sapiens
  misc_feature 251: k=g or t
acattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgtkaatacataattgctccaagcttcctgtaaactataagaatatatttagtttacagtatatggattctatgaaaaaatgtcca

SEQ ID NO: 14429 - DNA, 411 bp, Homo sapiens
  misc_feature 151: r=a or g
acggggccgcctggagaggtgctgggagctgggtggagcttagaggaattaaactttggccctgcgcctcgtccagcctaggttccacccttttctgggaacgctggagtgcagtggcaccatctcggctcactgcaacctctggctcccrggttcaagcgattctcctgcctcagccccctgagtagctgggattacaggcacgcgccaccactcccagtttacaccccgccactcctgagcaccgcacaccggcttcctcccagtccctcatctgagaactcatgaagccacttggaatccctctctgctttgcctggctcattccatgtcaatttcagatcttcacttcaggtcagctccaaggaggctatccttgcccatcttcctaaaatagagctctcaaaacct

SEQ ID NO: 14430 - DNA, 200 bp, Homo sapiens
  misc_feature 2: n=a, g, c or t
  misc_feature 10: k=g or t
tngagtggakataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatcc

SEQ ID NO: 14431 - DNA, 182 bp, Homo sapiens
tttctgagtttatttcagccatgttttagcagcattccaggatgctgttaatgcctcacagtggttaagggcaagaccttagttcaagacccagcttggccactcacttactttttggccttaggcagatttctttctcctgcgagcatcagtgtcctcaatataaaattataatggtagaa

SEQ ID NO: 14432 - DNA, 316 bp, Homo sapiens
  misc_feature 131: n=a, g, c or t
  misc_feature 133: n=a, g, c or t
gttattcttcggtttgcctcctcccagtggcgtggatttgctcccgacccgcttttggggcgtgcctgcttcctcctctctgttaggtgagtgagtaggcgtcattcttcacagtagtcctctgcctccancngccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggaca

SEQ ID NO: 14433 - DNA, 312 bp, Homo sapiens
  misc_feature 120: k=g or t
  misc_feature 158: n=a, g, c or t
  misc_feature 245: m=a or c
  misc_feature 306: w=a or t
aattctaacgaagcactcggacacgggagtttgagtcctgcaaatcaacaacgtcagcgccagctggtcctcgcccggccggtgacgggcccccgggagtacgtgctggacctggagatkgcaccatgaattccctcatgagctaccgggccagctcngtactgaggctcaccgtctgtaggggcctacacctctgaggagcaggagggagccaccctccctgcagctaccctagctgaggagcmtgttgtgaggggcagaatgagaaaggcccaggggcccccattgacaggagctgggagctcwgcacca

SEQ ID NO: 14434 - DNA, 252 bp, Homo sapiens
  misc_feature 32: y=c or t
tctgcctccttttctcccgccggctctaaccygcgcttggctaaggtccgcgggaacccgtgagccaccgagagagcagagaactcggcgccgccaaacagcccagctcgcgcttcagcgtcccggcgccgtcgcgccactcctccgatggccacagatgtctttaattccaaaaacctggccgttcaggcacaaaagaagatcttgggtaaaatggtgtccaaatccatcgccaccaccttaatagacgac

SEQ ID NO: 14435 - DNA, 336 bp, Homo sapiens
gcttccggttggggtggcagggtggtggatctgttggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaa

SEQ ID NO: 14436 - DNA, 153 bp, Homo sapiens
  misc_feature 24: s=g or c
actggagccctggccagcgcgcascttcccggcgccggcgggctgggtcttgggaattctggtttgctttggctcactcgctttttacaaaccactggatcttacatgcctctgtaccccccacttccactccatgtccccatgctcctgcgc

SEQ ID NO: 14437 - DNA, 362 bp, Homo sapiens
  misc_feature 4: n=a, g, c or t
  misc_feature 131: m=a or c
  misc_feature 148: r=a or g
  misc_feature 160: r=a or g
  misc_feature 186: k=g or t
  misc_feature 331: r=a or g
  misc_feature 332: r=a or g
ttanaaaaatacagtgggtcagagtagtagtacagtttgaagacagtaatacctggaattgagcatcatgtctgtcattcttaaatttgcatgcatctttctaacaggggaggtagacatgtagcagtaamaatagttaaaaatgtgratagatactgtraagctgctcgctcagaaatacaagtkctggaacatctgaatacaacagaccccaacagtactttgtaagtatcagattagaacttgggaagtggtatcaggtatatttaaattaggagcaactatacttagctatttttcatgtgtttgtagccgctgtgtccagatgttrraatggtttgagcatcatggtcacatttgca

SEQ ID NO: 14438 - DNA, 142 bp, Homo sapiens
ggttccggtgtcagcggcgttgaattgccatggcaatgcggtgggcgcgcgcttgtcgtgttggtctcttgggatagcggggctaggccgggcgggtatccgcctctcccagcttagattcattgattccaggtaaatcaga

SEQ ID NO: 14439 - DNA, 120 bp, Homo sapiens
cagtttctaattggtggaatttagatgattttatcattgtatgttcccctctgtatacatgtgaatgtgaactgttcttcaggatagacatttaaacttcgatttttttttttttttttt

SEQ ID NO: 14440 - DNA, 242 bp, Homo sapiens
  misc_feature 184: y=c or t
  misc_feature 205: r=a or g
  misc_feature 223: k=g or t
  misc_feature 228: s=g or c
  misc_feature 229: n=a, g, c or t
  misc_feature 240: m=a or c
tgatgtgtgtgttttgtttctgccatagtattgttagttagtagcatggagttccaattgtataattgcttcatagtatctgtgagctttgtatttatttgtccttttatgatgttgtatattgtgtttttgttttcatgtttagaacttccttgagcatttttttttttttaagacagagtcycgctctgtcactcaggctggrgtgcagtggcacgatctkggctsnctgaaacctamac

SEQ ID NO: 14441 - DNA, 185 bp, Homo sapiens
  misc_feature 100: r=a or g
  misc_feature 119: k=g or t
  misc_feature 131: r=a or g
  misc_feature 167: s=g or c
aagattgttttcctgaattgtggctgcgcagagactccggggtgggatgagaaccaagactgccccactgcctccctacccgactgacattggacacggracaagagacctgacagggkccaacagagaarcgcggatgggctccagagcttctttccagacccgcsagtctctgggtgcaacag

SEQ ID NO: 14442 - DNA, 438 bp, Homo sapiens
atcctgactggttcatcctccccggaacttcctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaag

SEQ ID NO: 14443 - DNA, 321 bp, Homo sapiens
atcctgactggttcatcctccccggaacttcctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaattctccacaaag

SEQ ID NO: 14444 - DNA, 102 bp, Homo sapiens
  misc_feature 93: n=a, g, c or t
agatgagaatttatgtacccccaaaatagacacataaattacatcctttaaaaatacatcctctaaggtttttgttttctttctttttttttnctttcacat

SEQ ID NO: 14445 - DNA, 238 bp, Homo sapiens
  misc_feature 12: m=a or c
  misc_feature 75: m=a or c
  misc_feature 81: m=a or c
  misc_feature 90: m=a or c
  misc_feature 96: m=a or c
  misc_feature 107: m=a or c
  misc_feature 130: m=a or c
  misc_feature 133: n=a, g, c or t
  misc_feature 163: m=a or c
tgtatgtacagmaattttgaacaaattgttttaaatgtaatataagagaattagtttaaggaagtaaagagaatmatttgmttgtgttamattttmagtgaggattmagtttaagagtcattcttaggamttncatttcctaatatttattcatgggtaatgmagaaatggtttgcattttgtggccagtcctaatttattttccagctgagccctaacttccggctcccacctacct

SEQ ID NO: 14446 - DNA, 429 bp, Homo sapiens
  misc_feature 338: n=a, g, c or t
  misc_feature 339: n=a, g, c or t
  misc_feature 340: s=g or c
  misc_feature 400: n=a, g, c or t
  misc_feature 401: n=a, g, c or t
  misc_feature 414: w=a or t
  misc_feature 415: n=a, g, c or t
cccagctacttgggaggctgaggcaggagaatcgcttgaacccgggaggcgggggttgcggtgagccgagattgcaccactgaactccagccaggtgacagagagagactctgcctcaaaaagaagaaaaaccgtggcccaggaaggcatgtgaatgagctggtgcagcatttggtcttggcccagtggatgttgatttcctgtctacaagtcatgggacccaagtaccttaatgccatgaggcagctttggttagaatctctttgctctctttcactaatttcacatccacgtggttctccctaggctagcagcctaattttgtgggggaaactaannscaactatgggatttcagagctttcctttggtatgccaggttcgttgcattgtttgaaatnngctttcagcctgwntgcattttttcaga

SEQ ID NO: 14447 - DNA, 316 bp, Homo sapiens
  misc_feature 126: r=a or g
  misc_feature 129: y=c or t
  misc_feature 234: y=c or t
gcaacatggtaaaacccagtctctacacaaaataaaaaaagtaagctgggcgtgctggtgtgcacctgtattcccagctactccagaggccaaggtgggaggatcacttgagcccaggaggtcgarggytgcagtgaggcgagattgtgccactgcactacagcctgagcgacagagtgagaccctgtctcaaaaaaaaatcggttttcataaaaaaataaagatcagttgaayactttgtctttgcaggtcctgcaggttaagttcaaaaacttttttttagtggttttattattgagaaaatttcatttcaccc

SEQ ID NO: 14448 - DNA, 248 bp, Homo sapiens
tttagtcatttgtatccttctgtgaatttcctgttaccttgcacatttttctgttaggattttaatgctttagtattctatgtttgttttcttttgaatttgagttcttggtgggcttctttttgttttttttgagacggagttcgctgtcacccaggctggagtgcagtggcgttgtctgggctcactgcaagctccgcctcccgggttcacgccattctcctgcctcagcctcccgagtagctggg

SEQ ID NO: 14449 - DNA, 160 bp, Homo sapiens
tgtgttattaactattatttatttaaattttagaacatttgaatttgcatagcaactatttctgacttccgcctttgtttctctctggctcccacaagtctttgcctgaagtcccacaagatgaggtactctggctctccagtttttgcggtatacccac

SEQ ID NO: 14450 - DNA, 187 bp, Homo sapiens
tccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgg

SEQ ID NO: 14451 - DNA, 662 bp, Homo sapiens
  misc_feature 431: m=a or c
aacttccggttctctgtcagtcgcgagcgaacgaccaagagggtgttcgactgctagagccgagcgaaggtgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgmtgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgccc

SEQ ID NO: 14452 - DNA, 400 bp, Homo sapiens
  misc_feature 71: n=a, g, c or t
  misc_feature 72: n=a, g, c or t
aacttccggttctctgtcagtcgcgagcgaacgaccaagagggtgttcgactgctagagccgcagcgaagnntgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgcagggcggttgagatggcattggacagtgacagcttgttgttgttg

SEQ ID NO: 14453 - DNA, 70 bp, Homo sapiens
atttctcctcgcagctcgctgcctcctctatccctgcctccctctccaccccaccttttcttctttctcc

SEQ ID NO: 14454 - DNA, 266 bp, Homo sapiens
  misc_feature 7: s=g or c
  misc_feature 116: k=g or t
  misc_feature 118: k=g or t
ttaatasagttttagaattttctggatactagtcttgctcattttttgttagatttatccccagctgtcttacattttttgatgcttttgtaaatagtattttctttctttttttkgkggggggcgggggacagagtctcgctctgtcacccaggctggaatgcagtggtgtgatctcagctcactgcaacctccgcctcccaggttcaaggaattctcctgcctcagcctcctgagtagctgggactacaggcgtgcaacaccat

SEQ ID NO: 14455 - DNA, 221 bp, Homo sapiens
ttgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcat

SEQ ID NO: 14456 - DNA, 187 bp, Homo sapiens
aaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatggaca

SEQ ID NO: 14457 - DNA, 488 bp, Homo sapiens
  misc_feature 3: w=a or t
  misc_feature 30: m=a or c
  misc_feature 88: m=a or c
  misc_feature 333: n=a, g, c or t
  misc_feature 334: n=a, g, c or t
  misc_feature 356: n=a, g, c or t
  misc_feature 379: n=a, g, c or t
  misc_feature 380: n=a, g, c or t
  misc_feature 402: s=g or c
  misc_feature 435: r=a or g
  misc_feature 436: n=a, g, c or t
  misc_feature 437: n=a, g, c or t
  misc_feature 453: m=a or c
  misc_feature 467: r=a or g
  misc_feature 487: r=a or g
agwcctccctaggaggagcaaagggaaggmtttggggtcgggggcaggagaatcagcggcacttgacctgctggaaatcctgcttcamactcccctttctccgtccctgcgtccccacccacacacacatcttgggcagcactcagggacctcaccaggttacccaaggctctttggaggtatgtgtgcgtgagggaccacgatgtgtgtgtgtgtgtccttgtctgtgactctgtacgtgtaatctgtgtgcgcttgagtatctgtatttgtgtatgtatatatctgcgtgtacagacacgcagcctctgctacctagctttaaaaaaatcnnttgaaacaatcgatacactcanactcgctctcgggcaccgggtgnngtgggggcgcaaccagaatacsgtgtcagcgggtcctggccagcacaatctctcrnncgctggctgcccgggmtatttcttgcgaaragcgttttcatttgaggcgra

SEQ ID NO: 14458 - DNA, 355 bp, Homo sapiens
  misc_feature 85: n=a, g, c or t
  misc_feature 129: n=a, g, c or t
  misc_feature 291: s=g or c
  misc_feature 336: r=a or g
cccatacaggcccccaccatgaagggtttcacagccactctcttcctctggactctgatttttcccagctgcagtggaggcggcnggtgggaaagcctggcccacacacgtggtctgtagcgacagcgncttggaagtgctctaccagagttgcgatccattacaagattttggcttttctgttgaaaagtgttccgacaattaaaatcaaatatcaacattagatttggaattattctgagagaggacatcaaagagctttttcttgacctagctctcatgtctcaaggstcatctgttttgaatttctcctatcccatctgtgaggcggctctrccaagttttctttctgtgg

SEQ ID NO: 14459 - DNA, 198 bp, Homo sapiens
  misc_feature 137: s=g or c
gaggccctgacgtggacacacttcgggttttacgactccgggtttctccaggggatgggccggccggtagaggcgcgtgagggagacgaagggacttccgtttccttcacctaggctggggccaagccgcagagcgsagttggcatttccagattggggctcgggccgcgcctcctccgggaccctccccttggaccg

SEQ ID NO: 14460 - DNA, 168 bp, Homo sapiens
gcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggt

SEQ ID NO: 14461 - DNA, 161 bp, Homo sapiens
  misc_feature 11: s=g or c
ccactgcgaasccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccac

SEQ ID NO: 14462 - DNA, 151 bp, Homo sapiens
  misc_feature 115: r=a or g
gtgacgtgttgtgaagcacgtcagctgctccttgttgctgtgcagatcacccaacattaggtcaccgagagagacagcagctcttgctcacacagctgataggattaggagatgrtgctttgtcagccctgattgagcccaagaaaacccc

SEQ ID NO: 14463 - DNA, 259 bp, Homo sapiens
tatatcaagtaaaggactaaagattaagccctccttttttgttctaaaaaggaaataatcccgtgatggtgtaactttcatggcctctttatatttaagtttctgatgctttgcttaggatgcaccttgtgttcctacaccccctagaggttgactactgctatgtttgggggctagaggagcgttatgctgctgtcctagttgaaacaagacagttcccccgatctttgtttagtttttttagtgttccttggtgatt

SEQ ID NO: 14464 - DNA, 133 bp, Homo sapiens
  misc_feature 92: r=a or g
  misc_feature 105: y=c or t
  misc_feature 108: y=c or t
  misc_feature 111: k=g or t
attcattgctcgttcccctccgttcccgcagacacccggacctcccctgggcgccagctccgcggctccaacgggtccagaaacaagccggratttttttttttyctycckggaaattggctttggtgtgtgt

SEQ ID NO: 14465 - DNA, 175 bp, Homo sapiens
  misc_feature 10: n=a, g, c or t
agagcgtggncgggaccgagcccgggcgccacccgcaagccgtggcagctgtgttgcctgccggggggtgcggggagaggatgggggtccccaccccgaagcaattctgccccatcctggagaggccgctcatcagctacaccctacaggccctggagagagtatgttggataaa

SEQ ID NO: 14466 - DNA, 144 bp, Homo sapiens
  misc_feature 9: n=a, g, c or t
  misc_feature 108: m=a or c
  misc_feature 112: m=a or c
  misc_feature 143: s=g or c
acctcgcgncggcctgacctgttaatcacgtccccacggctctcctagcggggacaccgccgtctgcaggctccgtccccacagtgcccagaccccgggaagtttgtmagtmagcaccctgatgccagccgattctcaaaaasc

SEQ ID NO: 14467 - DNA, 240 bp, Homo sapiens
  misc_feature 133: m=a or c
attactatgatcacattgatctaacccccaaagtaatggatctgtgtaatattttctacatatgtatgtgtgtcaggactttcccatggtttctttcgcattttaatgttgagaagtgaaaactgggtatccmgtcaagcttggagagtctgaagaaatagtatgaggtaatgtgtttcaaataaaggaaaatgagaagattcataaacttaagtcacttcccaaaaaccttctaccaac

SEQ ID NO: 14468 - DNA, 214 bp, Homo sapiens
aacccgctggggtctccgtttcaggctgtggaagctttgttgtttcagtctttgcaataaatcttgctgctgttcaccctttgggtttgtgcggcttttatgagctgtaacactccccgagaaggtctgcagttccactcctgaagccagcgagactgggaacccactgggagggaggaacaactccagacgggagacacgaacaactctggcc

SEQ ID NO: 14469 - DNA, 294 bp, Homo sapiens
  misc_feature 207: m=a or c
ggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacmcgcataccccagcgcccggcagttatgtattctccgctctgtctcacccaggatgaatttcatcctttcatcgaagcacttctgccc

SEQ ID NO: 14470 - DNA, 75 bp, Homo sapiens
cctgatagtgaataagtctcacaagatctgatggttttataaaggggagttccactgcacacgctctctcttgcc

SEQ ID NO: 14471 - DNA, 340 bp, Homo sapiens
  misc_feature 249: m=a or c
  misc_feature 281: y=c or t
  misc_feature 305: m=a or c
  misc_feature 315: m=a or c
  misc_feature 329: m=a or c
  misc_feature 332: y=c or t
acactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgamagcctccacccactccttccccggaccccgcytccgcgcgcaggttcctcccagtmacctttctcmacccccgcccccgmacytagcccgc

SEQ ID NO: 14472 - DNA, 335 bp, Homo sapiens
  misc_feature 46: k=g or t
  misc_feature 248: m=a or c
  misc_feature 252: y=c or t
  misc_feature 255: m=a or c
  misc_feature 277: m=a or c
  misc_feature 280: m=a or c
  misc_feature 283: y=c or t
  misc_feature 307: m=a or c
acactcgcgagcggaccgccacacgggtccggtgcccgctgcgctkccgcccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgamagcytcmacccactccttccccggccccmagmagytcggtcatcagaggacgcagtgamacctggtccctggcgaggtcccgctctc

SEQ ID NO: 14473 - DNA, 194 bp, Homo sapiens
acaggcgcagagtccactgcgcgggggcgggaccggggagctagctgcaggtacggtgctccgtctcctgtggaggctttagcggctcgtggacactgctcccccatttcctttcatttcccccgtcttctcagtgagatttccttggtgagttattggaggagaaaggaaggaaaactagaagccagcccgcc

SEQ ID NO: 14474 - DNA, 672 bp, Homo sapiens
  misc_feature 122: n=a, g, c or t
ttgtaagccccacctcaggcctactgaatcagaagctctgggggttgggtccagaagtctgttttagtcaaccctctaggtgattctgatgctcgctaaaggttgagaactactgctttagnaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccact

SEQ ID NO: 14475 - DNA, 79 bp, Homo sapiens
gacacttgatttctagtcgcagattcttagattccttattagtaaaatacatataatattttttatttttcagaaacat

SEQ ID NO: 14476 - DNA, 260 bp, Homo sapiens
  misc_feature 66: s=g or c
  misc_feature 67: r=a or g
  misc_feature 91: m=a or c
  misc_feature 123: n=a, g, c or t
  misc_feature 151: r=a or g
  misc_feature 218: w=a or t
  misc_feature 254: r=a or g
aggcgcgctgggtcttgtgggtggaaacgcgctggctgactggggtcggcgtttagttcagcgcasractcggggacctggagctgacgcmtagacacttgtattagctttaatagaagaganatggaggagccatagaatattaaggatraattctcgcttcttgctaggactgaaccatgagacttacagccatacttcacttttcccagggtttwtctataacaatggagtcgtcatgacctcctgtcgtraactgg

SEQ ID NO: 14477 - DNA, 261 bp, Homo sapiens
  misc_feature 158: r=a or g
  misc_feature 255: r=a or g
agtggcgtcaggggcgctttagggactggacttgcagtgtaaacagagacgctgcaaattgcttgtggacggtgtaggccgctgcaggccaccatgaaccggcttccggatgactacgacccctacgtcatgccaatctcatcttgttttctgcacargcgtagtcaagcttcatggcccttcataggacaaagtctgaaaaaaatggcagcatcagcatgacttgagggtggagctcttggccctgtgacgtcraaagag

SEQ ID NO: 14478 - DNA, 410 bp, Homo sapiens
  misc_feature 79: y=c or t
  misc_feature 88: k=g or t
  misc_feature 214: k=g or t
  misc_feature 215: n=a, g, c or t
tttccactcctgcaggaagctggagaaacaaaccctcttggctgtctgctgtccagggagtcgccactcccttcattayagccttgckcagagtgcagcggcaggcctggggatggcctcgggagagggaccacagagcaccagcctgcatggaacttccttcctcactcagcttcccacgttgccagctgggacaggggagatggagtaattkngctgtggaaagacttcacgtcttgccgaatgaaagtcccgcctgtctgtcacgctgatgcccgtgcagctgtctgagcacccggaatggaatgagtctatgcactccctccggatcagtgtggggggcttcctgtgctggcgtccatgaccaaggccgcggacccccgcttccgcccccgctggaaggtgatcct

SEQ ID NO: 14479 - DNA, 213 bp, Homo sapiens
  misc_feature 95: s=g or c
  misc_feature 103: m=a or c
  misc_feature 176: s=g or c
  misc_feature 181: y=c or t
  misc_feature 187: n=a, g, c or t
gggtgtgcagggttccagcgacagagcactggactcgtccagagggcggcgggtgagcggctggggccccgtggagccaccatggaccccgcagscagcagamccctcagtgcctcccaatcctttgactcacctgagcctgcaggacagatcagagatgcagctgcagagcgaasccgayaggggnagctcccgggcacttggaccaggtca

SEQ ID NO: 14480 - DNA, 115 bp, Homo sapiens
  misc_feature 73: r=a or g
  misc_feature 83: s=g or c
aaaaccggcgcgtgccaggagacagaggctggggaaggggggaggtgagaggaaagagggtggaaaggagagratagagagasaagagcggaggaccaggaaccagagagagaga

SEQ ID NO: 14481 - DNA, 346 bp, Homo sapiens
  misc_feature 165: k=g or t
  misc_feature 191: s=g or c
  misc_feature 217: k=g or t
  misc_feature 228: s=g or c
  misc_feature 234: s=g or c
  misc_feature 260: s=g or c
  misc_feature 272: k=g or t
  misc_feature 274: k=g or t
  misc_feature 313: k=g or t
  misc_feature 314: s=g or c
  misc_feature 317: k=g or t
  misc_feature 322: k=g or t
ttggcgggaggctgtggcggtcccttggtggggaagctgttgctgttgctagacgacgggaactagctctcgtcacttcctcagcccgccgtctgcccactcctctagccggaacctgggggcccgggagccggggtaggcacagagttgtcctcggaggtccakgacagcggccagcccggcggcgggastcagggccacgccacctgcagggaakaacccgagtcsaagcgsgaagatggctgcagacaagcctgcasatcagggagcakakaaacatgaaggcacaggtcagtcctctgggatcactgaksaakagaakgagttatccaccaatgctttccaa

SEQ ID NO: 14482 - DNA, 134 bp, Homo sapiens
  misc_feature 110: m=a or c
  misc_feature 126: n=a, g, c or t
  misc_feature 133: w=a or t
  misc_feature 134: y=c or t
cccaccttgacagatcccatcattacctgtggcttgtttttggtttggtttctatgctccatagctactgagactgacatctcttctcttgttgcaactttaatctgtcmaaccaatatgcaggtnagtctcwy

SEQ ID NO: 14483 - DNA, 208 bp, Homo sapiens
  misc_feature 119: s=g or c
  misc_feature 122: m=a or c
  misc_feature 123: s=g or c
  misc_feature 127: y=c or t
atgttggccgggcggaggtcttcgctgaggcccggggcggggtggcgccacccctgattgcggtgccacggactgctcctgctgggcggagaggacagattttgcaaagcggaggctgsgamsggtycctgcaggggaacagtgaggaaagggccgcctcgtctccgctcctgggggaccgcagaaataagaatcaaactccacaatg

SEQ ID NO: 14484 - DNA, 255 bp, Homo sapiens
  misc_feature 17: n=a, g, c or t
  misc_feature 122: r=a or g
  misc_feature 123: r=a or g
  misc_feature 238: k=g or t
tttgatgttttatgggncataatcatttgggaagtttttgttgtaaatgaagagttagtttgttgctattaatttgtttgacacataagttcattcctaaaagttagagatgttacataaarraagggttgaggactttatttcagaagtcatttaattttttctttattttctttcagattttgtatggtttattcagaagtgccaaatttcagtgaacccaacccagattatcgakgacagcagaacaaaggg

SEQ ID NO: 14485 - DNA, 235 bp, Homo sapiens
gggtggggccggcgtcgggcggggccggcggggtcttcagggtaccgggctggttacagcagctctacccctcacgacgcagacatggcagcgcagaaggaccagcagaaagatgcctaggcggaagggctgagcggcacgaccctgctgccgaagctgattccctccggtgcaggccgggagtggctggagcggcgccgcgcgaccatccggccctggagcaccttcgtggacc

SEQ ID NO: 14486 - DNA, 71 bp, Homo sapiens
acatcgtcctcagagtgctcggtcttcaggcagtacagcagctgcatggctttggcctgcaggagtaagtg

SEQ ID NO: 14487 - DNA, 151 bp, Homo sapiens
tgattcactcatctgtctccccatctctctgatctcgtctcttgcccagtccaccttgtttccgtgtcctgaccacagcaggcctcctcttggtcccctgaatgcatcttgctggtagcctctgttgttctttcctcctggaatgcccacc

SEQ ID NO: 14488 - DNA, 469 bp, Homo sapiens
  misc_feature 395: r=a or g
  misc_feature 417: r=a or g
aagtatgaggatgagatcaataagcgtacagaaacggagaatgaatttgtcctcatcaagaaggacatggatgaagcttacatgaacaaggcagagctggagtctcgcctggaagggctgactgacgagatcaaccttcctcaggcaactgcatgaagaggagatccaggagctgcagtcccagatctcgggcacgtctgcggtgctgtccatggacaacagcctctccctggacatggacagcatcatcgctgaggtcaaggcacagtaggaggagatcgccaaccgcagctgggctgaggctgagagcatgtaccagatcaagtatgcagagctgcagacgctggctggcaagcacggggatgacctgcggtgtacaaagacttagatctccragatgaaccggaacatcagccrgctccaggctgagattgagggcctccaaggccagggggcttccctggaggcc

SEQ ID NO: 14489 - DNA, 87 bp, Homo sapiens
  misc_feature 8: n=a, g, c or t
acacaacnactcttccccgctgagaggagacagccagtgcgactccaccctccagctcgacggcagccgccccggccgacagccccc

SEQ ID NO: 14490 - DNA, 121 bp, Homo sapiens
ctcgaccttggacttcaggccaggccacctgcccctggggagcccgcaccacagccccagctgcagctgagccgctctcaggcctcccctcctccctacctgcccccaccctccccacctg

SEQ ID NO: 14491 - DNA, 147 bp, Homo sapiens
  misc_feature 27: w=a or t
  misc_feature 43: k=g or t
attttggataccgtcctcgctgcggawagttggggcaacctgktgctagtctggtcgttggtgacagcgaggcttccgcgctcgctgctggtgagcagccccggcgtgccccgcgggctggaagaggcggcggcgtgatgcggcccg

SEQ ID NO: 14492 - DNA, 166 bp, Homo sapiens
  misc_feature 38: n=a, g, c or t
  misc_feature 126: m=a or c
gggccggaagagaggttgcttagcagcgtgtgtttctnccttgcctctgcggcggcggaggcctggcgatgcccaagaacgcagtggtcatcctgcgctatgggccctacagcgcggcaggcctamcggtggagcaccacaccttccgcctgcagggcctgcaagc

SEQ ID NO: 14493 - DNA, 121 bp, Homo sapiens
  misc_feature 8: y=c or t
aagattcytagagcggacagggcgatggcaggttcgccgggtgtgaggcttcacagcggtccggtgaccaagtcgagatggtgagaacaagaccaagattggaaagccagcttcagaggag

SEQ ID NO: 14494 - DNA, 135 bp, Homo sapiens
  misc_feature 8: y=c or t
aagattcytagagcggacagggcgatggcaggttcgccgggtgtgaggcttcacagcggtccggtgaccaagtcgaggatttttctggtggtctagtctcagagattacatctgtagtcagcacaatgattccct

SEQ ID NO: 14495 - DNA, 312 bp, Homo sapiens
  misc_feature 69: r=a or g
gcgagtgtgggaattcggcgtcgcgggagctctctgatccactcaggggtcagggcatcactggtctcrcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaaccc

SEQ ID NO: 14496 - DNA, 506 bp, Homo sapiens
  misc_feature 69: r=a or g
  misc_feature 420: k=g or t
  misc_feature 421: n=a, g, c or t
gcgagtgtgggaattcggcgtcgcgggagctctctgatccactcaggggtcagggcatcactggtctcrcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagckntatggatataaaaagcattcttaccggcttgttaaaaagcttaaactccagaaaatgaagaaaaatgaggtttacgagacattct

SEQ ID NO: 14497 - DNA, 178 bp, Homo sapiens
gatctttgcagcaatttgatgaattgggtgttctcgttatccccaggtgacaggcaactgaggcccagaagaaggttggtaatatgttaatgagttaagacatagcgccagggttcatgtgggtgagggtctgacaccagacagatgaagggtcgtcggctacagtgacttgagtacc

SEQ ID NO: 14498 - DNA, 139 bp, Homo sapiens
gctctggatccgctggttccgtaacaacatcccgttggcttccctcaggcggcgggaccagtgcagcgccgcctcccaggatcgtccgccggtcagggcccttgccctccccggcacaggccaccatggccaccaaccc

SEQ ID NO: 14499 - DNA, 427 bp, Homo sapiens
  misc_feature 17: r=a or g
gtcacagggacagaccracgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccaaatcgcctaccagaggaatgacgatgatgaagaggaggcagcccgggaacggcgccgcgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaagggga

SEQ ID NO: 14500 - DNA, 481 bp, Homo sapiens
  misc_feature 133: y=c or t
  misc_feature 325: r=a or g
  misc_feature 326: w=a or t
gatagcgagacacccagcgacgacgaggttgtcatggtgccgcggggccgtgctcgcgcatgcgccacctgacccacaggccggtcgtggagctgcgaccccggccctagggcagtccagatgaaaagagtaygaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcgttctgagctctgcagagcarwggagtccgaggacatgctgagcgccttaggctggagcagagaagacaggccgaggcagaactccaaaactgcaaagaatgccttcctaccctgtctcccatggtcgtcatgaagaatgtgcttgtcaaacagggcagcagctcatcccagctcca

SEQ ID NO: 14501 - DNA, 252 bp, Homo sapiens
  misc_feature 118: k=g or t
agtagagaaaaggggcctctggtgaccgcccctacctggcatccctctaacccaggaggagcgtggggaaaggggctgtgggcctctcggggagcgagctgcgggtagcggcgcactkggtacaggcgcgcgcttggctgtcgcctctgccgctgtgtttgggaggactcgaactggcgccaggaaatattaggaagctgtgattttcaaagctaattatgaaaacatttatcattggaatcagtggtgtga

SEQ ID NO: 14502 - DNA, 146 bp, Homo sapiens
gtttgtttccatctctaacggggtgcgttcgctacagggtcctcttggaacatatttgtttatttgacaagaggtgaaaatatgttatccttagcagatatgcaagtcccctttgtatgcctcgtgagatccttggcgtgtgcccc

SEQ ID NO: 14503 - DNA, 519 bp, Homo sapiens
  misc_feature 115: r=a or g
  misc_feature 117: s=g or c
  misc_feature 333: n=a, g, c or t
  misc_feature 423: m=a or c
  misc_feature 424: s=g or c
  misc_feature 426: k=g or t
  misc_feature 448: r=a or g
  misc_feature 519: r=a or g
ggggggtcaggatcctccacaggtaggcgcagtcagctggagcgtcgcggcgtccgccggtcgtggagggcgtgtcctgcggcgcgatggccgtagtgttgccggcggttgtggrgsagctcctgagcgagatggcggcggcggtgcaggagagcgcgcgaagtacgggaccgagttcctgatgaatatctgttatcgctgaagtttctctttggctcatcagccacccaggccttggacctagttgatcgacagtccatcaccttaatctcatcacccagtggaaggcgtgtttaccaggtccttggaagttccagtaaaacatacacatgnttggcttcttgtcattactgttcatgtcctgcatttgcattctcagtgctacggaagagtgacagcatcctgtgcaagcatctcttggcmstktacctgagtcaggttatgaggrcctgtcagcagctaagtgtctctgacaagcagttgactgacatattattgatggagaagaaacaagaagcr

SEQ ID NO: 14504 - DNA, 356 bp, Homo sapiens
  misc_feature 13: n=a, g, c or t
  misc_feature 20: k=g or t
  misc_feature 230: s=g or c
agttggggctgcngtcagckgatttactgcagtggcggcggcggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtsacaggtttgaaaacacaaacacaatggcaggaaacagccttgttctacccattgttctttggggtcgaaaagcgcccacacattgcatctcagcggtacttttaacagatgatggggccacgatcg

SEQ ID NO: 14505 - DNA, 375 bp, Homo sapiens
tgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaagga

SEQ ID NO: 14506 - DNA, 312 bp, Homo sapiens
  misc_feature 206: n=a, g, c or t
  misc_feature 297: n=a, g, c or t
ccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctntcaagatgatagaggtactgacaacaactgactctcagaaactgctacaccagctgaatgccctgttggaacaggagtctagatgtcagcnaaaggtctgtggttt

SEQ ID NO: 14507 - DNA, 252 bp, Homo sapiens
actctgacagtctgtcttttaagatcattttaaccactgacatttaaagtgattaatgatagctttgaattaatatctactgtatttgttactattttctactttttgccttttctctttgttcctgtctttgtcttctcgtttttctgccttttgtggttttaattgagccatttatataatctcattttctgtttttttcttagcatatcagttacacttctttttttactttttcttttcttttttttt

SEQ ID NO: 14508 - DNA, 309 bp, Homo sapiens
  misc_feature 7: k=g or t
  misc_feature 8: n=a, g, c or t
  misc_feature 9: n=a, g, c or t
tataatknnaatatacaatgctcaacatttaaattctatatggccaattgattcttacagaatgcctttttgatttttgtccaactcttgcatctgtagtcaacctgtggtcgcaattgacagaagagtttaattctttctttgtgctcggatcctgggtccctcattgtacagtgatcatcaaatgcaacatccttcatgaaaatgaatagcttcactttttggcatttccttcctttttatgtgtcatagaatacactacattattcttgattttacagttaatttgtaaattgtttctaaccccca

SEQ ID NO: 14509 - DNA, 114 bp, Homo sapiens
cttcctagatatattgtatacagttgacctatctaaaagcaattccttttattgcttgtatcacctaaccctacatacacataactaaattttttttttcttcttcttctttgt

SEQ ID NO: 14510 - DNA, 236 bp, Homo sapiens
aacaattccgagaaagagacggagagagagggaagaaaaagacagatagatactggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagg

SEQ ID NO: 14511 - DNA, 352 bp, Homo sapiens
  misc_feature 302: n=a, g, c or t
  misc_feature 323: m=a or c
acagtttcatcagatgtgacaaatttatccacagaatagattcctagaggtggaaatgctggtgtatcctattcctagtggtgtaggatagtctagtaatgaatagattgaagaaggaatatttgacatccaagggatgaactactttacttgaagccgttactcctttcagaagagtattgaaattgtttctctgaaagtgtatgtgaagcttaagtccctacaacctattaactgtgtgacactcggcaaatcccttacactctttaagtctcaattgccccatctatccagtgagactnataactgtacgtatttcatamagggtagtgagttaaatgtcactcccccg

SEQ ID NO: 14512 - DNA, 350 bp, Homo sapiens
agtgttaaagtcatataataagtacttatggagtaagtaaatgtgtaagacacaagagataacagatgaataagctaagtttgtatcctcaagaagtttaaagagtgaagggagtgaagaacttagtaagacaaagatgaatgtttagaacagtgcctggcacttagtgatgttagaaatgaaccttgaaggttggcaaagattttgatagacagttttcttttgattgtgacctactgagaggtcagtataggcagaaagcacagggcacacagagaagacaagttgaaaggtatagggctttggtggcaccatgggaatgggatatgttgaagacatagtattatagg

SEQ ID NO: 14513 - DNA, 178 bp, Homo sapiens
tgattgtgacatagattatactactactaatttttggatgtttcaaaaggtcaagaagtaaaagatgttagaaagcaatgagtgagtccttttgatttttaacttattccccatgtccctatacttcgtgtgcttttccttttttttttgagacggaggctcactccgtcacctaggc

SEQ ID NO: 14514 - DNA, 92 bp, Homo sapiens
aaaaaaagaaacatacatccttcagtataggagatgagggaatgagagaaaatattttttgaagaagcatttctgtaaaattagaaattact

SEQ ID NO: 14515 - DNA, 516 bp, Homo sapiens
  misc_feature 98: n=a, g, c or t
  misc_feature 395: k=g or t
  misc_feature 418: r=a or g
  misc_feature 513: r=a or g
atccacgtaatatggatgcacctttacctaactattcccctgttactattctttaggttgcttctagtttttctacaactataaataacatttttgtncatgtgtctttttcttctttttgtttttcctttctacagcctgttttgcaaatgaagacagacctaagctaatgaaaatgaatctttttcaggggttacatctcagatctttggactctcgtgctgatgccctttccattataccataatgcttgttttctgtaaagactacatggattgaaaacactatgtatcagctgtcttagcccattgttggaacaaggcaaggtagacataaaatgtaaataattcaagttaaaaattatctaacccgtctcctaccaagttaacagtttkattttgtaggtacttagacttaratcagtaaccttccagtttcctattgttaattcctttccccttctgcataataattaaagctgaatgcttagcttgtagattgttgaggaattgrtgt

SEQ ID NO: 14516 - DNA, 135 bp, Homo sapiens
actcgcggctgcgcggccctgtcaggagggaacgcagtgccaggtgcctgactcccagagacgccctgctggcggacttggagtctaccacctcccacatctccaaacggcctgtgttcttgtcggaagagaccc

SEQ ID NO: 14517 - DNA, 112 bp, Homo sapiens
aaaaaggtggtttcatcacattagggccagcaaggactacacagctaatttagacaccaagaccttcagagctctgatgtggagacaagccaagggtaccaaatggtaaagc

SEQ ID NO: 14518 - DNA, 91 bp, Homo sapiens
tgttacattccaaatactgaagtatttggaaattactgttccttgactgaaccaagcagtgattttcttttcttttcttttcttttttttt

SEQ ID NO: 14519 - DNA, 100 bp, Homo sapiens
  misc_feature 50: y=c or t
ccagaccctgctcacattccctctgctggtctgtgctggtctcagaaggycaccgcgcccgcattccactcagccagggtccagctgcctgcccccgcca

SEQ ID NO: 14520 - DNA, 216 bp, Homo sapiens
  misc_feature 173: n=a, g, c or t
aatgttgcccatatatacttactaaggacatgcgttccatttttctccttttttaaaaaaactttttcccctaacagttttcctttaaaccttgttttgtatagattttctgctgctagttattgtgacattggactgtttcccataaggaactcgatcattacccgttaggnacctctttttaaaaatacttttaaatttatttattttctgctg

SEQ ID NO: 14521 - DNA, 456 bp, Homo sapiens
  misc_feature 20: n=a, g, c or t
  misc_feature 49: r=a or g
gcgctccggaagtgaagcgnccagaccaccagctaatggatgcggaggragggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacga

SEQ ID NO: 14522 - DNA, 191 bp, Homo sapiens
agtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagatacc

SEQ ID NO: 14523 - DNA, 260 bp, Homo sapiens
agtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaa

SEQ ID NO: 14524 - DNA, 134 bp, Homo sapiens
cattttagctgtcaccagtatagttgatcaagaaagttctaagccataattttagtagtttaaagtatatatgtgtacatatatattttttttcattgaaaacagaagggaagacactttacacataatcttaa

SEQ ID NO: 14525 - DNA, 213 bp, Homo sapiens
agaaaagaaaggaccagtcttcactttctgcattatccccacattttattcattcatccagattacttcttcagtgcctcaggagtattcttctacaccagctgctgttaaaatgtacaaatgaactctagtcccaaggaatacagaagtgctcttattaccagttttcccacttgtggccgcctttgcaaagatccatattctaatttaagt

SEQ ID NO: 14526 - DNA, 91 bp, Homo sapiens
tctgtgaccagtgctggctgcaggcgttgcagtttttggtgcgtctcgttgatttgctgagcatatttatcatatgtaatggttcccccgc

SEQ ID NO: 14527 - DNA, 155 bp, Homo sapiens
  misc_feature 2: k=g or t
  misc_feature 101: y=c or t
tktttcgcgtgggggagggggcacgtctcggcgagtcacgatgatggcggccaccatcctgtggtgagctagcggattccctgcttgtctcgccgaccccytcgcgccttctgcagactccgtggctggcgctcggcgcgtgaggaagcacggcg

SEQ ID NO: 14528 - DNA, 95 bp, Homo sapiens
ttcaccatctgagagcactttagagaaaaattggctgactcttattttaaaaagcctattttcacataattataatggtgactaatttttttttt

SEQ ID NO: 14529 - DNA, 189 bp, Homo sapiens
  misc_feature 137: r=a or g
ctctattcttttaacctatctctgtctttatatttaaagtatgtttcttgtagacagcatgtcgatagctcttgcctttttatacaaactgtcaatatctgccctttaattagtatatttaatccattttcacttartataattagcaatattttatatttcattccaccatcttgctaattgtttccc

SEQ ID NO: 14530 - DNA, 229 bp, Homo sapiens
  misc_feature 139: n=a, g, c or t
agctctccagttatttgttggggaggaccatcttgggttcatagccagctaagaataaagaagttagactgggaaaaatgatatttaggaagagttttaaaacttattcactctaccattcttctaagtattctgaacnttcttctgggtacaaccaggttggtagggagctgattacttgggtgtcatagtagcctctgtctctgaataataataatacggggcatta

SEQ ID NO: 14531 - DNA, 414 bp, Homo sapiens
  misc_feature 68: n=a, g, c or t
  misc_feature 70: n=a, g, c or t
cttctcccgcctccctcggccttagccatggcgagtagcggcggtgctggggcggcggcggcggccgngncggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaacc

SEQ ID NO: 14532 - DNA, 317 bp, Homo sapiens
  misc_feature 275: n=a, g, c or t
atattcccgggcttctttctcctctgggtaccagctccttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgcnagcaaacagaagggaattttagacagaggctgcttcagtctc

SEQ ID NO: 14533 - DNA, 217 bp, Homo sapiens
  misc_feature 36: k=g or t
  misc_feature 37: v=a or c or g
  misc_feature 38: m=a or c
  misc_feature 189: r=a or g
atattcccgggcttctttctcctctgggtaccagckvmttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcraaaaccctgtgcggggtagtttccagct

SEQ ID NO: 14534 - DNA, 118 bp, Homo sapiens
  misc_feature 10: k=g or t
gtcctacggkagcgtgctggctcaccgaccgcattgcgcttggttttctcacccagtgcatgtggcaggagcggtgagatcactgcctcacggcgatcctggactgacggtcacgact

SEQ ID NO: 14535 - DNA, 112 bp, Homo sapiens
gatctaagatggcgactgtcgaaccggtgagtattgcctttggcccccacccccacgggtccccgcgctccgtcttccttctgactgggggactccgcgggacggcgttccc

SEQ ID NO: 14536 - DNA, 152 bp, Homo sapiens
attctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcaacc

SEQ ID NO: 14537 - DNA, 258 bp, Homo sapiens
  misc_feature 145: r=a or g
gcttccgctcggggcggggctgggctcccggggtaggtccgcggctgctgctgcgtccgacccccggccggcgcgggtatggagcttgggggtcactgggacatgaactcggccccgaggctggtctcgggagaccgcagagcgraaacaggagcagaagacaggaaccgaggcggaggctgccgactccggtgccgtcggagcccgccgcttcctgctctgtctctacttggtgggcttcttggatttgtttggtgt

SEQ ID NO: 14538 - DNA, 339 bp, Homo sapiens
  misc_feature 137: n=a, g, c or t
  misc_feature 143: s=g or c
  misc_feature 177: n=a, g, c or t
  misc_feature 178: n=a, g, c or t
  misc_feature 179: m=a or c
  misc_feature 266: n=a, g, c or t
  misc_feature 267: m=a or c
actcactgagagctccaggtagtgagcagttcagtcgatttcctcgttaccccgcccccctttctcttgcccccccacccctctcatctgcctggtggaggatgaagcggctgcagtggccccagcctcagcagcgncaccgscggtggctgcggtgtgggtggccggaactgggcnnmgtgaagaagcggtggtggcggctgaaggagcggtagcagcctcagcctctttccctgtgcttcctttcctctttagtgcagcgaggnmgttttcgcttctgtacatgtgtttgtgtgcgtgagtgtgggtgtgtgcggtgaggtttgggtggcgtttgtg

SEQ ID NO: 14539 - DNA, 411 bp, Homo sapiens
  misc_feature 10: s=g or c
  misc_feature 236: r=a or g
  misc_feature 305: s=g or c
  misc_feature 313: s=g or c
  misc_feature 314: r=a or g
acagtgctgsctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccgragcgagcctgggggccgcccgccgtgaagacatcgcggggaccgattcaccatggagggcgccggcggsgaaacgasragaaaaagataagttctgaacgtcgaaaagaaaagtctcgagatgcagccagatctcggcgaagtaaagaatctgaagttttttatgagcttgctca

SEQ ID NO: 14540 - DNA, 110 bp, Homo sapiens
gtgtctgtctgtgaggcgctgggtgcacgtccccagggctctgggctaggaaggcagcggcgaggtgcctccccacgtacccctcgcgggcccagccgagcaacgtgggg

SEQ ID NO: 14541 - DNA, 124 bp, Homo sapiens
agtgtgcatgttcactgggcatcttcccttcgacccctttgcccacgtggtgacctctggggagctgtgagagtgtgaggggcacgttccagccgtctggactctttctctcctactgagacgc

SEQ ID NO: 14542 - DNA, 120 bp, Homo sapiens
aattgtgtggctggactcggccgcccctgtggtgtgaggcgcgtgttcgggctcttgccgtccccgcacccgcaccgcggttactggcttgcggtccgccgttcgacaaccagcccttgg

SEQ ID NO: 14543 - DNA, 228 bp, Homo sapiens
agtacgcggggaagcggggacccgctgtcactgcgcctcccgctgccgacgccgcctggacggccgcactctccctgcccgagacccgactctccagaaagagcaacagtaatggagtacatgagcactggaagtgacaataaagaagagattgatttattaattaaacatttaaatgtgtctgatgtaatagacattatggaaaatctttatgcaagtgaagagcca

SEQ ID NO: 14544 - DNA, 125 bp, Homo sapiens
gtctggcctgcgcttgcgcgggtctccgccgcctgggctcctagggactgtggcctcggcggtatgtcccttgctttcccttgaagcgggagaagacccggcagaggcgctctgtccgctgcagc

SEQ ID NO: 14545 - DNA, 247 bp, Homo sapiens
  misc_feature 169: n=a, g, c or t
tgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggncgagccgggcgagaggtaacccccttactgtcccctctggctcccccggctcccgacacccacgacccctccctccgt

SEQ ID NO: 14546 - DNA, 122 bp, Homo sapiens
  misc_feature 23: s=g or c
  misc_feature 30: n=a, g, c or t
  misc_feature 108: n=a, g, c or t
gtcatgggtcaaaaacgcgacgscggaggncctttgctctcaccggggtcgagccgcggcgagggaacggatcggagacgctgcgcctgctcagaaggtagcgcaggngggaaaggcgggag

SEQ ID NO: 14547 - DNA, 147 bp, Homo sapiens
acagcctccgccgcagccgcctcagagcggcaggagggagcagtcggtcgctgcgccccggcgggccactttcccgggaccgctcgtcttccttgggccgagattttccactgcgcccctccgagtacccgggttccaaacccctag

SEQ ID NO: 14548 - DNA, 125 bp, Homo sapiens
aaagttcggggccagcagccgtctacccggtgtcgcgttctgtgttgtggcggccctggatccggcgtcagggcgaccgggcggacgaggtggagccagagtctgtcaggcgggttggtgaaggg

SEQ ID NO: 14549 - DNA, 109 bp, Homo sapiens
cttctttaactgtctcctgtttttcttcttctctctgaaatgcatgctacttggatgtttggcctcttagattgatctccatcaccctcccctgtgcccgtcccgcccc

SEQ ID NO: 14550 - DNA, 205 bp, Homo sapiens
gttagaaactacttgaattgcaaaaagatattttattagtcatcagagtcattgcactttctcaaaaacaacctcaacattcaaataaacctttgccagtcaccctggaggttttgcatagacaatgcatcattataagatttgaaatgagggtcaagtaaatatttcttttgtaaggtgggaaaaggatctcttatgaaagcag

SEQ ID NO: 14551 - DNA, 154 bp, Homo sapiens
  misc_feature 122: k=g or t
  misc_feature 123: s=g or c
  misc_feature 136: n=a, g, c or t
  misc_feature 140: y=c or t
tgaattttgtggggaggcacaattcaacccctaacacaccctgtttttcaggtggagaccttcagttatgtagtgtcatagttctgccctgcagattttttctgccctgcaggttttttctkscctgcagtgtaanttaycacttgaataatca

SEQ ID NO: 14552 - DNA, 332 bp, Homo sapiens
  misc_feature 65: r=a or g
  misc_feature 66: w=a or t
  misc_feature 95: n=a, g, c or t
  misc_feature 96: r=a or g
  misc_feature 137: n=a, g, c or t
  misc_feature 138: n=a, g, c or t
  misc_feature 184: m=a or c
  misc_feature 196: r=a or g
cttttatccgaatgtcggccctgcggtcagcgcgtccctggtcggagacaccgagggtgtgaccrwgtccctggcagtgctgcaggacgaggcgnrgaatattgccaattccgacgtgtggagtgctgaacaatganncggaagactggagcgtgactgtgatccccggtgcgaaggtgttggmagtgacagtgargtggaagagaggtctggactggtgttcctccaatgagacagattccttctcagagtccccctgtatcctccagacccttctggtttcagcatccccctgtatcctccagacccttctggtttcagcatcacataat

SEQ ID NO: 14553 - DNA, 174 bp, Homo sapiens
  misc_feature 25: m=a or c
agaggggactgggcgccggcggggmaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcgg

SEQ ID NO: 14554 - DNA, 312 bp, Homo sapiens
  misc_feature 12: s=g or c
  misc_feature 108: r=a or g
  misc_feature 115: k=g or t
  misc_feature 120: r=a or g
  misc_feature 171: n=a, g, c or t
  misc_feature 172: n=a, g, c or t
  misc_feature 241: n=a, g, c or t
  misc_feature 257: w=a or t
  misc_feature 258: r=a or g
  misc_feature 287: m=a or c
  misc_feature 296: r=a or g
  misc_feature 297: s=g or c
agacgacggagscggccaagctggaggaacgggaccgagggatcgaccgaggctggctggctaggggtgggactggcagagctacggacaggtgggagcagtcagacrgcctgakgagarggagaccagaacgcaaagagagcgagagcattaagtaggcagggagaggcnnacagaaagatagacagcaacactcgcgtgctccctccctccacacgccctcctcttaccgagcgaaggnccaggggcacagaagwrggagaaggactgtggcacagaagaccggmagagggacrstgcattgctggtggg

SEQ ID NO: 14555 - DNA, 466 bp, Homo sapiens
  misc_feature 458: n=a, g, c or t
  misc_feature 459: n=a, g, c or t
cgaaaaattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcactctcccagcgtttctccggtttgccaatcctcttaagnnttcctgt

SEQ ID NO: 14556 - DNA, 305 bp, Homo sapiens
cgaaaaattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatctccctcgtggaaaaaaagagggaacaccagcagccttgtataagctagataaaatcttctggctttccgcagcccagggagaaacagaaaacggcagccctaatttaaagaaacccggtgcaagctttcaggtacaccccccagtagagttgcaag

SEQ ID NO: 14557 - DNA, 183 bp, Homo sapiens
aaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaa

SEQ ID NO: 14558 - DNA, 134 bp, Homo sapiens
actccctctctcttctccactatggacagagcctccactgagctgctgcctgcccgccacatacccagctgacatgggcaccgcaggagccatgcagctgtgctgggtgatcctgggcttcctcctgttccgag

SEQ ID NO: 14559 - DNA, 316 bp, Homo sapiens
  misc_feature 134: s=g or c
  misc_feature 261: m=a or c
  misc_feature 265: m=a or c
  misc_feature 311: n=a, g, c or t
agactcgattccccctcttcctcctcctcaagggaaagctgcccacttctagctgccctgccatcccctttaaagggcgacttgctcagcgccaaaccgcggctccagccctctccagcctccggctcagccgsctcatcagtcggtccgcgccttgcagctcctccagagggacgcgccccgagatggagagcaaagccctgctcggctgactctggccgtgtggctccagagtctgaccgcctcccgcggaggggtggmcgcmgccgaccaaagaagagattttatcgacatcgaaagtaaatttgccntaagg

SEQ ID NO: 14560 - DNA, 91 bp, Homo sapiens
agtctgcggtgggcagcggaggagtcgtgtcgtgcctgagagcgcagtgtgctcctgggcaccgcgcagtccgcccccgcggctcctgacc

SEQ ID NO: 14561 - DNA, 125 bp, Homo sapiens
  misc_feature 79: m=a or c
  misc_feature 80: k=g or t
gggctctgctgggggccccgtgcatctttgttcctcgcggccgttgtcgccgcttcgccccgctagtgcccccggcctmkggcgctttgtctttcaccgctaccccctgcgactctctacccccg

SEQ ID NO: 14562 - DNA, 112 bp, Homo sapiens
  misc_feature 40: s=g or c
  misc_feature 70: k=g or t
aacagctaacatggcggcgcctgtgtgtcctacggcggasagtttcgtaccggcttcttctctggggtakgggtagcctcgcccggaagcaaggcctctggaaaccgcggcc

SEQ ID NO: 14563 - DNA, 225 bp, Homo sapiens
  misc_feature 10: r=a or g
agcgtagtgraggaggcgcggttgtgagtagtaccgggagtggggtgatcccgggctaggggagcgcggcggccgcgatcgggcttagtcggagctccgaaggagtgactaggacacccgggtgggctacttttcttccggtgcttttgctttttttttcctttgggctcgggctgagtgtcgcccactgagcaaagattccctcgtaaaacccagagcgaccct

SEQ ID NO: 14564 - DNA, 141 bp, Homo sapiens
  misc_feature 16: s=g or c
  misc_feature 31: m=a or c
  misc_feature 32: w=a or t
  misc_feature 76: y=c or t
ccggccagcgcgccascccgcctgcccttcmwcgccaccgggctgctctggtctcgtcggtcccctcctccgcccygtcgtcctgactctctctccctcctttcctcagaggatgtccggcttccagatcaacctcaaccc

SEQ ID NO: 14565 - DNA, 252 bp, Homo sapiens
  misc_feature 12: n=a, g, c or t
  misc_feature 99: m=a or c
  misc_feature 100: w=a or t
agcgcgtgagtntcgctctgttttatgtgtgcttcccagtcctgtggtgctgctataccggggacgttgagtccccacagacctggaaattgcggcccmwctttctcaacccagagcaaattgagacgtccgggtgagagtccgtgagtcccttcgagtttaaagtggccctgaggcaggtcccgtcctcggtctttctgcagtggggtcgtgcagacacctcctatcgcggaattttccttctcaaaaccc

SEQ ID NO: 14566 - DNA, 633 bp, Homo sapiens
  misc_feature 91: r=a or g
  misc_feature 134: m=a or c
  misc_feature 135: r=a or g
caccaaaaggacctagttctgtagaagacattaaagcaaaaatgcaagcaagtatagaaaaaggtggttctcttcccaaagtggaagccarattcatcaattatgtgaagaattgcttccggatgactgaccamraggctattcaagatctctggcagtggaggaagtctctttaagaaaatagtttaaacaatttgttaaaaaattttccgtcttatttcatttctgtaacagttgatatctggctgtcctttttataatgcagagtgagactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaac

SEQ ID NO: 14567 - DNA, 603 bp, Homo sapiens
  misc_feature 129: k=g or t
  misc_feature 138: n=a, g, c or t
  misc_feature 529: r=a or g
  misc_feature 530: n=a, g, c or t
  misc_feature 531: k=g or t
  misc_feature 556: w=a or t
tttctttatgaggcaaatttatattttttaatatcggggggtggaccacgccgccctccatccgtgctgcatgaaaaacattccacgtgccccttgtcgcgcgtctcccatcctgatcccagacccatkccctaagcnatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagacrnkgggatcgtagatttttacaatctgwatctttgacaattctgggtgcgagtgtgagagtgtgagcagggcttg

SEQ ID NO: 14568 - DNA, 301 bp, Homo sapiens
  misc_feature 17: n=a, g, c or t
  misc_feature 88: s=g or c
  misc_feature 89: r=a or g
  misc_feature 189: w=a or t
  misc_feature 192: n=a, g, c or t
  misc_feature 210: y=c or t
  misc_feature 257: n=a, g, c or t
  misc_feature 258: w=a or t
agatcaggaagccagcngagagacagggctacgtttcagggagggaaacagattcagcagcggcagcagctggagaaggtcgtggagsrgcaccttgcctgcagggtgttctgagaatcagccatgtcatccctgtacccatctctagaggacctaaaagtggaccaagccattcaggcccaggtcagwgcntcacccaagatgccagcyctgccagtccaggcaacagccatttccccaccaccagttttgtaccnwaacttggcagaactggaaaattatatgggtctttccctctcca

SEQ ID NO: 14569 - DNA, 138 bp, Homo sapiens
aacagtttttggatgtttcatttttttccaattctttgttttcttttgcattttaatttggaaactttcttttgacctattttcgagatcactggatcactggttctttcctcagctatgttgagtctactgatgagc

SEQ ID NO: 14570 - DNA, 314 bp, Homo sapiens
  misc_feature 125: m=a or c
acactgtccagccggctccctttttccccctccccgggggccaagggctccggctgctgcctggcggccaacgggccaggtaggatttccgggagaggcgctgtggaggctgaggaggcggcggmggagatctggaaacagtatctcacctccctaaactggttaatagtcatggaagatccatttgaggaagcagaccagcccactacagagccaggcatggtcctggacagtgtggaagcaggagacacaacacctcctaccaaaaggaagagcaagttctcaggctttggcaagatcttcaagccctggaa

SEQ ID NO: 14571 - DNA, 103 bp, Homo sapiens
agattggaggggcggctgcgcgaggctgcagactggtgcagcgcactgtgctggcggctgggcctcctccacctcctcgtctttctcccgggaaccttgacga

SEQ ID NO: 14572 - DNA, 179 bp, Homo sapiens
  misc_feature 10: k=g or t
  misc_feature 11: s=g or c
  misc_feature 120: m=a or c
  misc_feature 122: m=a or c
  misc_feature 126: y=c or t
  misc_feature 133: s=g or c
  misc_feature 134: s=g or c
  misc_feature 144: r=a or g
  misc_feature 150: s=g or c
agtgacgcgksgctctgcggagaccaggagtcagactgtaggacgacctcgggtcccacgtgtccccggtactcgccggccggagcctccggcttcccggggccgggggaccttagcggmamccayacacagsstactttccargcggascatgtctggtaacggcaatgcggctgcaa

SEQ ID NO: 14573 - DNA, 257 bp, Homo sapiens
  misc_feature 242: m=a or c
  misc_feature 243: s=g or c
  misc_feature 257: r=a or g
catagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggamsaagaatatgtggar

SEQ ID NO: 14574 - DNA, 142 bp, Homo sapiens
  misc_feature 128: r=a or g
  misc_feature 131: w=a or t
aaccgcgggactcctggagaaatggtgggcggtccaaacggtgagcagcacgctccttacttaggtcatgacctctgccgactaaaaaggctaaactcagcgtggattagggctataccaggtactgracwcttctagagta

SEQ ID NO: 14575 - DNA, 135 bp, Homo sapiens
  misc_feature 115: m=a or c
  misc_feature 120: m=a or c
  misc_feature 122: w=a or t
gcctgggccgcccgtcgtacctgatggtaggaggcagtagttccccgcttcccttccgcgggcagggagagttagctagccatccaagaaaacaccatgaaagataacgatatcmagagmcwactgtatacccat

SEQ ID NO: 14576 - DNA, 173 bp, Homo sapiens
ctcctggggggcctagtaggaccctgtgggcacgttggggaggagcctacaggcgcctcagctgcacgggagtgtgtttgcatccagcagtttgggcccccggccggtggcgtctccacctgcacgtgaggctgtgtgatgcttgcaggcatctcggtggggagggtggcagc

SEQ ID NO: 14577 - DNA, 576 bp, Homo sapiens
  misc_feature 292: s=g or c
  misc_feature 567: n=a, g, c or t
  misc_feature 573: n=a, g, c or t
caagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttstgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctntgaaantag

SEQ ID NO: 14578 - DNA, 344 bp, Homo sapiens
cattgcccttgttctgtctagattacctgtttgagccgtaagctacttgtgccaacttggtgttgtaaatagcatccatggaccagtcgtggtggcttatgcctgtaatctcaacacttggggaagccaaggcaggcggatcacttgaggtcaggagtttgagaccagcctggccaacgtggtgaaaccctgtctctactaaaaatacaaaaaaaaaattggctggatgtggtggtgcgtgtctgtagtcccagctactcaggaggtggagattgtagtgagctgagattgccgttacactccagcctgagctacagagtgagactccgtctcaaaaaaaaaaa

SEQ ID NO: 14579 - DNA, 146 bp, Homo sapiens
  misc_feature 106: k=g or t
  misc_feature 130: n=a, g, c or t
aagtccctgtccttaccttcagcaggagccggttccctgtgtgtgtgtccgctcgccctctgctccgtcctgcggctgcccactgccctcctacggtccaccatgkccctgctgcactccggccgcgtcntccccgggatcgccgc

SEQ ID NO: 14580 - DNA, 217 bp, Homo sapiens
aagtccctgtccttaccttcagcaggagccggttccctgtgtgtgtgtccgctcgccctctgctccgtcctgcggctgcccactgccctcctacggtccaccatggcctaccaaggctttgccagtggtgatggtgataaggatgcctgggctgtgcgccacttcatcgaacagggcattaatgtttgtctctgccaatcatatgccaagaacatgg

SEQ ID NO: 14581 - DNA, 121 bp, Homo sapiens
aaaaacggaaaggttcggaatttgcctctgcgccactttttttgcctgttacctgtgacgtccttggaagcagaatctgaaactttctgaggagagcatttgagcttcagatttctaacag

SEQ ID NO: 14582 - DNA, 148 bp, Homo sapiens
  misc_feature 6: r=a or g
tcctcrccccctcccgtctctcccccgcctcttcgctctcgctcggctccctctctagctgaccttccctttccctcacgcctccccacgcccggcccctggccccagcaccctgtccgctgccgcctcagagccgggaaaagcagcc

SEQ ID NO: 14583 - DNA, 106 bp, Homo sapiens
acctttgttttagatatatgtattataaatcttttcttattctatgacatgtctttcattttcttaatagtgttttataaagagtagaagttttaaaattttgatg

SEQ ID NO: 14584 - DNA, 272 bp, Homo sapiens
  misc_feature 33: n=a, g, c or t
  misc_feature 84: s=g or c
agtttcctcgtgcagcggtaggcgagagcactntgaggagcgtgcgcgggggccccgggagacggcggcggtggcggcgcggasagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaaca

SEQ ID NO: 14585 - DNA, 86 bp, Homo sapiens
  misc_feature 40: n=a, g, c or t
  misc_feature 57: r=a or g
gagaagcggcgtcggcggctggagcagaggcagcagccgnacgagcagcggaggcgrtcgggagcgatggtgaagatggcggcggc

SEQ ID NO: 14586 - DNA, 400 bp, Homo sapiens
  misc_feature 43: n=a, g, c or t
  misc_feature 354: s=g or c
  misc_feature 355: m=a or c
agggagggacagagagcgaactgtcagatcggagcgagagcgngcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaasmgagcgattcgacatcattttttttcctgttcaattttttccttgt

SEQ ID NO: 14587 - DNA, 357 bp, Homo sapiens
  misc_feature 120: r=a or g
  misc_feature 124: r=a or g
  misc_feature 139: r=a or g
actgcggctgcgcaagctcgacgcgcgcactcttgtctgcttacgagggctcctcccttcagctttggtccctcggggcgtctgggcagcctacgctttccggataaaaatggcagaatraaargaattatgagtggarctagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaattgtctatagata

SEQ ID NO: 14588 - DNA, 538 bp, Homo sapiens
  misc_feature 354: k=g or t
actgcggctgcgcaagctcgacgcgcgcactcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctgactggaatcagccattttaccaagaaagttgggtttcttttactggcaaatagtacttcaagagcacagtcttatgtaagaagtacagtckatataaagactgtccaggacaaaaactggccactccattcagcattgacagcagtatttaaagctggtgcatggtgaggtgaagtttctcaagggcaaagacaatgccttcatgcatgttcagtgtctgcccccgtgggctttgaaatgatcgctgacaatgggggatctgcagtgacttctct

SEQ ID NO: 14589 - DNA, 167 bp, Homo sapiens
aataatgccccgcggtcccgcgagctgccagtctcgtcgcgagaagcagcggcccggggcgactgagcggacaaacggaagtgtaggttacggtctgagacatcaccgccaagctgggctcggggtaaaaagtggctgcggtgtttggcaatgctaattcaatgccg

SEQ ID NO: 14590 - DNA, 546 bp, Homo sapiens
aataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacat

SEQ ID NO: 14591 - DNA, 335 bp, Homo sapiens
ctgtgttagagaactccaaggaagtaaaactgattaaaatgttcatgcttgaatggtgctgatggaatagttcatttggactttctctacctcctgcagctcaagctgaaatattaaaattcagtggatttaaatctctttcctctcagctcaggaaaaaaacattacattttaataggttttaaacccataattcattggtttggagcagcactattaaatctatttaaatattacttgtattactaaggaaatgatttaaatgactttgcctttaccatcctatgtgtttgagttagtttaaaaaaagaaagacaatacctttgcggtccccc

SEQ ID NO: 14592 - DNA, 431 bp, Homo sapiens
  misc_feature 147: s=g or c
  misc_feature 364: r=a or g
actgaaatctgagcaggacggaatctccaaaacgcataagctgctgcggaggacttgttccagcacagtcaagactgatgatgtgtggtggtcacaaagtcacacaggacctttggccgctccttgtccagcgatcccagggcggasaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaraaatcacaaattgctcagcaagtcctactccagtgcccccaagtcatccaaaactgagcttttcaag

SEQ ID NO: 14593 - DNA, 113 bp, Homo sapiens
ctttcttccttttggtgcgagcttgctgtggtttttgctctgggtcctctgggatggcgcctggctgtggccgcgtggtctctcacgcaggggcgccgggcgggggaacgcgg

SEQ ID NO: 14594 - DNA, 221 bp, Homo sapiens
  misc_feature 12: s=g or c
  misc_feature 13: r=a or g
  misc_feature 197: n=a, g, c or t
  misc_feature 198: w=a or t
gatcggagcctsragccggtgtgtgctgggtgccgagaagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacnwgaggagcctgttcctctcacgcc

SEQ ID NO: 14595 - DNA, 158 bp, Homo sapiens
gctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggc

SEQ ID NO: 14596 - DNA, 289 bp, Homo sapiens
  misc_feature 281: n=a, g, c or t
  misc_feature 282: w=a or t
ctctctcgcgacgcctttcacaacatgtattataactctttccaccaatttcaaatagtgcggcttaaaagatgaaggagagctaaacaaaccagaaagaaaagaaagaaaaaatccgcacccaatttcgtatctccagttggtaaagaatgtagctgtccgctattttggaacgtctcgtatttctgagtctttcacaatgtgaagtacttcataaagacagtaaaatcctctcaagatcataaagatgcttttgaatccatggtttcccaaaggagggnwagcgcca

SEQ ID NO: 14597 - DNA, 90 bp, Homo sapiens
gacgggctgtcggccagaccccgagttctcggtgcgctcagcggccgccgacgctaggaggccgcgctccgcccccgctaccatgaggcc

SEQ ID NO: 14598 - DNA, 146 bp, Homo sapiens
  misc_feature 107: m=a or c
  misc_feature 110: w=a or t
  misc_feature 115: m=a or c
  misc_feature 118: m=a or c
  misc_feature 119: r=a or g
  misc_feature 127: r=a or g
  misc_feature 137: m=a or c
  misc_feature 139: s=g or c
  misc_feature 141: s=g or c
tacctggggcgcgggtccctgccggaaggggcgtccgcgacgcagctgttcacgcttaggtgggcgcaggatggcaaaacagaagagaaagttcctgaagtgacagmgawaaagmacmraaagctgragaaggcgtmasasgaggg

SEQ ID NO: 14599 - DNA, 488 bp, Homo sapiens
ataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtgg

SEQ ID NO: 14600 - DNA, 453 bp, Homo sapiens
  misc_feature 387: s=g or c
  misc_feature 437: m=a or c
ataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccccaagcttccttctaaatccccacacctcgtgggtgcctcgcccacaccgggaagcacctcggttgcgggtgggggttgcagctcccctccagcgcccgcttcccgctctccacagccattgagcaggagaagcggagtgaaatttcctaagatcctggaggatttcctacccccgtsctcttcgagaccccagtcgtgatgtggaggaagagccactgcaagatggmcacgagcacaagctgc

SEQ ID NO: 14601 - DNA, 298 bp, Homo sapiens
  misc_feature 55: r=a or g
ataaggctaggggcgggcgccgctcttttgtttcttgctgcagcaacgcgagtgrgagcaccaggatctcgggctcggaacgagaccccatggggtgggtgaagaggagtggcccagctgagctgaggaaggtgaccactgagaacccattcaacctgctgagcaggctgggcagaaaggagcaggacaaccaggaacttcaagaacttatccagagtgtgaaggacttcctcaaccaggagggggctgatcctgatagcaccaaactttgatggcccagcagcagagggtcaaccag

SEQ ID NO: 14602 - DNA, 173 bp, Homo sapiens
  misc_feature 129: m=a or c
agttctggccgctgtcccggtgcgcacggacgtggctcgagtttcctctgctctccgctctcgcccgctagctctcctcccttccgctcctgcttctctccgggtctcccgctccagctccagccccamccggccggtcccgcacggctccgggtagccatggaggaccccac

SEQ ID NO: 14603 - DNA, 51 bp, Homo sapiens
acggaggactgcaggggcctgagccgctgctgcgccgcccgccgcccccgc

SEQ ID NO: 14604 - DNA, 336 bp, Homo sapiens
  misc_feature 274: n=a, g, c or t
  misc_feature 275: n=a, g, c or t
  misc_feature 276: n=a, g, c or t
acttgggacccgcgactcgcggcacgccactctcccggaggcggtggctagatggggctgggctggcggctagcacggcctgtggcgcgacgaccgctgtatttgcatggttcgcataggcagagaaccgtggggcttcggcagtgggaatttgagataggagattggggtcttccgagccttcccagtgcgggttcgaacctcagctgttttgcgagtggcgtgatcttaggcaaagctgacttaacctaagtttcggtcgtgtttctaaaannncctctgtaaatctatgaggcttatgcgcgagtactggttgctgcattaaaagacaaactt

SEQ ID NO: 14605 - DNA, 84 bp, Homo sapiens
tctccttttcacggcgtcttgcattactattgtgcggctgcaggaggtgtcgagcggcgttatttttttttgcggtttgccttt

SEQ ID NO: 14606 - DNA, 75 bp, Homo sapiens
tctccttttcacggcgtcttgcattactattgtgcggctgcaggaggtgtcgagcggcatgcatgcccccatata

SEQ ID NO: 14607 - DNA, 265 bp, Homo sapiens
  misc_feature 8: s=g or c
  misc_feature 17: n=a, g, c or t
  misc_feature 21: k=g or t
attctgcsctcctagcnccckccctccctccccctgcttcctctctcctcctctctccccttccctcttcggctccacggctccctcggccgctgccgtttccaacccccccactccccgccagctggtggcaatacaaactaacataaaaccagccaaagccgggcgcggtggctcacacctgtaatcccagcgctttgggagaccgaggcgggcggatcacaaggtcgggagttcgagaccagcctggccaatatggtgaaac

SEQ ID NO: 14608 - DNA, 179 bp, Homo sapiens
  misc_feature 37: n=a, g, c or t
cattttgttctgcggtgctggtatttagagcgcaggnctgacgggccggatcgccttcgccgccgcccgccggggagggcccgtcaaaggatgcaggggaggaggcggggagggggccaccagagccagggtgaaccttatactaaaaaattacaagttttgatctgatcctctctcat

SEQ ID NO: 14609 - DNA, 119 bp, Homo sapiens
aaaaagagagaggcaagggcaggagtgaaggagagagctgaagcctggggctccgagatggtcagaggatgggagacggggcagtgaaacaaggcttcttgtatcttcagcagcagcag

SEQ ID NO: 14610 - DNA, 111 bp, Homo sapiens
actcagcaggttgggctgcggcggcggcggcagctgtggaagctcaggcgctgcgcgtgagaggtcccagatacgtctgcggttccggctccgccaccctcagcttctctt

SEQ ID NO: 14611 - DNA, 234 bp, Homo sapiens
  misc_feature 151: n=a, g, c or t
gtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgccnatggccactaggcagagggaatcctctatcacctcctgctgttccacctcgagctgcgacgcagacgacgagggcgtgcgcgg

SEQ ID NO: 14612 - DNA, 107 bp, Homo sapiens
agaggaaggtgccacatacctttaaacaaccagatcttgtgcaaactctatcactagggggaggttgctaaaccattagaaaccacccttgtgatccaatcacctcc

SEQ ID NO: 14613 - DNA, 299 bp, Homo sapiens
aggaggatggaggatactttacttcccatttgatcccacatatggatatgatttacttggagtataaaggacaaagaaaaagggtataggcagactatcaggagaggtaaaccaatttaagctaatgcaaaacgaaaaaaaagacaaatgtttatgtctgatgacataaaattaaaagattactagttcagtcagtttaatgaagataatctggtccagttaataaagaaaactgagtatatgtattgtaaccatgtctgaagaggcaatcctgaaagcattttttttttttctgaagc

SEQ ID NO: 14614 - DNA, 115 bp, Homo sapiens
ctttgaggactatcagggtgttgagctgagcacacatttctttggtgaagtgtgttatttgttgttgttgttgttgttgttttcttgaaatggagttttgctcttgtggcccagg

SEQ ID NO: 14615 - DNA, 233 bp, Homo sapiens
ttaattttactcagtaatattttgtagtttcaatgtacagttcttgcacatattttgttaaaattatccctacttctttcacattttttgatgctattgtatttaaacaatggtattttatttcaatttccaatcttttgttattaaaatgtaaaatacaattgatattttatattgaccttgtatcctgagaccttgctaagcttactacttctactatccttttttatagc

SEQ ID NO: 14616 - DNA, 281 bp, Homo sapiens
attctggacctgagttggttcctgttagtgtcaaggatggggtcagaccgagaatgctgggggagggttttccgctggaaaaattgcgctagagatttggccaaaaacaaacaagcaaaaatggcttgccctcaactaatactcggcagtgatgagtgctggaaaaacgggcgaatataagaatatttaacagctctgaactggttcatcctggaaccaaggaaagtatgcaaggaggcagggttacttttaaggagtctggcttcctgtgctgaatccgg

SEQ ID NO: 14617 - DNA, 140 bp, Homo sapiens
ttagactatgtagtatgtgacagaatttttttaaaattataaaaagattttatttagtaattgggatttacttaaaataattttggaataatgctcccagacttgcccagatttgtgtaattgtacttattgccactggc

SEQ ID NO: 14618 - DNA, 420 bp, Homo sapiens
  misc_feature 137: k=g or t
  misc_feature 138: n=a, g, c or t
  misc_feature 139: n=a, g, c or t
  misc_feature 142: r=a or g
  misc_feature 148: k=g or t
  misc_feature 153: n=a, g, c or t
  misc_feature 179: k=g or t
  misc_feature 200: k=g or t
aacactcctggagtgaagagccgacctgtttcactgtcctgactcaccaccatcttggtagtgtgcaagactctgggacggcatgagaaaggcagaaagggagcaaaggagctggtggggtgtcacagggcctatgknngargcagakgtgangttctgcatccagttttgcaatttakccatttacctgcctgagactkggaaacacctactttatagtcctgattcaagtgttggcggatggaagggaggagactcctgaccctcagaatggtaatgctgaaattttttgggtgcgctgttatggccttttctttgatcttacaatattgctttctcctgaaagaatattaaacataagttttaggaaacctttggacaattccaaacatatccaaaaatagaataactaccttagca

SEQ ID NO: 14619 - DNA, 59 bp, Homo sapiens
ctcttgttttccgagtgcgcggactcatcgggtcacagtttatgcttttatgacgcgga

SEQ ID NO: 14620 - DNA, 641 bp, Homo sapiens
  misc_feature 14: r=a or g
  misc_feature 16: r=a or g
  misc_feature 17: r=a or g
  misc_feature 33: r=a or g
  misc_feature 102: k=g or t
  misc_feature 146: s=g or c
  misc_feature 147: n=a, g, c or t
  misc_feature 225: m=a or c
ccaaatattacatrtrrtttcatgtaatttatrgacctattaaggcccaaccattttcttggataggggattctttagaagtccagcttaaataaagcccgkatagaaagtttttttaaaatttatacataatcacctaaagtaasnttatctactgaactcttagtacatgctaccggaaccttttatcatgtttcttcctggcttgcattacaacactgttgmcatatctcagccttacttctaggcttctttgagagcatcactcatgtttgtattcctcactgaggttgaatgaataagagaaactacagtagtaggaaaaaacagtacatgtacatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaa

SEQ ID NO: 14621 - DNA, 220 bp, Homo sapiens
  misc_feature 88: n=a, g, c or t
  misc_feature 89: n=a, g, c or t
  misc_feature 91: n=a, g, c or t
  misc_feature 93: y=c or t
caaggttgcagaagaagactgaagattgactgccaagctagtttgggtgaagttcactccagcaagtctcaggccacaatggggtggnntngyttggtttcctttaactttctttttgttatttgcttttctcctccacctgtgtggtatattttttaagcagaattttattttttaaaataaaaggttctttacaagatgataccttaattacactccc

SEQ ID NO: 14622 - DNA, 130 bp, Homo sapiens
  misc_feature 103: n=a, g, c or t
  misc_feature 105: s=g or c
tctccgcggccgtcagtctctccatttccccctcctggtctcgtcctccctcccgactccctagctctccctcccctcgctttcatcctcctatccccacctntscaacctcctctttcatccccctccc

SEQ ID NO: 14623 - DNA, 73 bp, Homo sapiens
agatccagttccggacgcggccgccgccgtcgccgccatctgtcacctccactccggcatcagcagccagccg

SEQ ID NO: 14624 - DNA, 228 bp, Homo sapiens
  misc_feature 115: k=g or t
  misc_feature 116: m=a or c
gcattttcgattccactctcttccgtttctgtcgctgcagtcgtccgcgggactccggccggttgccggccccaggcggtgcttctccccaccaccgcccagctcagctcagcckmgcccagcccactctgcccttagagggcccttctccccaaagacgcactccagaagtctcgccctcgtgcggctgaggagcctgggatcccagagctgaacaagtgaaacccc

SEQ ID NO: 14625 - DNA, 469 bp, Homo sapiens
  misc_feature 10: n=a, g, c or t
  misc_feature 32: n=a, g, c or t
  misc_feature 33: n=a, g, c or t
  misc_feature 34: w=a or t
  misc_feature 336: s=g or c
  misc_feature 346: n=a, g, c or t
  misc_feature 348: n=a, g, c or t
  misc_feature 423: s=g or c
ttgcgaaggngacgctttgcaggtgatcgggnnwgatttattcccacatgggagagaccagagcacagcacgtttgtgtacggccaggagggaaccacgaaaaaagcagaagatagaaacgcaagcacacgatggtggtggccaagaggagcctgcccctagtgacctcacttccgcggccagtgcgagaggcgagggagctccagctctgcctgtaagtctcggaagtacgaggcggaggggacgaaaaacggggggccagactgttgtggctgtggtggagacgagaaaccaggaagaagaggctcgcttcccactcggcgaccgtaagcgaasagccgaagangncgccgacatcagcagctgccccctaaaccccgcccttcgtcttggcggcagcgggagactgagagacgcgcgcasaggggcgggactggagaggggccccgcgcgcggatctcgcgagagc

SEQ ID NO: 14626 - DNA, 223 bp, Homo sapiens
  misc_feature 62: r=a or g
atttcactcggctcggtcctgaggagaaggactcagccgcggctgcgggacccgggcaccgraggcggtggcggcgccgtggccagcatggtgaaaccccgtttttactaaaaatacaaaaattagctgggcgtgatggcacatgcctgtaatcccagctactcaggaggctgaggcatgagaatcgcaacaagagcgaaattccatctcaaaaaaaaaaaaa

SEQ ID NO: 14627 - DNA, 190 bp, Homo sapiens
  misc_feature 21: s=g or c
  misc_feature 174: n=a, g, c or t
  misc_feature 179: s=g or c
  misc_feature 180: s=g or c
  misc_feature 181: s=g or c
agtgtggggaacgcggcggastgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggagnctagssstgggcagca

SEQ ID NO: 14628 - DNA, 51 bp, Homo sapiens
gctgtttggcgactcgtcgccattcccggagcaggtcggcctcggcccagg

SEQ ID NO: 14629 - DNA, 220 bp, Homo sapiens
  misc_feature 20: n=a, g, c or t
  misc_feature 86: n=a, g, c or t
gatctaaaacgagaagaganctcggggtctcatactgcgccattcggctgcggtacatctcggcactctagctgcagccgggagangccttgccgccaccgctgtcgcccaagcctccactgccgctgccacctcagcgccggcctctgcatccccagctccagctccgctctgcgccgctgctgccatcgccgctgccacctccgcagcccgggcctcc

SEQ ID NO: 14630 - DNA, 340 bp, Homo sapiens
  misc_feature 120: r=a or g
  misc_feature 190: s=g or c
  misc_feature 191: n=a, g, c or t
tttagtcagaaactaggatggagctaggtgctgtgactcacacatataatcacagcactttggaaggcccaagtgggacgatgacttgagttcaggagttgaagaccagcctacacaatrtgaaacccatctttacaaagaatacaaaaaattaggcaggcgcacgcctatagtcccaactgctcaggasncttaggtgggaggatgggctgagatgatcctcccactctcattcacttctgtcaggctagactctctctccttttcattggcttgtcttagctattaataagtctcggctgggcgcagtgggtcacacctgtaatccgagcactttgag

SEQ ID NO: 14631 - DNA, 190 bp, Homo sapiens
gagaatgagctcaagctgggtcagagagcagggctgactctgccagtgcctgcatcagcctcatcgctctcctaggctcctggcctgctggactctgggctgcaggtccttcttgaaaggctgtgagtagtgagacaaggagcaggagtgaggggtggcaggagagaagatagagattgagagagagagc

SEQ ID NO: 14632 - DNA, 312 bp, Homo sapiens
  misc_feature 20: s=g or c
  misc_feature 100: s=g or c
  misc_feature 101: n=a, g, c or t
  misc_feature 186: n=a, g, c or t
  misc_feature 187: n=a, g, c or t
  misc_feature 191: r=a or g
gtcacggcgtcggggtggasccggcggcaggggccaggcctctctaggctctccggctgagccgggttggggcccgggttgggccgcccggggactctgsngcattgggatttgtagcgcgccctctgggtaggcggctgtagcggagaggcgtgcgggatcgggatgtcggggctgctcacgganncggrgcagagagcgcaggagccgcggtaccccggcttcgtgctggggctggatgtgggcagttctgtgatccgctgccacgtctatgaccgggcggcgcgggtctgcggctccagcgtgcagaag

SEQ ID NO: 14633 - DNA, 102 bp, Homo sapiens
  misc_feature 49: w=a or t
  misc_feature 77: w=a or t
gcagcggggggcggactctgggcttttcttccccttctgattttccccwccccccttttctcccttccgggtttggwtccccccttttcttcccctctcacc

SEQ ID NO: 14634 - DNA, 222 bp, Homo sapiens
  misc_feature 12: y=c or t
  misc_feature 108: m=a or c
  misc_feature 136: y=c or t
gtctctaggggyttctcctcgcgccgctgtgttccagcgccggctccgagctgggagggtgactgagccctgagcttgggccctccgagaggtgcgttactctgggtmttcttgcccctacgcccgagcctggcgytctctcggccccctcttaggaacgctagccctgggcagaaattgcctttgtggctgaagtcggccagcgtcgcgtttccactctcc

SEQ ID NO: 14635 - DNA, 274 bp, Homo sapiens
  misc_feature 52: m=a or c
  misc_feature 132: n=a, g, c or t
  misc_feature 164: k=g or t
agaaacgctggcttagccgttggccgagttggcggctggacgaggacgctcmgagcccagctctcgagagttcaagcaaccgacggttccccactgctcccaggagcggtacctgggcactctgtgccctcntcctgttcgggcccaggccgaggacctgccaktagggctcagttgcctggagcccgttcagcccatcccccagttcactttgcctgtgggatctccccgttgctcctgccgtggactgagtggcaggccatcctacagcacc

SEQ ID NO: 14636 - DNA, 222 bp, Homo sapiens
cagatagggcatgtatatgacttataaatatataaatacgattttgtattaaaagttttgtagtttatggcaaaatctggtcctgtggtaggctaaataagtacagtccctgtgaaaggaatgtttgtggctcatgtcagtgtgtgaatgcatagacaatttgaagtttttgatatatttgtgatatttatcttgagcactgcaatctcacccccccccccc

SEQ ID NO: 14637 - DNA, 310 bp, Homo sapiens
  misc_feature 22: s=g or c
  misc_feature 72: n=a, g, c or t
  misc_feature 105: r=a or g
  misc_feature 144: n=a, g, c or t
  misc_feature 146: n=a, g, c or t
  misc_feature 186: n=a, g, c or t
  misc_feature 232: k=g or t
  misc_feature 247: r=a or g
  misc_feature 248: m=a or c
aagtcctggcccactgcgccasgctgagcctgccagggctggggctggggatcaccttgggatgatggtgtngtcccagggggcaggagatcgagtgtcctctgragcctggcgactgggcctgtagaagggaaccggcatttntngagtgtctactgagtgccaaggtctgcgctgggcactgtnctcgcaccgcctcacctagtcctcacgtagccctcgggcaagtgakgatccgccgggactrmggctgggagggatggctgtggctgtcccccagcccacacagtaggcgctcagtgtcagggtg

SEQ ID NO: 14638 - DNA, 472 bp, Homo sapiens
  misc_feature 122: m=a or c
  misc_feature 123: m=a or c
  misc_feature 146: n=a, g, c or t
  misc_feature 379: w=a or t
  misc_feature 435: r=a or g
  misc_feature 437: w=a or t
  misc_feature 461: n=a, g, c or t
gctttcgccgcctgggagccgtccggcgcagagtttctaggtccccactgtccccgccgtcccgccccttcgcgtcccgggaaccggctggcttccgagccgcactcgccgatcctccaggmmtgccccgcgaccgagctggcttnaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagccgttgaaaagcatggtggagcacttgtctcgagawatagatgtgattagagggaatattgtcaaacaccctctgacccaggaactaaaagrawtgtgaaagggattgtcccagtccnactcgcagagg

SEQ ID NO: 14639 - DNA, 134 bp, Homo sapiens
attgtgttggattttgccattttatacttagcaccatgaggccaatggtaaatcacacttgctgggtgggagatcacctccctgagatggcacgttcacctgctttttcttctatcattgcttcttactggatg

SEQ ID NO: 14640 - DNA, 224 bp, Homo sapiens
tttttagactttgcaggccacacacggtctctgtcatatatttttctggttttttgttttgttttgttttgtttttgctatcttgtttgttttgtcttatttttaaccctttaaaatgggaaagccatacttagttctgggggcatacaaaaacatgctacaggcagagggcagaatttagcctgcaggctggccaaaatttgccaacccctgccctagctctc

SEQ ID NO: 14641 - DNA, 198 bp, Homo sapiens
cataaccttttaattctatttttcatttgagctgacttgtagccacttcagactatcaatggaatcttatgttgagcctttctctggctttccttcctccactatctctccaactttagagatcatcccctctccctccagtgcgttctatctcccccacacccaccctagatactcccttttcacccacctttcctc

SEQ ID NO: 14642 - DNA, 140 bp, Homo sapiens
cccttcccccgctctgccccagctgcaggacttgccctgtgtcctgatcatgagcccaaaatttcccgtcaaatcacccccagtgggatcctgttatttccaactccaaaaagtctttctttcttttttttttttttttt

SEQ ID NO: 14643 - DNA, 158 bp, Homo sapiens
  misc_feature 90: w=a or t
gacttgggagcgcgcgctgcccctcacttggctgcaactggacccagaactagggaagaggccagggacagattttttttttttattttwattttttttgccgagggacgtttcaaaattttgcacggccagggtgacaaaaagaggatttaagagcc

SEQ ID NO: 14644 - DNA, 183 bp, Homo sapiens
  misc_feature 117: n=a, g, c or t
catgtcttggcagtcttatttaaacatgaagtgaaagttagattttttaagttgtcatttgtttttagggtgtgagagaatatttaagtgatactctttttatcctccacataaganaataggactagagaaacctatggcttcctcacttgttggtggcctagcagccctggcacacagagc

SEQ ID NO: 14645 - DNA, 127 bp, Homo sapiens
  misc_feature 33: n=a, g, c or t
tcatatttcatctgcacattcctctgttcccanctgtgctggtgtttcatcttcttctccagctttgtctgccactttcctctcttcagcctgttggctcccatttctgccatagtcttgtagttca

SEQ ID NO: 14646 - DNA, 149 bp, Homo sapiens
  misc_feature 149: n=a, g, c or t
agtttgcccggcaccggaggagggtcgggcggcatcttccgggtactggggctctgcggacggagaagaggttccagcggggaatggtatatctggattcaagaagccgcggctcggcgccagatcctggagtgtagatatttgggaan

SEQ ID NO: 14647 - DNA, 245 bp, Homo sapiens
tgccattctatatttagcttctgggaggggagcttgttcctgggaatagaatcaccactcattccttttctctttagttttttaggtggtggcggcagtcggatagacaataccacaacaacacattttgcagagcttaggggccatttggatcacacgatgttttttcaagattttagaccctttctaagtagcagtccactggaccaagataatagagccaatgaaaggggtcaccagactca

SEQ ID NO: 14648 - DNA, 72 bp, Homo sapiens
agagaatacttggagggagttatgaagctttcctcaatactttgattattatgtttctttttattcttcctg

SEQ ID NO: 14649 - DNA, 78 bp, Homo sapiens
gcgagtgagtagtgtcgctcctggttctgccagctcccctgagagcctgaacccgggcttgagagcctcgccaccccg

SEQ ID NO: 14650 - DNA, 411 bp, Homo sapiens
  misc_feature 258: s=g or c
  misc_feature 392: k=g or t
acatcccaaacatttctgataatggaagcattttctctctaaaggggatgggattattggattggcaatttctcttaatctgagaaaactcatctcccactcccttccccatatcccctttccatcctctctcttccccttatacacacacgcacccgcatgcacacacgtatattctgaccattttattagagtggaaagttgaaaggaagcaacccgccagctacacccacccagcgctcctgggggtggaatagsaaagttctagggcagagccttccctcccagagcccggcgatgcagtcgctctcggatacctgctcagctccgcaccgcaactgaagatctgccgccgcggaacagttgcgtctccatctggctaccaacccackcaagctttcttctccaccc

SEQ ID NO: 14651 - DNA, 112 bp, Homo sapiens
  misc_feature 65: r=a or g
actccttccctgtctctgcctctccctcccctcaggcatcagagcggagacttcagggagaccaragcccagcttgccaggcactgagctagaagccctgccatggcacccc

SEQ ID NO: 14652 - DNA, 94 bp, Homo sapiens
actccttccctgtctctgcctctccctcccctcaggcatcagagcggagacttcagggagaccaaagcccagtgcgccctttttttttgttttt

SEQ ID NO: 14653 - DNA, 113 bp, Homo sapiens
  misc_feature 25: r=a or g
  misc_feature 47: s=g or c
gttttagggagggagagcggcctgrgtcctgggtgttgtgtgcggastgtggcgtcgcgtgtgaggcgcgtgcagggtgagtgtgagtggacgcgtgagtgtgtgagtgtgcg

SEQ ID NO: 14654 - DNA, 126 bp, Homo sapiens
  misc_feature 122: r=a or g
gaggaagagataaataatagaaagttgggtatatggttctagagctcaggagaggctgctgctggagatacttggatagagaatacttgaagctttgagtgagcgtggcacctggggcaaarggtt

SEQ ID NO: 14655 - DNA, 69 bp, Homo sapiens
  misc_feature 12: s=g or c
  misc_feature 20: s=g or c
actcgctccgasccctgctsccgggagagggagctctcgggtcggggctagggaaggctgaccccgctc

SEQ ID NO: 14656 - DNA, 81 bp, Homo sapiens
  misc_feature 56: r=a or g
atcagagggccaactgcactttgtttattcaaatattaaatgggaaatctattaaraatcaatctttcctaaattaaactg

SEQ ID NO: 14657 - DNA, 660 bp, Homo sapiens
  misc_feature 12: y=c or t
  misc_feature 438: r=a or g
atttcttccacyaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcagaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaaracttgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctct

SEQ ID NO: 14658 - DNA, 230 bp, Homo sapiens
  misc_feature 138: w=a or t
aagagggtaactcagatcaggcttagaaatcacttgacttaactcagcagcactttttcttttctttgtgtctgtattattttagcagccttctctaaatactggaggcattggatttcatgtcgccaaaaggaattwaaaaatgacaaaagtgtaatctgttagaaatagttaatttgtagaattttactctataaggaggtttagtttcaatttgttttgaaatgaag

SEQ ID NO: 14659 - DNA, 251 bp, Homo sapiens
aacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctgga

SEQ ID NO: 14660 - DNA, 341 bp, Homo sapiens
ttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgaccaa

SEQ ID NO: 14661 - DNA, 468 bp, Homo sapiens
  misc_feature 214: y=c or t
  misc_feature 215: s=g or c
  misc_feature 344: w=a or t
  misc_feature 349: r=a or g
  misc_feature 366: y=c or t
  misc_feature 375: r=a or g
  misc_feature 389: s=g or c
  misc_feature 392: k=g or t
  misc_feature 415: r=a or g
tgatcggcagggagagcacatgtgttttcatgaagaattatgctgaagtaggtaacgggtggagaagaaatttgagctttggagggggatacccaatatctcttggagaataaatgttgaaggagctggagtgtgtcttgttgagaagattcaaaggaggggctacaaagtagaaggtcatcaatatattgaataaggtgagaagcacatgggysgaaataaattaaatcatgagaaagagcttggctgaagtaatgagggctgtccctgaagccttgcagcagtacagcccaggtaagttgctgagactgatgggtgtcagggttagtccaagtgaaagcgawgagargctgggatgaagggtgyaaaggaatrgtaaagaaagcatsttkgagatccagaacagaataatggrttgtggagggaggtattgaggataggagagtatatgggtttggcactatagga

SEQ ID NO: 14662 - DNA, 345 bp, Homo sapiens
  misc_feature 109: y=c or t
  misc_feature 114: r=a or g
  misc_feature 118: r=a or g
  misc_feature 137: r=a or g
  misc_feature 142: k=g or t
  misc_feature 146: y=c or t
  misc_feature 214: r=a or g
  misc_feature 216: r=a or g
  misc_feature 221: r=a or g
  misc_feature 235: s=g or c
  misc_feature 237: s=g or c
  misc_feature 242: m=a or c
  misc_feature 243: r=a or g
  misc_feature 245: r=a or g
  misc_feature 249: y=c or t
  misc_feature 277: r=a or g
  misc_feature 289: y=c or t
aacagggaatctgccccgatattcacgtaggttcttttctattttccttaagcgttggccagcttgagaaataaagggacagagtacaaaagagagaaattttaaagcygggcrtccrggggagacatcacatgtcrgtagkttcygtgatgccccacaagccacaaaaaccagcaagtttttattagggattttcaaaaggggagggagtgtrcraatarggtgtgggtcacasasatcamrtrcttyacaaggtaatagaatatcacaaggcaartggaggcagggygagatcacaggaccacaggactggggcaaaattaaaattgctaatgaagtttcagg

SEQ ID NO: 14663 - DNA, 90 bp, Homo sapiens
  misc_feature 73: s=g or c
gatggatgagatgctggtgtgtggatggatgagatgctggtgtgtggatgaggtgctgtgtgggatggatgasgtgctggtgtgtggatg

SEQ ID NO: 14664 - DNA, 528 bp, Homo sapiens
  misc_feature 54: n=a, g, c or t
  misc_feature 253: y=c or t
  misc_feature 369: w=a or t
  misc_feature 416: s=g or c
  misc_feature 436: s=g or c
  misc_feature 437: r=a or g
  misc_feature 438: k=g or t
  misc_feature 478: s=g or c
  misc_feature 485: n=a, g, c or t
accattcggaagaggcggagtcttcttccgaggaccattcggaagaaggcgganctacctctcatcaggaccagtctgactgcacctgcatccttagctcagagcatccccggagcatcttaagagctgagcgcagtgacaactaggggccggaccgtcgcaggaggcgtccgctggataccttcccccttccctgacctagagctctacagctgctgcctcggtactgaccgagggttcccagagctgtctyaccattgcaaaaacgttatagcaacagcctctgattacgacatggctgagatcaccaatatccgacctagctttgaagtgcatcagcagaggggagctccaggtgtctctgtcatwtcagcctgtggcacagagaatgacagtggtggtcctcaaagccagasacttgccgaagatggatatsrkcggtctctcaggtaatccttatgtcaaggtgaacgtctastacgggngaaagcgcattgccaagaagaaaacccatgtgaagaagtgcac

SEQ ID NO: 14665 - DNA, 125 bp, Homo sapiens
cgtgacttttcgtgcctggcttctttcactaggcatattttcaagcttcatccacattggagagctcatgtcagtgttggtctctgttttgcagatggggaaggtattaatgatcaggagcaggc

SEQ ID NO: 14666 - DNA, 122 bp, Homo sapiens
tagatgttcagatgtatctcaaactcagttttatttttattccaaatattgtgaatgagaagccattgtcctaaactttggccattttgtgctataaacatgcatttttaagttataaggtg

SEQ ID NO: 14667 - DNA, 360 bp, Homo sapiens
  misc_feature 341: n=a, g, c or t
gagaataaatggtaatggagagaactatttaacaaggtcctggtttctcttgcaacacagtagctaaacttgcctgcttttatatgcatttttgtagggatcagcttggtagacagtattagcggagtaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagtgggcttttaaagagtattgaagattganagggtttttctttcttttt

SEQ ID NO: 14668 - DNA, 256 bp, Homo sapiens
  misc_feature 10: m=a or c
  misc_feature 12: m=a or c
attttcagamamcaatacagaaaggtcctttattgtgtggtgataatacagaagaattacagagcattccttctgaggaggagatttttgcacctgaaaaaggcagccatagtttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagaga

SEQ ID NO: 14669 - DNA, 78 bp, Homo sapiens
  misc_feature 13: s=g or c
ccttccgcgcgastctccgcggctccctagcccagcagccctcgcccagcagcccgcgccgccaccgcctcttccctc

SEQ ID NO: 14670 - DNA, 128 bp, Homo sapiens
ccaaatgcgaacttaggctgttacacaactgctggggtctgttctcgccgcccgcccggcagtcaggcagcgtcgccgccgtggtagcagcctcagccgtttctggagtctcgggcccacagtcaccg

SEQ ID NO: 14671 - DNA, 226 bp, Homo sapiens
  misc_feature 35: m=a or c
  misc_feature 140: m=a or c
  misc_feature 199: r=a or g
catgtagcaggattccatttatgtaacattggtgmaataatgtaattatagagatggaaaacagattaaaggttaccaggggtttaggttagggatggtgagggggtggttcatacgagggagtcctgtggtgttgaaamcatctgtcagcctgactggtggttacacagggctatacatgaaagttaaaattgtgtaragttaggtacacaaaggagtacagatg

SEQ ID NO: 14672 - DNA, 202 bp, Homo sapiens
ttttatgcttcattgcttagcccagtctcatacataatgtgtgttcaatatacatctgaaaaatggatcaacaaataaatgaatgtttggttccttgatatcccagccagggtagccccagaaaatgaaagttatacaataggaaagtgagagtgagacattgtttctcaaaagttttaaacactggactcccttttttttt

SEQ ID NO: 14673 - DNA, 258 bp, Homo sapiens
  misc_feature 191: r=a or g
  misc_feature 201: w=a or t
cttttcagcttggtctttccgggcctcgcttcccccagcccctgcgcccggcccgaacgagaggttccggagccccggcgcgggcgggttctggggtgtagacgctgctggccagccctccccagccgaggttctcggcaccgccttgagagcttcagctgccccagggtgtgcagattagaatcccaagraaaatccaawtggccatccggggatttctgctcacctggagaagggatggaaatacttcaacaagtg

SEQ ID NO: 14674 - DNA, 102 bp, Homo sapiens
attcgccagccgcctcgctcccggaccccacggctgcaaactgatctggcgcgcggggaggaggagagcgcaggcgagcgaacccgcgagagagggagagag

SEQ ID NO: 14675 - DNA, 175 bp, Homo sapiens
  misc_feature 37: y=c or t
  misc_feature 67: r=a or g
  misc_feature 131: r=a or g
  misc_feature 132: s=g or c
agtcggcctgtcagccggcttcgagataagtcccggygcttgcgcggcggcggctatggcggcggargaggaggaggtggactctgccgacaccggagagaggtcaggatggctaactggttggctccccrsatggtgccctacgtctatatcacaccttaaagaagctgaagag

SEQ ID NO: 14676 - DNA, 216 bp, Homo sapiens
  misc_feature 164: n=a, g, c or t
gagagccgccgcccgcgaggaatgctggtgaggaagccgtcgggagccgccgccgccatctgagggaggtaccctggaaaccaccttttatcggtggggaagtgcagtcgcggtgggcggctctcgacggctccctccccagccttccccgcgagcggacgcgncagccctctgtctcgctttttcttatttttcccccctttcccctttcttttt

SEQ ID NO: 14677 - DNA, 352 bp, Homo sapiens
  misc_feature 299: k=g or t
aaaatgagtccacggaccttcggcttttcttagccacgagaaaacgtcctccctccttccatcctagtgccaacgacttccccagcccgtctcctttcggccgcacttctctgtactttcgttggaccgggaaggcggcggggaggaacaggaagggtgaaagaccaagtccgcgtagtttacaaggagtgggcgagtctaggaatcggtccgcgagggcggagcgaggaagccggcacttcttcctcccttcccctctcttcccctccctccccagccttccccgcgagcggacgcgkcagcgcctctgtctcgctttttcttatttttcccccctttcccctttcttttt

SEQ ID NO: 14678 - DNA, 286 bp, Homo sapiens
  misc_feature 44: r=a or g
  misc_feature 81: r=a or g
  misc_feature 82: w=a or t
gcgaggtgggcggtgggtgggcagggcgaagactgaagcgagargggcagcgcgaggtgggcgactaccagagcgaacgtrwcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaa

SEQ ID NO: 14679 - DNA, 485 bp, Homo sapiens
  misc_feature 155: y=c or t
gaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcayacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattctcaggttccagtcctttggatcaagttgatcttctttacccagtgaactatatttgaaaaagtgaacagaaattcccacttgtggtt

SEQ ID NO: 14680 - DNA, 136 bp, Homo sapiens
  misc_feature 46: s=g or c
aactaggagcggctctcggtgcagcgggacagggcgaagggcctgsgcccacagagcgcgcgacactgcccggaaggaccgccacccttgccccctcagctgcccactcgtgatttccagcggcctccgcgcgcgc

SEQ ID NO: 14681 - DNA, 105 bp, Homo sapiens
  misc_feature 18: r=a or g
  misc_feature 20: r=a or g
tttgttttgtttttgtgrgrgggacgtgtctcctaaatgaatgtttgctccagcgttgcacctcaaataagtcacctaaatatccacgccctctttatccaccca

SEQ ID NO: 14682 - DNA, 120 bp, Homo sapiens
agccctgcctgccgcacctctcctttcttctgtagctcgcgttgaagccgcacgtccggccccgatcccggcaccatgagcttcggctcggagcactacctgtgctcctcctcctcctac

SEQ ID NO: 14683 - DNA, 80 bp, Homo sapiens
  misc_feature 15: s=g or c
tggctcctgcgaggscttggtttagggcttcagctctctgcgttctcggctccgggaggcctcggtgattcagccacagc

SEQ ID NO: 14684 - DNA, 251 bp, Homo sapiens
tctcagctctgctccttccttttctgttctgtgggcaccacccagttaacccactgcacccccatgcctggcttggcataatcactgccctccctgtctccagtcaacccaggccagggtaaggaagcagaaaggccagtccccaactcacagttgcatcctatgaccacacttggatcctgctcccgctgtgccagggcaccctgggagccatgtgtctcattcagagcctcgacctcttgctctgcacc

SEQ ID NO: 14685 - DNA, 207 bp, Homo sapiens
  misc_feature 17: r=a or g
  misc_feature 18: m=a or c
  misc_feature 188: k=g or t
acccgctccctccctcrmaccttctattcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgtkataaacaaccacttaaacc

SEQ ID NO: 14686 - DNA, 165 bp, Homo sapiens
  misc_feature 20: s=g or c
agtgcggagcttaggcggasgaagagaaccggtcgcggcaatcctagcgcgcagagcagcagcagcagcagcagcagcagcagcagcagcacccgcatccgctgcgggagtccgagccggaaccacacccaagtagctgccctttcctcttctgtcatctcaccg

SEQ ID NO: 14687 - DNA, 146 bp, Homo sapiens
  misc_feature 32: k=g or t
tagttgagacttgaaaaaataagcatcttatkttgtgtgctcaggagctgtctgacaaaatcctaagcctgactgagatcatagtccaccctgactttgtctaaaaatgttgctgactgggcatggtggctcacgtctgagatcct

SEQ ID NO: 14688 - DNA, 441 bp, Homo sapiens
  misc_feature 404: w=a or t
  misc_feature 413: n=a, g, c or t
ccaaggccatggtgagatctgagctgtggtcctaagagccatgagagagtgttgaagggttttaaacagggaggggtgtgatactgtgacactgtttgtcatccttgaagagaggggggtctgatggctcacacctgtcatctcagcactttgggaagctgaggcaggcagatcacaaggtcaggagatagagaccatcctggccaacatggtgaaaccctgtctctactaaaaatacaaaaattagccaggtgtggtggcgggcacctgtaatcccagctactcaggaggctgaggcaggaaaactgcttgaaccctggaggtggaggttgcagtgaaccaagatcacatcattgcacaccagcctgggtgactttgtctcaaaaaaagaaaaagaaaagaawagaaaaganaaatattagtgaggacaaaaatgtccac

SEQ ID NO: 14689 - DNA, 113 bp, Homo sapiens
agctgtttgtctgttcgacacaggcttggggccgacgggggagacggagccccaggagtgttgaagcctggaaatcccctccccttccccctcccccctttacagtatccccc

SEQ ID NO: 14690 - DNA, 162 bp, Homo sapiens
aggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgacca

SEQ ID NO: 14691 - DNA, 148 bp, Homo sapiens
aggagagggacggtttggtaggaaggaaacacacactctcaagacagaacaaatatgttttattatagttaatccctgcatttccccttttgagacagggtctcactctgtcactgaggctggaatgctaaggggtgatcatagctcc

SEQ ID NO: 14692 - DNA, 180 bp, Homo sapiens
gtttttccgggcgagtctgttcggcttatggcgtctgctaggagtctcctatccggcgtttgtgccgcagaaaacctttaacctgcgttttacccgtaaacattttcctttttaggcttcctatcattgttttggttcttgctcctgtattaactttgtttttggttttttctttttttt

SEQ ID NO: 14693 - DNA, 113 bp, Homo sapiens
ctaggatccagtcccgaatcgcatattgcatttagttgtcttatctccttagtctcttctaatctgtgattgttcctaagtcttctctttcattgctatgacacttttttttt

SEQ ID NO: 14694 - DNA, 172 bp, Homo sapiens
  misc_feature 118: y=c or t
  misc_feature 119: s=g or c
  misc_feature 159: s=g or c
ctgttgggaatcttgggaaggaatttgtgagtaatgccaggcagcctagcttttagggtgaatgactggttctgacttatgtcaatacatccttgagtcatgccaagaactgtgggaysatcaaggaccacggaccagtgtcctggaagcatcgatggstccaagctgctgg

SEQ ID NO: 14695 - DNA, 293 bp, Homo sapiens
  misc_feature 128: m=a or c
  misc_feature 129: r=a or g
  misc_feature 237: r=a or g
gaagagaaagcgtgagggctgggcctgcggcgggctttagggagtggtccctggctgtggatagatctgctgatgagtccaggccccggtccattctcctcgcgctgcaaggatgctcctgggatttmrgagaggccgcaggagatcatttcaaacagggtctcgctctgtcgcccaggctagagtgcagtggtgcgatcatagctcactgcatcctcgaactcctgggctcaagcratcttcccaccccagcctcccgaggagctgagactacaggcgcgcgccactactcc

SEQ ID NO: 14696 - DNA, 95 bp, Homo sapiens
ctattttattgtaggcctccttcatgtctaaatgacacttgggaacagctgaaaagacaaaaagaacaaattaaacaaacgctgcaccaccacca

SEQ ID NO: 14697 - DNA, 344 bp, Homo sapiens
  misc_feature 21: s=g or c
  misc_feature 298: m=a or c
agtctgaagagaggcgggacsggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggatamcggaaaccccacggaggtgcagatgagcccagctggtgctgcccat

SEQ ID NO: 14698 - DNA, 244 bp, Homo sapiens
  misc_feature 114: y=c or t
  misc_feature 115: n=a, g, c or t
  misc_feature 240: n=a, g, c or t
tcttttcgatccgggacggccggtcaggctcgccgccgagctggagaactacgatgacccgcacaaaacccctgcctccccagttgtccacatcaggggcctgattgacggtgyngtggaagcagaccttgtggaggccttgcaggagtttggacccatcagctatgtggtggtaatgcctaaaaagagacaagcactggtggagtttgaagatgtgttgggggcttgcaacgcagtganacca

SEQ ID NO: 14699 - DNA, 326 bp, Homo sapiens
  misc_feature 12: s=g or c
  misc_feature 150: n=a, g, c or t
  misc_feature 168: m=a or c
  misc_feature 186: s=g or c
  misc_feature 297: n=a, g, c or t
  misc_feature 298: n=a, g, c or t
gcagggatccgsaaacacctgatcatctataggtttagtgcctaatgggtgttgttcctggctggacttgatgtccagggcctgaggggttttctcgccgagtctcctggggcggtccggaggctcgtgccctgttgtggggcccccatntgccgccgccatgcccamgggccggccgcccccatsatcagctcggtccagaagctggttctgtatgagactagagctagatactttctagttgggagcaataatgcagaaacgaaatatcgtgtcttgaagattgatagaacaganncaaaagatttggtcataattgatgacag

SEQ ID NO: 14700 - DNA, 205 bp, Homo sapiens
  misc_feature 10: r=a or g
  misc_feature 60: s=g or c
aatttcagcraggctctgttcagttgttcttatctacatcctagaatcgggggtttcagstcactgctccttttcttttttttctttctctcccccgcccacccgtgcgtcgtaggtagggacacccgccgggggtgatgggtgcagggagggggtcgcatcagacctcggccaccgcgcctcctcccctcctcccgcccacgcc

SEQ ID NO: 14701 - DNA, 123 bp, Homo sapiens
  misc_feature 21: n=a, g, c or t
  misc_feature 36: y=c or t
  misc_feature 37: n=a, g, c or t
ggagaaggctgtcgttgcctnggccgtcgcatcccynagggagtcgtgtcggcgccaccccggccccccgagcccgcagattgcccaccgaagctcgtgtgtgcacccccgatcccgccagcc

SEQ ID NO: 14702 - DNA, 653 bp, Homo sapiens
  misc_feature 254: w=a or t
catcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgwtttgcactgctaactatgatgagggtttaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttag

SEQ ID NO: 14703 - DNA, 660 bp, Homo sapiens
cggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgg

SEQ ID NO: 14704 - DNA, 326 bp, Homo sapiens
atgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtag

SEQ ID NO: 14705 - DNA, 312 bp, Homo sapiens
tctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaacc

SEQ ID NO: 14706 - DNA, 126 bp, Homo sapiens
agtctagtttgttaattgtgttcatatttgtatacatttgttgatattttatgtgcttctgttagttactaagacattttgttttcatttattactgaaggggggcatctttttacatctttctgt

SEQ ID NO: 14707 - DNA, 171 bp, Homo sapiens
  misc_feature 41: k=g or t
gtcagtctggccggctccgtcctcccgtagctccgctgtakctagcaatgtgacaccaggacgcactcgctctcgcgcgctctcccaggctcgttctccctcgccctctctctctcacacacgcacgcacacacccacctctcccataaacacacacacacacatgcacac

SEQ ID NO: 14708 - DNA, 366 bp, Homo sapiens
  misc_feature 19: y=c or t
  misc_feature 35: w=a or t
  misc_feature 73: r=a or g
  misc_feature 74: s=g or c
  misc_feature 238: r=a or g
  misc_feature 239: w=a or t
  misc_feature 282: r=a or g
  misc_feature 306: k=g or t
  misc_feature 308: m=a or c
  misc_feature 309: r=a or g
  misc_feature 335: w=a or t
acggaagctgagactgcayttcctgcgaggccccwgcagcagcagcggcgtggtcagagcgagcttcggagarsagtggtgggttccatgtgatggtggagtaggaggcaggtctccgcggtttcttcatgtggctgcagatggcaggatttcccaaaggtttctggctgaaacatattccgtggtgtatctgtacagcagtttccttatccctgcagctgtgtttgaacaggaaagrwaaaagaagaaaaaaaacctccatacgagagtgggtctaaaggracttcccaaacctccatgattttkcmrgaaacaagataaagctggttggtggwgaatttgaactggagatgaactctattatcc

SEQ ID NO: 14709 - DNA, 163 bp, Homo sapiens
ttctaatagttgggctcagtgttcatatatgttctgcccttgtctctaagcaggtggaaaaggaactcctctgggaaccccagcaacctctcctcctccagccccactctgtcattcggatgactacgtgcacatttcactcccccaggccacagtcacaccc

SEQ ID NO: 14710 - DNA, 227 bp, Homo sapiens
atcctgaggtaggcaatgcaggcattaatattcccattttactcatgaagaaacagagctgttaaatgccttggctcaagtgacatagccgctgagagaagtggaaaacaataagccaggtctcctgatacctaatttggtgttattagtcacctctgtattgtattaatatttatattaatattcattttaaggaaaaactacaaatatgactcctaaacacctcc

SEQ ID NO: 14711 - DNA, 102 bp, Homo sapiens
gctttttggctgttgttaataatgctactgtgaacttgggtttgcaagtatctcttcaagactccaaggcccttcttgatattacccccaaacaaatgcctg

SEQ ID NO: 14712 - DNA, 74 bp, Homo sapiens
cagtctgaggcaggtgcccgacatggcgagtgtagtgctgccgagcggatcccagtgtgcggcggcagcggcag

SEQ ID NO: 14713 - DNA, 154 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttgga

SEQ ID NO: 14714 - DNA, 275 bp, Homo sapiens
  misc_feature 196: n=a, g, c or t
tggatctgcttctggtgatggccccagtaaacttccagttgatcacagtggaaggcaaagggggagcaggctgtgtcacatggcaagagtgggagtgagagtggggaggggccacgtacttctaaacaaccagaacaagatccctgggtgagcacccaggaaatggtgctaaaccactcatgaggcatccaccccnatgatccagtcacctcccaccaggccctacctccaacactaaccaatttcaacatgagatttggaggggacagacatcc

SEQ ID NO: 14715 - DNA, 185 bp, Homo sapiens
caaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccg

SEQ ID NO: 14716 - DNA, 156 bp, Homo sapiens
ttgaaatgtgtgtgttggttcactcagcctttccatttatctatgtattgaaatgtgtgtgttggttcattgtgccatggcatctgtctatttattgaaatgagtatgttggttttctggacctgggtatctgtctatttattgaaatgtgtgggg

SEQ ID NO: 14717 - DNA, 211 bp, Homo sapiens
tttgtttgtatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccg

SEQ ID NO: 14718 - DNA, 196 bp, Homo sapiens
gttcattcttttgctgagtagtattattgtttggatgtgctacagtttgttattcattcacttgttgagggatatcttggctattttcagaatctgtgattatgagtaaacctactataaacttggttagatgcctaggagtgggattggtaaatgtacgtttaacttttaaagaaactgtcaaacagttttccga

SEQ ID NO: 14719 - DNA, 261 bp, Homo sapiens
  misc_feature 254: r=a or g
ctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctrccccgcc

SEQ ID NO: 14720 - DNA, 109 bp, Homo sapiens
  misc_feature 47: s=g or c
atttttccacccagcaggatgggtgatgctgagagctgcctgctcasacaacagacacgcgaggtcaggaagaagccgcttataaattaccgcttccttcgcgccgccg

SEQ ID NO: 14721 - DNA, 444 bp, Homo sapiens
  misc_feature 314: r=a or g
tgctgagcataaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggrcatggctgtcttctaaaaagccacgacatgaaaatgacaatccctttcgtctccttcctccgctgcttccacctaacgcagcctcctgcctccgcctttgtttcatagtgaggattttattttgcacggc

SEQ ID NO: 14722 - DNA, 501 bp, Homo sapiens
  misc_feature 183: n=a, g, c or t
  misc_feature 330: m=a or c
  misc_feature 449: r=a or g
agatggatgattgcttttaactactgccagctgatgtctctcagcccctgccctcatacaagatttttctcagccttcagcctaccactgcagaatccgatgtgacccaccattagggagtctgcatcttggaagagttggaaataaccctttaacatcaacatgcttcaaagactttttgcntttggcctagtaagatgcctctccagctactgaggcccacaagtaacatgagcggataaaaagagacttgtttgtgctagaaatgagggtctatgctatgagggggtccaagactctggcgaaatgtgctttttcatcaatggagamatgaaagggaaacacaagcaagaaaaaagttaacttgtattatgtatttttactacacttttcttaaaaatagagcattgggaaaactctgaaagagactgacatttttctcaacaggratccatacttaacagttctggctttcattaaattttgctctttggtacctgg

SEQ ID NO: 14723 - DNA, 188 bp, Homo sapiens
  misc_feature 163: y=c or t
tacatctttctttttaagaaaatctttatatgtacctccttctgtcgagtgtccttactttcaatgaacttttttgagatataatttatatacagtaaaatgtacctattttaagtttacaattcagcggatgttgacaaatgtacaacccccagtatctgtyaccccagtcattatattgatcctcc

SEQ ID NO: 14724 - DNA, 112 bp, Homo sapiens
aaatctattaggaactggaaaacagcaagtatggttgattctcattattcaaggtagttacgttctataaagtcactgcgaacactgaattagcaaatatagaacctagggg

SEQ ID NO: 14725 - DNA, 144 bp, Homo sapiens
caatagagaagagcaaatgtagtttaaaaattacaaaatctaaaggaaaccaagaaagaagagagaacaaagagacaaatatagaaaatgcctattattttagaagcataaactcaaatcagaataacattaaatgaaaaagga

SEQ ID NO: 14726 - DNA, 149 bp, Homo sapiens
attccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagccggagcgag

SEQ ID NO: 14727 - DNA, 186 bp, Homo sapiens
cggtccaaatatccacttgcagattctactaaaagagtgtgtcaaaactgctctatgataaagtatcttcaactctgtgagttgaatgcaaacatcacaaagaagtttctgagaatgattctgtctatattttatgtgaggatatttcctttttgaccataggtctcaaagctctcctaatgtcca

SEQ ID NO: 14728 - DNA, 176 bp, Homo sapiens
tgtctttctatttcccaccatctgtaagcaactgggctggcatgtagtagatggggtctcactcagtctgtcccccaggctggagtgcaatggcatggtcacagctcactgcagcctcaaactcctgagctcaagtgattctcctgactcagtctcccaagtagctagaaatacag

SEQ ID NO: 14729 - DNA, 245 bp, Homo sapiens
tgcatgatttataatcctttgggtatatacccagtaatggggtggctgggttgaatggtatttctatttctatatccttgaggaattgccagactgtctttcacaatggttgaactagtttacagtcccaccaacaggtaaaagtgttcccatttctccacatcctctccagcacctgttgtttcctgactttttaatgataaccattcaaactgttgtgccatctcctgatttctttatcatcc

SEQ ID NO: 14730 - DNA, 191 bp, Homo sapiens
  misc_feature 125: w=a or t
  misc_feature 130: w=a or t
  misc_feature 152: y=c or t
atttgtttgattctctctggctagtaggagctccatgggcagtgactgaagcattttgtttgttttttaaatgtattttccttgacaaataataataatatattttttaagttttcatttttttwttttwaatttagagacagggttttgcyctgttgcccaggctggagtgcagtggctattcataggcg

SEQ ID NO: 14731 - DNA, 298 bp, Homo sapiens
ttggtctttaaaaagtatttacaagtacataaatttgctttatttttaaaaatacaaaaaggaaaaatttaaattttttttgatgtaattaaaatgttaactatgtggtcagataatccccattttacaatagtaacagaaaattgtaattcttagttctaaaattcagaaattaaactcataagttttgttgcattttgttttttcttttccatttttaaaactaatgtgatgtctttagtggcaatagaaggtacttctatgctaaatacaaaactaaaaaggcaaaataatgaac

SEQ ID NO: 14732 - DNA, 176 bp, Homo sapiens
  misc_feature 7: n=a, g, c or t
  misc_feature 8: w=a or t
  misc_feature 20: n=a, g, c or t
  misc_feature 27: n=a, g, c or t
agagagnwaaagtaaaagancgaagantgaggctggagagaccaggatccttccagctgaacaaagtcagccacaaagcagactagccagccggctacaattggagtcagagtcccaaagacatggccttgaaagccatcccctgggtacaggtctttgtcttgaaagaaagcaac

SEQ ID NO: 14733 - DNA, 230 bp, Homo sapiens
aaagcccttttcattgcaggagaagaggacaaagatactcagagagaaaaagtaaaagaccgaagaaggaggctggagagaccaggatccttccagctgaacaaagtcagcgacgtctcatactggaaaacatcactgcagctgcagcaggccggcatggtgacagcctccctccctgcgcggactggaccagagctctactcttcctgacagggccacagcaagccccc

SEQ ID NO: 14734 - DNA, 339 bp, Homo sapiens
aaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttgacccaatatcattgaggcaaacagtttgggctgtttttccagtagtatgacagtgacggtgtgtcaaccgcagacctcacc

SEQ ID NO: 14735 - DNA, 445 bp, Homo sapiens
cattttaccacatttaatatggtacttattaagggtataacttaaatacaagattaaattactacaattttaaaactccacatgaactatatgactgggtgcagtggcccacacctgtggtcccagcactttgggaggccaaggtgggcagattacctgaggccaggagttcgagaacagcctggccaacatgccaaaaccccatctctactaaaaatacaaaaattagccaggtgtggtggtgcacacctgtggtcccggctactcggaaggctgaggcatgagagtcacttgaacccaggaggcggaggaggtggaggttgcagtgagccgagatcgtggcactgactccagcctggggaacaaagtgactctcatgcctcagccttctgagtcgctgggactatgggcaccgccaccaagccggctaatttttgttttagta

SEQ ID NO: 14736 - DNA, 182 bp, Homo sapiens
  misc_feature 142: w=a or t
aaagagagagagagagagcaagagagcgagctgtgagctgtgctgccgccgccgctgccctttgatcccgacattagtgttaggggctcggagacacagagcgcggccatagacaccgccgcaccggcactcatttatttawacctccccatcacacacgcgagcataggacacacacacac

SEQ ID NO: 14737 - DNA, 158 bp, Homo sapiens
ttcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagcttttttt

SEQ ID NO: 14738 - DNA, 69 bp, Homo sapiens
agttcagctcgctcggcgcacccacgcctcgctgccccgcttcctgccctcaacctgggcatgcgcacc

SEQ ID NO: 14739 - DNA, 120 bp, Homo sapiens
  misc_feature 23: m=a or c
  misc_feature 102: y=c or t
ccacgctgccaccgtcagcctgmcgggtcctgcctgttggaggctgacgggaaccggggatcctggggtgggcaggtcccgtggggaaagggagagacagayggtcaggggcacagagac

SEQ ID NO: 14740 - DNA, 101 bp, Homo sapiens
tattcatttatattttcctatggttttttttggtattagcaattaactgataaaggaatttatttctcttatttctgctgtcattcatgtattagcccaac

SEQ ID NO: 14741 - DNA, 490 bp, Homo sapiens
  misc_feature 313: n=a, g, c or t
  misc_feature 463: n=a, g, c or t
atgttggccaggttggtctcaaactcctgaccagcctaatgaatccccatctgcgtgctctttgatcagtttctgtttctcttgcatcttctgcaattctgaggaggtgggtttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtntgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtngctgagaaaatgtaaggattctggata

SEQ ID NO: 14742 - DNA, 713 bp, Homo sapiens
  misc_feature 599: w=a or t
  misc_feature 629: m=a or c
  misc_feature 659: r=a or g
ttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagtccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagttagttgagattgtgccawtgcactccagcctgggcaacagagcaagamtctgtctcaggaaaaaaaaaaaaaaaaagraaagcaacatagtggggtttctgtcaatctgtcctcggctgcccttctcatttg

SEQ ID NO: 14743 - DNA, 420 bp, Homo sapiens
aaatctttctgaggcatctgcctcttttttaagctctgagttctagttatcctggctcaggataaaaataatcccaccactggtatcctccctttttctacttccgaggctgcaaagtgcaacagcagactcttctgactcaggaaggccggtgctcctacccacttcctgttcctccatctccagcggacactgctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggaggatc

SEQ ID NO: 14744 - DNA, 117 bp, Homo sapiens
ttaaaaaaaaatcaacgaatgaattgaatgatagatttgtctgaaaacagaactagtgaccagtatgagaggactgaaagaaaaacagaacgtgcagttctgggagatgatgagaag

SEQ ID NO: 14745 - DNA, 130 bp, Homo sapiens
ctctctctccctctccctcgagctcccggctggctgcggctccctggcgctctccctctctctccggtaggctcaccgagcgatgcgagctctgggagacagcgacgccgcctcccgctagagacctgcc

SEQ ID NO: 14746 - DNA, 256 bp, Homo sapiens
  misc_feature 161: y=c or t
gcgagcgtggtcacgtggccgctggtcaccgccgccaccccctcccgccctgttctctttcaggtcgggccgggcccggccgcttccgcgagcgccctgcagactgagggagagagagagaaaagaggaggggaggaggaggaggatcagggaataggagytggggagcccttctgcgccacagtgatatcagtatcaagataaaagtttggaatgggagaaaaattctcaaagcctgaaagaaaatctgtagtta

SEQ ID NO: 14747 - DNA, 395 bp, Homo sapiens
taggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaac

SEQ ID NO: 14748 - DNA, 175 bp, Homo sapiens
  misc_feature 171: y=c or t
ctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgytccc

SEQ ID NO: 14749 - DNA, 146 bp, Homo sapiens
attcggagctgcgggagccgggctggcaggagcaggatggcggcggcggcggctgcaggcgaggcgcgccgggtgctggtgtacggcggcacccgacgcgctacgccctgcagtgtcgcttcagccccgactccacgctcctcgcc

SEQ ID NO: 14750 - DNA, 202 bp, Homo sapiens
agggggtggggcattcccctgcagcaaggggcggggccaccccaacgccgcttctgcggccaaagtaggttgggagtggaaggtggtggctgctgctccgcagtgtggggaagatggcgccgccggtggcagagagggggctaaagagcgtcgtgtggcagaagataaaagcaacagtgtttgatgactgcaagaaagaagg

SEQ ID NO: 14751 - DNA, 286 bp, Homo sapiens
  misc_feature 1: k=g or t
  misc_feature 90: y=c or t
  misc_feature 278: n=a, g, c or t
kagagcgggttgccagggcccgaagagggctggctgcggcggtctcgctcggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcanaccaggag

SEQ ID NO: 14752 - DNA, 116 bp, Homo sapiens
tctttagagtattggttggagctcattttatctgtagatatttaaatattcctccaaagagtaagttctcctttgcctttgttaatggtatactttagtagagaagttttactgat

SEQ ID NO: 14753 - DNA, 463 bp, Homo sapiens
  misc_feature 48: s=g or c
atccgtcctttcatcctggcgtttgcctgcagcaagatggcggcggtstcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaacttcagtactaaagaagatgcagtttcctttgcagaaaaaaatgaatg

SEQ ID NO: 14754 - DNA, 194 bp, Homo sapiens
ttgtactgatgattgtttgaaagtctgtgtgtgtcctgcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccat

SEQ ID NO: 14755 - DNA, 90 bp, Homo sapiens
tttccttaataataataaactttttcagaaagaattgagtagagcaaaaatgacaaagatgtgtagctgtgttcaatttttttttttttt

SEQ ID NO: 14756 - DNA, 152 bp, Homo sapiens
  misc_feature 44: n=a, g, c or t
  misc_feature 126: w=a or t
  misc_feature 146: r=a or g
  misc_feature 152: w=a or t
gcggggggcggagggacggagggaagatggcggcaggggccggntattggcgccgcctcccccaatctcggagccggcgcagatgaggcagtcggctggggccagcggcgctttggaacccgaggwggggggacctggcggtgggrcctggw

SEQ ID NO: 14757 - DNA, 199 bp, Homo sapiens
aggagggtgggggtgactggagccggaaggcctcccgggccgtgtggtcgccgtgggttctcggttgcgaggcagctcgctcgttctgcgatctattgagagtggcttccaagagccccgtgcctatgtctgggagggagggaagatggcagccgtggcggcaggcggcctggtgggaaaggggcgcgacatcagccta

SEQ ID NO: 14758 - DNA, 146 bp, Homo sapiens
ctcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaagg

SEQ ID NO: 14759 - DNA, 268 bp, Homo sapiens
  misc_feature 12: y=c or t
ggcttttttctyaagagggaattgtttagaggtctgctggctgtataaatgtacttattatttcgttgctagtcttatcatgggttacaatattttattaattaatttttatgattttacataaggcttttcagtaagtggtatgcctgggaaacatggtgagacccccgtttctgcaaaaaatacaaaaattagctgggaatgatggcacatgcctgcagtatcaactactgtggagtctgcagtgggaggatggcttgagcctggg

SEQ ID NO: 14760 - DNA, 172 bp, Homo sapiens
  misc_feature 154: k=g or t
acaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtktctcattacattgaataa

SEQ ID NO: 14761 - DNA, 273 bp, Homo sapiens
actttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctag

SEQ ID NO: 14762 - DNA, 272 bp, Homo sapiens
tgctgggtttcgtttggacaaagaatctactcttgtatagcctaaccccatttataagacattaagaggaactgggctgggcatagtaatgcctgtaatcccagcattttgggaggccaaggcgagttgattgctggagcccaaaagttcgagaccagcctggacaacatagtgagaccccatctctacaaaaattaaaaatgaaattagctgggcgtgatcatagctcactgcagctcaaccccctgggctcaagcagtcctccctgcctc

SEQ ID NO: 14763 - DNA, 354 bp, Homo sapiens
  misc_feature 125: k=g or t
  misc_feature 128: n=a, g, c or t
acaagtcagtgtcagcttaccaacatgacattttttcagtcagttgtggtaggccagccttgaagccatcgcacagtctagaaacttgtgtagctgagtgtgcagctcacctttaagggtgaagktanggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtca

SEQ ID NO: 14764 - DNA, 84 bp, Homo sapiens
cttaaactacacttgatataatgcaatagtagatcagggtacccaacaagtgataagaatttgcttcctttttttttttttttt

SEQ ID NO: 14765 - DNA, 138 bp, Homo sapiens
  misc_feature 137: n=a, g, c or t
agctcctgggttcaagtgatccttctgccttggccttccaaagtgctgggattacaggtgttagccaccacatctggccaatatgtgcagtcttgaataagacaattaccatgtcagagactgctctcacaaaggang

SEQ ID NO: 14766 - DNA, 131 bp, Homo sapiens
ggctttgattgggagaaaataagtgggaaacaagagtagcttggacagggggcttggacggccagcgcattgaccagaagcggcccacactacacgcgcgcgaacacacacacacacacacacacacacac

SEQ ID NO: 14767 - DNA, 171 bp, Homo sapiens
  misc_feature 47: s=g or c
ctcattggcagaggcgggaccgacggtgtgtgcggaacatggcggasgcggcaggaagcggccgtgcggcccgggtgaacacggccaaaggattgagtggcgaaaatggaagcaacagaagaaagaggagaaaaaaaaatggaaggatctcaagctgatgaaaaaactaga

SEQ ID NO: 14768 - DNA, 476 bp, Homo sapiens
gatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacacaccaccacgcccagctaattttttgtatttttagtggagacagagtttcaccatgttggccaggctggtcttgaactcctgaccttgtgatccacccacctcggcctcccagagtgctgggattacaggcatgagccaccacgcttggctaagaacacctaaatttttatgtttcttggctc

SEQ ID NO: 14769 - DNA, 343 bp, Homo sapiens
aagatgcatttggtgacaaaatggaatttgccagaagtattgtaagaacaattttagtttttaaaatttttattttttattatttattttattcatttatttatttttgatttttttttaaggagtcttgctctgttgcccaggctggagtgcagtggcactatctccactcactgcaaccatcacctcccaggttcaagcaattcttctgcctcagcctcctgagtaactgggattacagggatgtgccaccatgctcagctaatttttgtatttttagtagagagagggtttcgtcatgttgaccaggctggtctcaaactcctgacctgaagtgatccac

SEQ ID NO: 14770 - DNA, 588 bp, Homo sapiens
gtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtccgccacttccagatagactac

SEQ ID NO: 14771 - DNA, 60 bp, Homo sapiens
gtaattatggaataaatcagatttctggcatgcctgtttgtatgacagcaaaaaaaaaaa

SEQ ID NO: 14772 - DNA, 346 bp, Homo sapiens
gtcttgattggggttcctgaagaggaggccccctctccccagatagagtttcaccctgttggccaggatggtctcgatctcctgaccttgtgatctgcccgcctcggcctcccaaagtgctgggattacaggtgtgagccaccgcgcccggcctgtcttcttcttcctaaggtctcactctgtcgcccaggctgaagtgcagtggcaccatcacagatcactgcagactccacctcctgggctcaagcaatcctcctgtctcagcctcccgagtagctggaactcccaagtaacacacacattagcatgcccagctaatgtttaaattagggttttaattcacaga

SEQ ID NO: 14773 - DNA, 120 bp, Homo sapiens
attagatccctacatcatgtcatacacaaataatacctagtagattaaagacttaagtgtgaagggcaaagctataaaaattttaggagatataggagaatatcattatgatcccaagac

SEQ ID NO: 14774 - DNA, 314 bp, Homo sapiens
catgcttcaatgcaggccagttgtgaattgtgatggcttttatttctcctggggctgtaactttaagggtttagaatttggaaccacagcctagctaatcatgacacacacacacacacacacatgcacacacatacacatacacaaagcatcacgaagaaccatacaaattgtacattattttacacatggaggctcactctaaaatagataccattttaaatattaactaaaacttgtgctcattgtatgttcattctatatgtactgatttgttattcacatttctttcaaaatcgttcaaatttctagcc

SEQ ID NO: 14775 - DNA, 103 bp, Homo sapiens
cttttttgcaggacgtcacggaggactgcaggggcctgagccgctgctgccgccgccgccgcgcagcccacatcaacgcaccggggtcctgtcaccgtcaccg

SEQ ID NO: 14776 - DNA, 430 bp, Homo sapiens
agatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaa

SEQ ID NO: 14777 - DNA, 278 bp, Homo sapiens
  misc_feature 11: n=a, g, c or t
  misc_feature 18: r=a or g
gatatgattgncggcgartcgtggttctcttttcctccttggctgtctgaagatagatcgccatcatgaacgacaccgtaactatccgcactagaaagttcatgaccaaaccggtgggatggggagcaatgggaaatgaatgcgaacagttttttgttcgtctgtttgttttgtagagacggagcctcgctctgtcacccaggctgaagtgcagtggcgcaatcttggctcactgcaacttctgcctcccagactcaaatgattctcctgcctcagcc

SEQ ID NO: 14778 - DNA, 229 bp, Homo sapiens
  misc_feature 82: n=a, g, c or t
  misc_feature 83: k=g or t
  misc_feature 161: s=g or c
gatatgattggccggcgaatcgtggttctcttttcctccttggctgtctgaagatagatcgccatcatggtgagtctccctnkgcccgtgcagttatctgccgcgtatccgagccatccgtggtccctgggtcccagtacttgagctataggcacgcgaasccggttgctcttctctggccgtttctgtcagaggatggttgtcgaggggctcggggctgttggcaggg

SEQ ID NO: 14779 - DNA, 279 bp, Homo sapiens
  misc_feature 217: w=a or t
gatatgattggccggcgaatcgtggttctcttttcctccttggctgtctgaagatagatcgccatcatgaacgacaccgtaactatccgcccaaggagccaccatgcctggcctccttcactctttttatgataatctctcctagtcttgacttttgttttcgcagcagtggccctggcttgctggtagtaaattcatcatactgccagtagtttawagtcagtggtgtgtttctcagtacaagattctctcctttctttgtctggatggtggtctatc

SEQ ID NO: 14780 - DNA, 313 bp, Homo sapiens
  misc_feature 73: s=g or c
  misc_feature 136: k=g or t
  misc_feature 297: m=a or c
gcacgccgccttcgccgctggctccgtctgttggggggcgtacacgccgcggtcctcgtcgtggtgagcgcascactcaggctggtcctgggggtggggctgtaggggaaagtgctaaagccgctaggtgcaagtkggctcacgcctgtaatcccagcactttgggaggccgaggcaggtggatcacctgaggtcgggagttcaagaccagcctgaccaacatggagaaaccccatctctactagaaatacaaaattagccaggcatggtggtgcatgcctgtaatcccagctactmgggaggctgaggcagg

SEQ ID NO: 14781 - DNA, 289 bp, Homo sapiens
  misc_feature 72: r=a or g
  misc_feature 73: s=g or c
gcacgccgccttcgccgctggctccgtctgttggggggcgaacacgccgcggtcctcgtcgtggtgagcgcrscactcaggctggtcctgggggtggggctgtaggggaaagtgctaaagccgctgagatggctctgagagattcctctgcgaatctgtttttagctatcaagtggcatccacgcttaaacaggtgaaacatgatcagcaagttgcccggatggaaaaactagctggtttggtagaagagctggaggctgacgagtggcggtttaagcccatcgagcag

SEQ ID NO: 14782 - DNA, 347 bp, Homo sapiens
  misc_feature 294: r=a or g
  misc_feature 295: s=g or c
tcgggcgcgcgcacgccgccttcgccgctggctccgtctgttggggggcgaacacgccgcggtcctcgtcgtgatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcrsaagtgcaaagccagtgggggactttctcacagcttacatagccatccagaga

SEQ ID NO: 14783 - DNA, 441 bp, Homo sapiens
  misc_feature 268: y=c or t
  misc_feature 426: m=a or c
aatcgaaaaactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaaccygtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtmcagccgtgtgtgtgt

SEQ ID NO: 14784 - DNA, 514 bp, Homo sapiens
  misc_feature 16: n=a, g, c or t
  misc_feature 70: w=a or t
  misc_feature 160: k=g or t
  misc_feature 172: y=c or t
  misc_feature 175: r=a or g
  misc_feature 183: s=g or c
  misc_feature 187: s=g or c
  misc_feature 219: r=a or g
  misc_feature 361: r=a or g
  misc_feature 411: s=g or c
  misc_feature 437: m=a or c
  misc_feature 440: k=g or t
  misc_feature 441: n=a, g, c or t
  misc_feature 446: s=g or c
  misc_feature 484: s=g or c
  misc_feature 486: s=g or c
  misc_feature 502: s=g or c
  misc_feature 503: w=a or t
ctcatttttctactgntcgtggtaagtggcttcgtggtctttatagctgttactcttttgtactttgtcwttttcttttattttcttttgagcgattgtgcgaacatagcatagcacgcactatgccttctgtgttgtagctgcctggccagggcgactkgcggataaggtyttrtgcgtggsctcsaaggcttaaaagttagcagtgggggctttgtraaggacaaaatggcgatggcgggccgtgtaggtcccccttcctatgatgaggaccttttcacagacctgtactgagctccgtgaggataaataactctgaggagatgggccctgcaagcctcttgcttagccgtctgttcaraaaatagcgttttcgaaatgccctgaagttgacctaatgtcttattgggstcctgtctggcaggatttacgcgcamgtknggaascgaagagaagctctgttgttgcagtaagttcttacggscsatttcttaatctctgswctttcgttgag

SEQ ID NO: 14785 - DNA, 331 bp, Homo sapiens
tattagacttgctattttaaataccatcatctaggaaaagaaaagtggcagattttatttctgacttttttcacacacacagcagcaccaatggcaacaactaaagcaaaaactatctcttgagtctcagaaataaactttgtcccgacactttgaatttttagttgaacaaagcatttcactgtcatttaaaatctctcaagtggcacttgaaggcaagcaagtcgggaactttgagaccagcatttgaatttggttccatgatactgtacttggctttccatacttggttggggacagagatgattctgagaattactaatagtacacg

SEQ ID NO: 14786 - DNA, 1033 bp, Homo sapiens
  misc_feature 358: y=c or t
  misc_feature 377: m=a or c
  misc_feature 383: n=a, g, c or t
  misc_feature 408: n=a, g, c or t
  misc_feature 412: n=a, g, c or t
cccaaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatygaaccagaggagttcttgmccccanagaaacttcagtgtgtggacctccnatgnttatttccaatgacgtgtgtgcgcaagttcaccctcagaaggtgaccaagttcatgctgtgtgctggacgctggacagggggcaaaagcacctgctcgggtgatctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctg

SEQ ID NO: 14787 - DNA, 1032 bp, Homo sapiens
  misc_feature 91: s=g or c
  misc_feature 114: r=a or g
  misc_feature 122: s=g or c
  misc_feature 124: k=g or t
  misc_feature 407: n=a, g, c or t
  misc_feature 411: n=a, g, c or t
cccaaactcaccacctggccgtggacacctgtgtcagcatgtgggacctggttctctccatcgccttgtctgtggggtgcactggaatagscaggtctggctgggtcggcacarcctgtttsakcctgaagacacaggccaggtatttcaggtcagccacagcttcccacacccgctctacgatatgagcctcctgaagaatcgattcctcaggccaggtgatgactccagccacgacctcatgctgctccgcctgtcagagcctccgagctcacggatgctgtgaaggtcatggacctgcccacccaggagccagcactggggaccacctgctacgcctcaggctggggcagcattgaaccagaggagttcttgaccccaaagaaacttcagtgtgtggacctccnatgnttatttccaatgacgtgtgtgcgcaagttcaccctcagaaggtgaccaagttcatgctgtgtgctggacgctggacagggggcaaaagcacctgctcgggtgatctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctg

SEQ ID NO: 14788 - DNA, 350 bp, Homo sapiens
  misc_feature 299: n=a, g, c or t
aaatcatcgtctccatttcagaagaagaaccaaaacacatctgatctgctcttaaaggaaactcaattgtgacaagcagaggaaactaaagaggtaagagtatttccttgctagtggtagaattggctctagaaccagaaaggttaaattataaatctttggcaaaacacagctttctttacgtcattttcctctgggactagatgagaaacagctgggtatttggctagagaaaccgctggaaaaactcacgttggttaacaacacttctcccagaccttcacatggtgattgcagtncatctcagctctaatgccacctcctcagagtctctttctctgacactcaac

SEQ ID NO: 14789 - DNA, 415 bp, Homo sapiens
  misc_feature 78: k=g or t
  misc_feature 79: k=g or t
  misc_feature 363: r=a or g
  misc_feature 370: n=a, g, c or t
  misc_feature 373: m=a or c
gtagcggccacgttgatctgcgatacgcgtgtttgcccagtgagtggccccggactgctacgtgggactgcggtgaakkaacccagaaggtggagaggaaccgttctcggtgcacagaggcggctctgcagcccggtgagggcgcctgctgctcccgggcagtgctttccccaagtagtccgatggctgcggctgcgccgaggcgccctactcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaaratgagcngamcttctaagcagagtatttatatacaaagagagactcaggtca

SEQ ID NO: 14790 - DNA, 421 bp, Homo sapiens
  misc_feature 404: y=c or t
taagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgcycagtacataaggagttg

SEQ ID NO: 14791 - DNA, 410 bp, Homo sapiens
  misc_feature 99: n=a, g, c or t
  misc_feature 101: s=g or c
tgagtttggggctttttgtttattgtttgataagactttttattaagtaattgctgagcaaaaactttgtaaaaactcatgtaacagtactccagtcancsccccaaggcctcgtacccctgcttccccctacacctccatatccccaccaaaaggtccatctggctcctggtgctcagccagtgccttattttctttgacctgacagcactgggtggtagggaaggtattgtctggaggagcagggttgacagtgccaccgttccctcatacgcctgcagggctggggtttggggcagcagtaggtcaagtctggttcctcaaggtctcctattctcagtagcaaaaagcagccggtgggggtggggtgtaatggcttaaagctttcaacagctgtccccactgggcct

SEQ ID NO: 14792 - DNA, 273 bp, Homo sapiens
atctttcttcgggggaagccagctacaaagtcatgagggcactcaagtagacagtggaaaaactcatgtgaaaagggaccaaggcctcctgacaacagtcagcaccaacttgcagccatgaatggcatgtggaatttgattcaaaataatctagaaggagcaagtagagcaagtacaaacaaaagactactgtctacgaggtgataactgttcaagctgagatatggatacatggaataatctggataacataaaatgtggagtgctctgttg

SEQ ID NO: 14793 - DNA, 427 bp, Homo sapiens
tatacagataatcggagggcacgttcccataggtgaagcccgacaggagacataagactttgctgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgt

SEQ ID NO: 14794 - DNA, 531 bp, Homo sapiens
aaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttcttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattc

SEQ ID NO: 14795 - DNA, 391 bp, Homo sapiens
  misc_feature 358: n=a, g, c or t
  misc_feature 359: n=a, g, c or t
ggaagttgctttgttttgcttcgagatggctgcggggatgtatttggaacattatctggacagtattgaaaaccttccctttgaattacagagaaactttcagctcatgagggacctagaccaaagaacagagggtggacaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaccctgattgttccattgagtnnttccattttgcctgtgtggggctgacaaccaa

SEQ ID NO: 14796 - DNA, 540 bp, Homo sapiens
  misc_feature 136: n=a, g, c or t
  misc_feature 318: r=a or g
  misc_feature 364: w=a or t
  misc_feature 507: n=a, g, c or t
  misc_feature 508: n=a, g, c or t
ggaagttgctttgttttgcttcgagatggctgcggggatgtatttggaacattatctggacagtattgaaaaccttccctttgaattacagagaaactttcagctcatgagggacctagaccaaagaacagagggnggacaaacacattcggcggctggacacagacctggcccgttttgaggctgatctcaaggagaaacagattgagtcaagtgactatgacagctcttccagcaaaggccggactcaaaaggagaagaaagctgctcgtgctcgttccaaagggaaaaactcggatgaagaagcccccaagactrcccagaagaagttaaagctcgtgcgcacaagtcctgagtatgggawgccctcagtgacctttggcagtgtccacccctctgatgtgttggatatgcctgtggatcccaacgaacccacctattgcctttgtcaccaggtctcctatggagagatgattggctgtgacaccctgattgttccattgagtnnttccattttgcctgtgtggggctgacaaccaa

SEQ ID NO: 14797 - DNA, 475 bp, Homo sapiens
  misc_feature 413: m=a or c
ctttcttttcagtcgggcgctgagtggtttttcggatcatgtctggtggctccgcggattataacagcagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacmtttctccaaaatggatcaaaatgtttgttttggatgaagcagatgaaatgttgagccgtggt

SEQ ID NO: 14798 - DNA, 397 bp, Homo sapiens
  misc_feature 203: r=a or g
  misc_feature 204: k=g or t
  misc_feature 205: n=a, g, c or t
  misc_feature 269: r=a or g
ctttcttttcagtcgggcgctgagtggtttttcggatcatgtctggtggctccgcggattataacagcagaacatggcggcccagagggaatggaccccgatggtgtcatcgagagcaactggaatgagattgttgataactttgatgatatgaatttaaaggagtctctccttcgtggcatctatgcttacggttttgagarkncttccgctattcagcaaagagcgtatgggttgtctgcaatgtgggtggggtgagtggggagagrgcgtgggtggttagaaatcagctaacagagcactttatcactcagtgcgggagtgtagaatttattttaaatattttgggaagactttagggatttaatcatggagaagagtgggcgttggaggtggg

SEQ ID NO: 14799 - DNA, 351 bp, Homo sapiens
ctttcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatcataccctttaatacagggaataatagctctctgctgaatagcggaaggcttct

SEQ ID NO: 14800 - DNA, 241 bp, Homo sapiens
  misc_feature 141: m=a or c
  misc_feature 220: s=g or c
ctttcttttcagtcgggcgctgagtggtttttcggatcatgtctggtggctccgcggattataacaggtatgcagtctgttggcggtcgcggtctgtagtgaaggtcatagggcgccaggggagatgatagtggatggcamggaggcaaaaactctaaattaatggacgttttcttagggtacagcactcctgtgcccttccagaagcttccatgatggstagggcccggattgtggggag

SEQ ID NO: 14801 - DNA, 155 bp, Homo sapiens
ctttcttttcagtcgggcgctgagtggtttttcggatcatgtctggtggctccgcggattataacagagaacatggcggcccagagggaatggaccccgatggtgtcatcgagagcaaccagacatgatccgaaaaaccactcatcgcccttacc

SEQ ID NO: 14802 - DNA, 134 bp, Homo sapiens
  misc_feature 32: w=a or t
agaaccagctgtctgagctgcccgggcagcgwgggagcagcgagcgggcttccgcgagccggagaaggcacaggcctgtcccgggtcccggcaggtctgcgcgtctgttcccagcgctctggaggcctaaaaag

SEQ ID NO: 14803 - DNA, 304 bp, Homo sapiens
  misc_feature 109: w=a or t
agaatcagctgtctgagctgcccaggcggcgggggagcagcgagcgggcttcagcgagccgcaggaggcacaggcctgtcctgggtccccgcaggtctgcgcgtctgtwgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctgga

SEQ ID NO: 14804 - DNA, 182 bp, Homo sapiens
gataatctgacactatggacttcagacatgcagggtgacgattcctaaaggaaaacccaactcttcctttcctaaaaactctactttgtgaagagcagaataaagaagcgctgcaggacgtggaagacgaaaatcagtgagacataagccaacaagagaaaccatctctgaccaccccctcc

SEQ ID NO: 14805 - DNA, 100 bp, Homo sapiens
taccatggagattaacaatgaacattccacatttataacaatctagttttaataccagttttgtctcagtatcatacaaaaactctgctcctatccagct

SEQ ID NO: 14806 - DNA, 454 bp, Homo sapiens
ttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattaagggcagagcaatcaggctggagttgcaaggacccaggggatcacctaatgccagaaagccagccatccaaaactctgtttgtcaaaggcctgtctgaggataccactgaagaga

SEQ ID NO: 14807 - DNA, 421 bp, Homo sapiens
  misc_feature 52: s=g or c
  misc_feature 392: r=a or g
  misc_feature 419: s=g or c
ctttttttgacaagatggcggcaggaggcagtggcgttggtgggaagcgcastcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgactcatcctcgagaacacatccaragtccctgcccccaaagacgtcctcgscc

SEQ ID NO: 14808 - DNA, 602 bp, Homo sapiens
  misc_feature 8: n=a, g, c or t
  misc_feature 9: n=a, g, c or t
  misc_feature 266: k=g or t
  misc_feature 553: n=a, g, c or t
  misc_feature 554: k=g or t
aagtcgtnncgggagggagacgcagaggcggacaagatggcggcggcagctgtacagggcgggagaagcggtggtagcggaggctgtagtggggctggtggtgcttccaactgcgggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaatkgacaagatggcggcggcagctgtacagggcgggagaagcggtggtagcggaggctgtagtggggctggtggtgcttccaactgagggacaggaagtggccgtagcggcttgttggataagtggaagatagatgataagcctgtaaaaattgacaagtgggatggatcagctgtgaaaaactctttggatgattctgccaaaaaggagaagagcatctttctcgtggcccacaggaaagatcctacaggaatggatcctgatgatatttggcagctgtcctccagtcnkaaaaggtttgatgacaaatacaccttgaagctgaccttcatcagtagg

SEQ ID NO: 14809 - DNA, 692 bp, Homo sapiens
  misc_feature 8: n=a, g, c or t
  misc_feature 9: n=a, g, c or t
  misc_feature 266: k=g or t
aagtcgtnncgggagggagacgcagaggcggacaagatggcggcggcagctgtacagggcgggagaagcggtggtagcggaggctgtagtggggctggtggtgcttccaactgcgggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaatkgacaagatggcggcggcagctgtacagggcgggagaagcggtggtagcggaggctgtagtggggctggtggtgcttccaactgagggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatcttt

SEQ ID NO: 14810 - DNA, 309 bp, Homo sapiens
taaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtga

SEQ ID NO: 14811 - DNA, 202 bp, Homo sapiens
cagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagaccctg

SEQ ID NO: 14812 - DNA, 461 bp, Homo sapiens
  misc_feature 12: y=c or t
  misc_feature 13: n=a, g, c or t
  misc_feature 19: n=a, g, c or t
  misc_feature 201: n=a, g, c or t
  misc_feature 427: r=a or g
aaaaggccgcgyntgcgangccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagnaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaactgtagttgctgctcaraaaataagtaaaggtgcagatcccaagtctgtag

SEQ ID NO: 14813 - DNA, 310 bp, Homo sapiens
  misc_feature 135: n=a, g, c or t
agatgcagagctgtagccaatcgagtgattttggttttttacttctgtcatcagtgtataaaaactgcagctcatgctgctggatagagctctgtgaacctcttctggttgtgagtgctgcctgattcgtgagtngtttgttgctcagtgttcttgaagtcattacttactgagaaaagaatcactatccaagatgaaaaatcaggaacttcaacaacagctcctttatttccatttctacttctgttggaaataccaaaatatttgcagactggatccaaatcaggagcccagatgaacttaaagaagc

SEQ ID NO: 14814 - DNA, 587 bp, Homo sapiens
  misc_feature 442: k=g or t
  misc_feature 510: r=a or g
cattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagtkattaacatttgggacctggataattatatcagagtatgtcagtccaataaattatttaactaattaaraaatagttgcaaagcatttgagctgtggttgaggaagtggtgtaaagtgcatccattaggaatgatgcactttcatt

SEQ ID NO: 14815 - DNA, 472 bp, Homo sapiens
  misc_feature 137: k=g or t
  misc_feature 355: s=g or c
catttgtatatgtctgttgattaaagcattcgaaatgttatcttagaatttttcacccaactgcttggtttcaaagatcttaagtgaaaaactgcctcctggtcaataccaaatttgtacagagtgtgaagtggagkttttatgcttctgtcaaacttccatccatctaatactgtacctgtgtcatattttattcctttgtagtcttctaaggaattggaagtttctgtatgatgcgctttactagttgtaaaatagactatcagagggaaaaggcctctctagtttatttttgaaaaatgctccaggtcttaataattttcattttcattcatcttagttttagaattgtcasctcagtctgattttcacaatcctttttgctaaaagttggaagtgggaattagcagacgatttgggataaggaaagaggaatgatgttatatttacccttaggaatagaagtgaccga

SEQ ID NO: 14816 - DNA, 482 bp, Homo sapiens
gaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagagactacgccccgtctctactacaaatacaaaaattagttgggaatggaggcgtgcacctataatcccagctactcgggagggtgaggcaggagaatcacttgaacccaggagg

SEQ ID NO: 14817 - DNA, 412 bp, Homo sapiens
gaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtggggg

SEQ ID NO: 14818 - DNA, 348 bp, Homo sapiens
ctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgca

SEQ ID NO: 14819 - DNA, 461 bp, Homo sapiens
  misc_feature 179: s=g or c
  misc_feature 388: k=g or t
  misc_feature 411: r=a or g
  misc_feature 422: r=a or g
gacgcgcgcggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggasgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgckgggcaacgcattcaagaaagccracccccaagargccattaactgtttgatgcgagcaatcgagatctacaca

SEQ ID NO: 14820 - DNA, 410 bp, Homo sapiens
acacaccccagtacaccagcagaggaaacttataacctcgggaggcaggtccttcccctcagtgcggtcacatacttccagaagagcggaccagggctgctgccagcacctgccactcaagaagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggctaaaatcgtgcctggc

SEQ ID NO: 14821 - DNA, 350 bp, Homo sapiens
atgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagta

SEQ ID NO: 14822 - DNA, 252 bp, Homo sapiens
taatttattataaatgcagttgtaagtgataaattcatctctttaaaactattttaaaattctgatttatcactagttctaactatccttccatcagtcattccaaagtaatggtctgtaatgagaaatcactatgtataattatacacaataaaaatatatacaacaggtattttgataatatgataattaaaaccaaatatagtcattgaggcttagaatttttaaaaactgtattatatattgtaaaag

SEQ ID NO: 14823 - DNA, 121 bp, Homo sapiens
agagttatgctagtgtcataaatgcatcaggaaacatcagtggaaatggtgtggtaggtaccttcagggcctcatctctcccaagaaacactgaaaaatcttgcaaaaactgtcagaagct

SEQ ID NO: 14824 - DNA, 493 bp, Homo sapiens
  misc_feature 428: w=a or t
  misc_feature 447: w=a or t
  misc_feature 450: n=a, g, c or t
  misc_feature 459: k=g or t
  misc_feature 462: w=a or t
  misc_feature 475: w=a or t
  misc_feature 491: w=a or t
  misc_feature 492: w=a or t
gttttgatataatcttggcttcttaaaaactgtgtatcattaaaatatatgttctgcaagaattaaaactgagtccatgaaaataccataggaagacataaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgwatatttgcaaaccctttgwatnataattgtkgawattttcccttttwaaaaaataccattgawwt

SEQ ID NO: 14825 - DNA, 438 bp, Homo sapiens
  misc_feature 3: n=a, g, c or t
  misc_feature 150: k=g or t
  misc_feature 151: y=c or t
  misc_feature 152: k=g or t
  misc_feature 153: n=a, g, c or t
  misc_feature 160: r=a or g
  misc_feature 183: k=g or t
  misc_feature 187: w=a or t
  misc_feature 249: n=a, g, c or t
  misc_feature 359: r=a or g
  misc_feature 360: n=a, g, c or t
  misc_feature 361: n=a, g, c or t
ttnctggcttgggaaccacatcgcccgaccgtgctctttatttttcggtggagcagctctgctttctcaggtctctacttacttatataagatggcatcaagaagaaggacctgaccactggcccctgactacatggtctttggaaccckykngcattgraagatgtcagagacatggcacakggawgtgatcttcaaaaactgttacagcctcatctcattgggtgagtacagtttctccaatgccanaatatgtaggatcatgagatttacaagtgttcatctgagactgagctttgagtttagggaccagagacaagatatttctgtactaaacagatgatagtccttttctttarnnctttgtaaatagtcttactttgttaccttagaagtatcaacatttctctatcgcagaatttctgaagactacttagg

SEQ ID NO: 14826 - DNA, 426 bp, Homo sapiens
  misc_feature 3: n=a, g, c or t
  misc_feature 159: r=a or g
  misc_feature 420: r=a or g
ttnctggcttgggaaccacatcgcccgaccgtgctctttatttttcggtggagcagctctgctttctcaggtctctacttacttatataagatggcatcaagaagaaggacctgaccactggcccctgactacatggtctttggaacccgtggcattgraagatgtcagagacatggcacatggatgtgatcttcaaaaactgttacagcctcatctcattggattggtctacacatcaaggtgctggaagtgtcgcatgcccagagatgatgtggaagctctatacccctttcccttctgcccaccttgccctgtgcatctcttcctgaatggcttctcctgaattgtatcctttataataaactggtaaataggaaagagataatatcttctacttaatcctggatactatatctgargtcaga

SEQ ID NO: 14827 - DNA, 413 bp, Homo sapiens
  misc_feature 357: w=a or t
  misc_feature 358: n=a, g, c or t
tcttttgctctctatggttaggagcgcaacctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcagcattttaaaaataaagttccggagaagcaaaaactgttccaggaggatgatgaaattccactgtatctaaagggtggggtagctgatgccctcctgtatagagccaccttggatagtttgcaaattattttawnccatcctgtgggttgtctctccactttgttggttgttttctttgctgtgcagatt

SEQ ID NO: 14828 - DNA, 421 bp, Homo sapiens
  misc_feature 63: s=g or c
  misc_feature 309: s=g or c
  misc_feature 310: n=a, g, c or t
  misc_feature 325: n=a, g, c or t
  misc_feature 326: w=a or t
acgcgcaacttccgggacagaggctgtggctggaaggagctgggcatccggcctgaggcgcasggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttsncagaaatgagctcanwcctcctaactgggtaatagacatgggtggggcctggaaaagtgaggtatgttctctgttctggaggcccactttcccgactgtgtctcttcgtga

SEQ ID NO: 14829 - DNA, 255 bp, Homo sapiens
  misc_feature 25: s=g or c
  misc_feature 26: s=g or c
acgcgcaacttccgggacagaggcsstggctggaaggagctgggcatccggcctgaggcgcacggtcgcgttagttcggcccaatggcggcaccgctgcttcacacgttgtttgtcgggagatgcggccgcttcgtcctctgcagtcaagacgctgggcgcgtcgaggactggcttctacttgaatgaagacaaaaatctaggccgggcgcggttgctcacgcctgtaatcccagcactttgggaggccgaggtg

SEQ ID NO: 14830 - DNA, 89 bp, Homo sapiens
acaaagatacttatgagcctttctgcaaggtccctgtgatcacctcatccaaggaagaacaaaaacttatagcgacttcaaataagcca

SEQ ID NO: 14831 - DNA, 409 bp, Homo sapiens
  misc_feature 392: y=c or t
atacgccggggcggggccgagagtttgagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataaggtaaggctcgcagggctgtgggtctagcctcatgttggtgtgttggcctgttcctgactggyaccaggtaagtgtgtgc

SEQ ID NO: 14832 - DNA, 408 bp, Homo sapiens
  misc_feature 81: k=g or t
  misc_feature 393: y=c or t
atacgccggggcggggccgagagtttgagccccggagtggggtgtcggcgcctcattcgggtggagctgagccggagacakgcagttgtgaaaaacttcaggacaaaaatgtttcatttaaggacttgtgctgctaagttgaggccattgacggcttcccagactgttaagacatttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcaactgcctaccagagycccttcccctgagcc

SEQ ID NO: 14833 - DNA, 472 bp, Homo sapiens
  misc_feature 386: s=g or c
gatttttgatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggastgacgtgcctcaacgaagcctccgtgctacacaacctgagggagcggtacttctcagggctaatatatacgtactctggcctcttc

SEQ ID NO: 14834 - DNA, 390 bp, Homo sapiens
agatttggacgctccggcctgggaggggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggactgacgtgcctcaacgaagcctccgtgctacacaacctgagggagcggtacttctcagggctaatatatacgt

SEQ ID NO: 14835 - DNA, 261 bp, Homo sapiens
  misc_feature 98: y=c or t
atttttcgctctttccggcggtgctcgcaagcgaggcagccatgtcttatcccgctgatgattatgagtctgaggcggcttatgacccctacgcttaycccagcgagagtaacccctccgggagaaacaccaaacactcggaaacagccagggctttcgcaacagtgaagctgcagatcccatttatttccgtcttagtagcattgtctctgttcaaattaggtaccagcaactaaggcaagtccactaaacattcacatg

SEQ ID NO: 14836 - DNA, 246 bp, Homo sapiens
  misc_feature 47: n=a, g, c or t
  misc_feature 81: y=c or t
  misc_feature 97: r=a or g
  misc_feature 135: y=c or t
gggaggtcactttaaagagggctgctcaactgcaaggacgctgtaancaggaagagaagccacagcgcttcagaaaagagygggacagggacaagcrtatctaagaggctgaacatgaatccacagatcagaaayccgatggagcggatgtatcgagacacattctacgacaactttgaaaacgaacccatcctctatggtcggagctacacttggctgtgctatgaagtgaaaataaagaggggc

SEQ ID NO: 14837 - DNA, 311 bp, Homo sapiens
  misc_feature 135: r=a or g
tgttttgttttgttttgttttgttttgtatttttagtagaaatggggtttcaccatcttggccaggctggtctcgaactcctgacctcgtgatccacctgcctcagcctcccaaagtgctgggattacaggtgtragccaccgtgcccagccttgactcagtttttgactcaatcactgtgttgatcatcaagtcctatgttagcaaacaatttttttattgcagcagattcaggaagcttttagccaatataactaatgtcagtctcgttaggatttacatcaaaggaatagtaaaaacttctctttccc

SEQ ID NO: 14838 - DNA, 158 bp, Homo sapiens
  misc_feature 86: m=a or c
gagaagactttagtttgagccagtctttggagacttgggtcctaaaaacttctgtgattccttttctattaagaaatgtatttggmaaatatttaggaaggatgccaggctcagccacttcattccctcattctgatcctgcctaattctgccactct

SEQ ID NO: 14839 - DNA, 324 bp, Homo sapiens
acgtgacatgggttggaagatggcgtctcccacagacgggacagatctggaagcatctttgctaagttttgaaaaacttgaccgtgcctcaccagatctttgccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtggtctccctctgtcacccaggct

SEQ ID NO: 14840 - DNA, 482 bp, Homo sapiens
attgtgggagtctccgcgtcccgctcgctgggagagaggtacctctccttttccctctccctttccctaaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatg

SEQ ID NO: 14841 - DNA, 177 bp, Homo sapiens
aagctccttttcctgaatttcctacctaaatattaaccatatgcctagtctctgaaactaaaaacttggacctcatcctcaattattttctcctttcaactctgttgaccctctgtctggtcttcctctagaaggtaccgcagaaattgatgtgtgctccctgccctcgtcactgcc

SEQ ID NO: 14842 - DNA, 502 bp, Homo sapiens
  misc_feature 413: k=g or t
agcacaatgattgcctgtattgtgtttttcttgacaagacactgttttggcatatttcattaattccctcttcatttttcaaccttgattttatttccttttatgattcagaacaatacagctttctccttgaaaacagccttcttagtctgtacacactggttgggatgggtggaaggtaatagaaagataattgggttggcagattaaaaacttgggttctaatcctttttctgccactctctagttctggaatcctaggtatatcacttgccctacctgggtctaggcatccccatatctaaaatgacattcaagtgggtggtctttaaatgatactatgacaatctagtagccatgtttttgtttgtttgtttttgagacagggtctcactctgttgctcaggctggaktacagtggtgccagctcggctcactgcatcctgtgcctcccaggctcaagcaaccctcccacctcagcctcccaagtagctgggactac

SEQ ID NO: 14843 - DNA, 99 bp, Homo sapiens
actctatgaaaatgtttttcatttgaaaattttccctagaatgatttaaattaaaaataatgaggaaaaacttgtgaatctctacagatatatccgcga

SEQ ID NO: 14844 - DNA, 333 bp, Homo sapiens
ttgtgaataagtctgttgaatgaacaacatagttgaaatggggtgttttatttatgaattagtctgttgaatgaacaacatagttgaaagaacacaaccacaaaccaaacctcagttaacaagtcaaggggaaaaacttgtgactctactggcagcagcagatgatgggtgtcccagacacaagctggttccatgtggtggatctgtgtctaggctattaccatacaatgaagggaaacttacttggaactaaagagacttaactatgtttaattaacttgtgaggagtatgtttttcagagtggtgattttaatcacccacccttgtcccca

SEQ ID NO: 14845 - DNA, 355 bp, Homo sapiens
  misc_feature 192: w=a or t
  misc_feature 308: n=a, g, c or t
aaaggagccgcgctgggaacactgcggtcggggcgaggaagctgccggggaagtgagatgacggtcgtgggggtgcccaggagccctgaaaaacttgtgccctgggcacggcaaaatctgcaggttgcagaaagtctcaactgatcctggcataccccgaggtgccgacttttagagctgaagatgcaagawagattgggatcctgcgatgcaccgaacctgtctctcgaagtgtgtgcgccctgcttcctgtgttaaacaatttgctacaaggtcacacaattttaactagaagactgagatgtgancctgggtgtctgatgtgaacaccactgtctggtaatcccaacgctct

SEQ ID NO: 14846 - DNA, 555 bp, Homo sapiens
aaatgaacggcggcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaat

SEQ ID NO: 14847 - DNA, 281 bp, Homo sapiens
  misc_feature 13: s=g or c
gttcctggcggasgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagagg

SEQ ID NO: 14848 - DNA, 161 bp, Homo sapiens
acacaaagcccagacgcggagaaaatggcggcaggggtcgaagcggcggcggaggtggcggcgacggagatcaaaatggaggaagagagcggcgcgcccggcgtgccgagcggcaacggggctccgggccctattccttgactctctttttctccttaccg

SEQ ID NO: 14849 - DNA, 474 bp, Homo sapiens
  misc_feature 207: m=a or c
aaatgaacggcggcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagamaggctgaaggggatgctaagggagataaagcaaaggtgaaggacgaaccacagagaagatccgcgaggttgtctgtggttcgtccttcacctttgctttatctcccttagcatccccagacgcggagaaaatggcggcaggggtcgaagcggcggcggaggtggcggcgacggagatcaaaatggaggaagagagcggcgcgcccggcgtgccgagcggcaacggggctccgggccctattccttgactctctttttctccttaccg

SEQ ID NO: 14850 - DNA, 309 bp, Homo sapiens
gaaccgcagactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaac

SEQ ID NO: 14851 - DNA, 307 bp, Homo sapiens
aaccagagtataacttttcagggtacaaaaaataatgtaggacagcttcttatttgagattgactttactaattattattgttcaaaaattgaaatatgtcacgaaaaacttttgtattgaaggaaaattcggtaatgatgagactcatgaggttatgtcctatcagtgaaggatacataattgagaggggttgtttatactttacagcaaaatcaaaggctgaaattttcttaacgctggagctatatgtgatctttagtgattatgaactaggtagaagaggatgaaatacgaactgctaagccc

SEQ ID NO: 14852 - DNA, 246 bp, Homo sapiens
gcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaagtgagtagtgtactttttttccccaaaaataaatcactggataccagc

SEQ ID NO: 14853 - DNA, 410 bp, Homo sapiens
  misc_feature 226: w=a or t
  misc_feature 312: n=a, g, c or t
  misc_feature 313: n=a, g, c or t
  misc_feature 314: n=a, g, c or t
  misc_feature 315: n=a, g, c or t
  misc_feature 372: n=a, g, c or t
  misc_feature 374: n=a, g, c or t
  misc_feature 375: s=g or c
  misc_feature 376: s=g or c
gtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctcwgaaacctattagtgtctcctacaacccagccacagccaaagaaattatcaatgtggggcattccttccatgtaaattttgaggacnnnngataaccgatcagtgctgaaaggtggtcctttctctgacagctacaggctctttcangnssaattttcactggggcagtacaaatgagcatggtt

SEQ ID NO: 14854 - DNA, 207 bp, Homo sapiens
caaacattgatttaagtaaaatgggtccttgagaaactgggtgctttaaatgtttcagtatctgttgcttttttaaggtacatttagaaagtagttttgtatgaatcgtgaaatagccttcttcacagcgaatttttaaacgcaaaaaaagataactagtaagagggtgaacttggtgaattacaaaatagacattttaatatagca

SEQ ID NO: 14855 - DNA, 435 bp, Homo sapiens
  misc_feature 433: m=a or c
cttttctcccaggcgacaccaggctccgcataacccgggagtggctcaggtagggccgtcggttccagtgcctgcgaggcagcagccaggctgaaaatgtctccctgcgctgagacgctggtgacaaccgccctttgggactacctgccaaacaaggagaatgcgctctttgacagataattccctaagagggaggcactgcctcggtcggtagacaagtaatgaatgaccgaaaaaaaaatcacattagaagttatcaccagcacgggtgcgaaggcagtgcattaaatcaacactcattttagagcgccccagacagcccagccggaagggaggagatcagagctgtcaaagcacagcagagccccaaaccacaaaggcttaaatgaaattcaacttcctgagccaggaagtgtcacggtctcgcccgcamtc

SEQ ID NO: 14856 - DNA, 81 bp, Homo sapiens
agacccaaaaagaaaatagcataatgaactctaatgtgcccataacctgcctggaattattttttggagcataaaaaccct

SEQ ID NO: 14857 - DNA, 244 bp, Homo sapiens
  misc_feature 12: n=a, g, c or t
  misc_feature 13: s=g or c
  misc_feature 48: s=g or c
  misc_feature 49: n=a, g, c or t
  misc_feature 147: s=g or c
  misc_feature 154: s=g or c
  misc_feature 155: s=g or c
aaaggaggccansagcgcgggcggcgaggcaagatggcggcaaccaasnggaaacggcgtggaggctttgcagttcaggcgaagaagccaaaaagaaacgaaatagatgcggagccgccagctaagcggcacgccacagcagaggasgtggagssaagaagagagggaccggatcccaggccccgtttgcaagggaaagtggaaaaataaggaacggattctcatcttttcttcctctacctcc

SEQ ID NO: 14858 - DNA, 254 bp, Homo sapiens
gccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataa

SEQ ID NO: 14859 - DNA, 117 bp, Homo sapiens
cccataaaaccagctgagtctttgtgccaggaagactgcgtgcagaaggccttggctccttgaacttttggccgccatgtgcttcccgaagtcctctctgatgagatgaagaagctg

SEQ ID NO: 14860 - DNA, 209 bp, Homo sapiens
aagactgcgtgcagaaggtgactgtctcagtggagctgggtcatctcaggccttggctccttgaactttggccgccatgtgcttcccgaagtcctctgatgacatgaagaagctgaaggcccgaatgcaccaggccatagaaagattttatgataaaatgcaaaatgcagaatcaggacgtggacaggtgatgtcgagcctggcagagc

SEQ ID NO: 14861 - DNA, 275 bp, Homo sapiens
agggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcggtgcgtgagtgctccaggcgcaaacttgcatcgtccacccccgtccccctacatccctccatcttgtacccctaaagccctatcgccgccctcgggtcccctctagtgtgtctgcacccccacggcatccccttatctatcccca

SEQ ID NO: 14862 - DNA, 341 bp, Homo sapiens
  misc_feature 98: k=g or t
actttccctctgcccctccccactctcaggctggtggggtggggaaagcagcccattcctgggctcagagactcccaccccagctcagagggagcagkggcccagccagggacggaccctcattcctcccagggaccccagacctctgtctctctcgggccttggctccttgaacttttggccgccatgtgcttcccgaagtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagag

SEQ ID NO: 14863 - DNA, 402 bp, Homo sapiens
  misc_feature 148: s=g or c
ataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcasctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggagtcggctgcagaaaaactagaaaaagtagg

SEQ ID NO: 14864 - DNA, 405 bp, Homo sapiens
  misc_feature 201: k=g or t
  misc_feature 202: n=a, g, c or t
ggacaaatggacctgcggtaggagagagggacaacagtaggagcaggcagatcttgctgtttcaaccaaaacctcatgctgaccagagttgaggaacagaagaaagatggtgaaggcctgcaggtataggtgttcagcatgtcatctgaaatattccccacagaggcaaaaagaaaggaaattatctctgaaaaggaatgknaggacaaggtattgatgacattttctgattacagaggagactctcaggactgaggaattgtcacccatgcttggccaatctcccaaactgtcatgcctctggcaaaagcaaagatcacctctcaccttctaaagactggccccagtacttctctaacaatcccttccctcaccgacacccacccaccaataaaaaaacaacca

SEQ ID NO: 14865 - DNA, 611 bp, Homo sapiens
  misc_feature 278: n=a, g, c or t
  misc_feature 279: n=a, g, c or t
  misc_feature 425: s=g or c
  misc_feature 430: s=g or c
  misc_feature 442: r=a or g
atctctgggactcagtgctgcaccgcgtgtacaaagacaaagagatgaatctggggtagatttaggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagannacttctttctctacattgcctacagtgacgaaagtgtctacggtctgtgaagctgctgcccctttcttgacctcctcctccttcaagctcaaacaccacctcccttattcaggaccggcacttcttaatgtttgtggctttctctscaagscttctcttaagraggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccc

SEQ ID NO: 14866 - DNA, 117 bp, Homo sapiens
agtgctgcaccgcgtgtacaaagacaaagagatgaatctggggtagatttaggtgctaggaatattgtttcttgagttcttgacaggtgcagcttcggggctgcattccttctgtct

SEQ ID NO: 14867 - DNA, 351 bp, Homo sapiens
  misc_feature 129: r=a or g
acattgtaactcctgctgccggaagctcaaactcccggatttaaaaagaaatgactattcccctgaaaggataaattccacctttggacttgagataaaaatagaatcagctgaggagcctccagcaargggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagac

SEQ ID NO: 14868 - DNA, 602 bp, Homo sapiens
  misc_feature 86: s=g or c
aactcgggagctatttctgaacggacctgggcttgtcggaccagtgagcggcggcggctgcgcggcggcagcggcagaaagcgtastgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggtaaatgcaagttacagcattttctgtttaagcact

SEQ ID NO: 14869 - DNA, 286 bp, Homo sapiens
  misc_feature 263: r=a or g
agaggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctrccgaatggaaacccgctaaaccc

SEQ ID NO: 14870 - DNA, 361 bp, Homo sapiens
  misc_feature 14: w=a or t
  misc_feature 61: n=a, g, c or t
attctcttctcccwgaagggaggcacaccgtccgttcgcctgactggcagtgttttaaggnccatcgcgcttgacgggaaagtcagattaaaaatcaagaaatataaaccagatgtagcagtttcttgacatggagaaccaagcccataatacgatggggctgaagtgtaagacctcaataactacctgcttatccagtctgagtgactggacttacaccagctccctggagaatgcttcagcttctttgaaaaagaactctgtagtgagagcacttaccaatctgtcttaacaacagttgctatagtcctagctgttatactaagcattttgtttgaaactcaataaaccctcctggacc

SEQ ID NO: 14871 - DNA, 315 bp, Homo sapiens
  misc_feature 5: k=g or t
  misc_feature 14: s=g or c
  misc_feature 15: s=g or c
  misc_feature 16: m=a or c
agcaktcggcggassmtctgcctgcgtccgctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagc

SEQ ID NO: 14872 - DNA, 156 bp, Homo sapiens
gtttaatttttgttgtcagaaaagtatgaacatttgtgacttgcctaaaaagaacttggtccccctgcaaagatagagggaaggtacagatcggagtgaatgaaaataatcagcaatcaagtattaagaaatgaagtatttgcacacctcatcact

SEQ ID NO: 14873 - DNA, 518 bp, Homo sapiens
  misc_feature 313: s=g or c
gggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcasgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcg

SEQ ID NO: 14874 - DNA, 750 bp, Homo sapiens
  misc_feature 127: w=a or t
  misc_feature 495: r=a or g
  misc_feature 536: n=a, g, c or t
  misc_feature 537: n=a, g, c or t
  misc_feature 588: r=a or g
  misc_feature 701: m=a or c
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcacgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaargccaagcaaagggagtgctcacaacatttgaggacaagtgnnaggtctcatggaaggaagaggtgatatgggcctgacccccaagaacagcarcctcctggctttacattagcagagtactacggtgtcaaaacattcttgcttttttcttcttttcattgacttactaatttgttattcattgttaacagcttccatggctccamaattctccagtcatccagatttaatctggtttatccaagaatgttgcct

SEQ ID NO: 14875 - DNA, 705 bp, Homo sapiens
  misc_feature 127: w=a or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcacgtttctgagcagcgcttcctttttgtccgacatcttgacgaggctgcggtgtctgctgctattctccgagcttcgcaatgaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 14876 - DNA, 918 bp, Homo sapiens
  misc_feature 127: w=a or t
  misc_feature 848: k=g or t
  misc_feature 856: r=a or g
  misc_feature 880: s=g or c
  misc_feature 881: n=a, g, c or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaaagtcaccggcgttcttgggtttgaggactcagtggggagagccttcggcgcgagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaaggccaaaaagaagctgtggtctctgagagactgaagattcgaggctccctggccagggcagcccttcaggagctccttagtaaaggacttatcaaactggtttcaaagcacagagctcaagtaakttacaccrgaaataccaagggtggagatgctsnagctgctggtgaagatgcatgaataggtccaaccacc

SEQ ID NO: 14877 - DNA, 979 bp, Homo sapiens
  misc_feature 127: w=a or t
  misc_feature 724: r=a or g
  misc_feature 765: n=a, g, c or t
  misc_feature 766: n=a, g, c or t
  misc_feature 817: r=a or g
  misc_feature 930: m=a or c
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaaagtcaccggcgttcttgggtttgaggactcagtggggagagccttcggcgcgagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaargccaagcaaagggagtgctcacaacatttgaggacaagtgnnaggtctcatggaaggaagaggtgatatgggcctgacccccaagaacagcarcctcctggctttacattagcagagtactacggtgtcaaaacattcttgcttttttcttcttttcattgacttactaatttgttattcattgttaacagcttccatggctccamaattctccagtcatccagatttaatctggtttatccaagaatgttgcct

SEQ ID NO: 14878 - DNA, 1030 bp, Homo sapiens
  misc_feature 127: w=a or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaaagtcaccggcgttcttgggtttgaggactcagtggggagagccttcggcgcgagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 14879 - DNA, 807 bp, Homo sapiens
  misc_feature 268: k=g or t
  misc_feature 408: n=a, g, c or t
  misc_feature 409: n=a, g, c or t
gtgaaaagcggcccgacctgcttggggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggaatgcggggkatgcttcggctcacacacatcacagacaatgtctgctggtcgtgcatgtatatttgatcacccctcttgaagctttcttcactttaatggtggcagtttcacaaggggagtacaattcaccatgagttgtcatggatttnnttgcataattcaagaaatgctctgtttatgtggtcggctgctttttttgtccgacatcttgacgaggctgcggtgtctgctgctattctccgagcttcgcaatgaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 14880 - DNA, 252 bp, Homo sapiens
gagagaagcgagatttattcctacgtaccgggccgtgctgcttatggcggcgctggagagggggcgctgagctgttggggtgagtacgacctcagggtccaactgggggtagcagaaacccaggggaagggctgagaataagaccaaggctaacgagaagccttctgagtcaaggtgggcactcgtagagctctaggtggggaagaatgcaccccgattccctgccctgggctttttcatacgtctcccgtt

SEQ ID NO: 14881 - DNA, 270 bp, Homo sapiens
agcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaa

SEQ ID NO: 14882 - DNA, 214 bp, Homo sapiens
acttgctgcggaggaccgtgggcagccagggtcggtgaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatg

SEQ ID NO: 14883 - DNA, 736 bp, Homo sapiens
  misc_feature 467: n=a, g, c or t
tcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgntataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtg

SEQ ID NO: 14884 - DNA, 146 bp, Homo sapiens
taggagcagctctgttgcgacataggccgagcagcgaggcccagctccctgaaacaacagtaacctacccctgtgggtcatcatcatgccctccgaccgccaagaagaaggcagccaaaaagaaggaggctgccaaagctcgacag

SEQ ID NO: 14885 - DNA, 284 bp, Homo sapiens
gcagtttatcctgatttcaatttgacaatgtctacatgttcttttaaattacttgctgagttggtgaatttttgtttctgttatttttaaaaactgacaaaatccttctgcttaaaaaaaattcagtgctgtagttttgcttgcagcctgtatcttagcagggaaccctttggaaacccagtctccagagaaagtttgacgggcatcttggcataggctgctgcctggtattactcaaaaagaagggctgttcatttccagcaggtgttaagagctgagtaagg

SEQ ID NO: 14886 - DNA, 331 bp, Homo sapiens
  misc_feature 186: r=a or g
accatgtctattggtaggtaggttattttctttaatgttctgtaaaccagtttttcctgttttatataaaaattattctagcatagacgcagtgatcaaatctcttcactttctctgttggtatgtatcttagtctgttttgtgttgctataacataatacctgagactagataatttataaagaraaaaagtttatttagctcatggttctacaggctgggaatttcaaggtcatggccctggcttctggggagggctttcatacagggttctaacatgaaaaagaaggtaaaaggggaagtggacatgtgcagagagaaacccaaggag

SEQ ID NO: 14887 - DNA, 399 bp, Homo sapiens
  misc_feature 386: s=g or c
accaactctcttgctgacaacaacgagaaaatcttgataccatttagcaaaaagaagtctgtgggggaggcgttggagagtgacggaactgccacggcctgaggcacctggcttccggagcctctggcagcccagagaagtctctgtcttgtcgcccaggctggggtacagtggtgccatctcagctgactgcaacctccgcctccgggttcaagtgattgtcctgcctcagcctcctgagtagctgggattacaggcgcccaccaccatgcctggacgtcccagtgatcgggaggagtgggaagagcttcagctacaaccaggacgtggtgctgctgcttctgacagacggagtcctgttccaccttcagagcgtcacggcgtasgcctcatggggaa

SEQ ID NO: 14888 - DNA, 580 bp, Homo sapiens
  misc_feature 19: r=a or g
  misc_feature 504: n=a, g, c or t
  misc_feature 505: w=a or t
  misc_feature 506: n=a, g, c or t
  misc_feature 507: n=a, g, c or t
  misc_feature 515: n=a, g, c or t
  misc_feature 518: k=g or t
agcgttccctgcggcgtargaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgnwnnaagttctngaktttttatgaagccaatttccctgcaaatgtcatggatgttattgcaagacagaatttcactg

SEQ ID NO: 14889 - DNA, 639 bp, Homo sapiens
  misc_feature 14: s=g or c
  misc_feature 563: n=a, g, c or t
  misc_feature 564: w=a or t
  misc_feature 565: n=a, g, c or t
  misc_feature 566: n=a, g, c or t
  misc_feature 574: n=a, g, c or t
  misc_feature 577: k=g or t
acaggacgtgaaasggaggcggtttgggaagtttagagaccattctccgccgaccaaaacccgtcaaaggattatcagacacgcgggtcggacggtccacatcagccggcagcccgggcgggtcccggggtgcgagcagcgcacttccgtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgnwnnaagttctngaktttttatgaagccaatttccctgcaaatgtcatggatgttattgcaagacagaatttcactg

SEQ ID NO: 14890 - DNA, 189 bp, Homo sapiens
  misc_feature 44: n=a, g, c or t
  misc_feature 62: n=a, g, c or t
tttttttggcagcagcggaagaaggagaccggagggtgtgtgtngggcaaagccggaggagnaggaacaagtacttgttatgtatcataggtactgggaagaatacagcaagggtgcagactatatggactgcttatataggtatctcaacacccagtttattaaaaagaataaattaacagaagcgga

SEQ ID NO: 14891 - DNA, 328 bp, Homo sapiens
ttagtagagacagggtttcaccatgttggccaggatggtctccatctcctgaccttgtgatccgcccacctcggcctcccaaagtgctgcgattacaggtgtgagccaccgcgcccagccctttccttactttttaaaatgaccttcacagccttgaggagtcctggccaggtgtcctgtagaatgtccccaaatctgggtttgtccgaggttttttttcatggttagactggagttacagatactcaaaaagaataccccagaggggaagtgcccttctcatcacatcacatcagtaggtacctgagatacacaacatcactggcga

SEQ ID NO: 14892 - DNA, 277 bp, Homo sapiens
  misc_feature 16: k=g or t
  misc_feature 26: n=a, g, c or t
  misc_feature 27: n=a, g, c or t
  misc_feature 113: m=a or c
  misc_feature 120: r=a or g
  misc_feature 157: n=a, g, c or t
  misc_feature 160: m=a or c
  misc_feature 161: m=a or c
  misc_feature 245: w=a or t
  misc_feature 247: w=a or t
agacaaagcataccakatctcaccanngagtcctaggggactacagaaggaaaaagacaagaggcagtaggatatctgtgtgtcctcccgctgaccacacttcctttagtgamccgattrcctcctcaaagtcgcagacactatgctgcctcccatngcmmtgcccagtgtgtcctggatgctgctttcctgcctcattctcctgtgtcaggttcaaggtgaagaaacccagaaggaactgcccwcwccacggatcagctgtcccaaaggctccaag

SEQ ID NO: 14893 - DNA, 230 bp, Homo sapiens
acatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatctttttttttttttttt

SEQ ID NO: 14894 - DNA, 329 bp, Homo sapiens
  misc_feature 93: y=c or t
  misc_feature 94: w=a or t
  misc_feature 187: n=a, g, c or t
  misc_feature 318: n=a, g, c or t
  misc_feature 319: n=a, g, c or t
tgaatttataagagtggaagatatcaagtctcttactgcccatatagttgaaaacttttataaagcacttgaatcgattgaatatgttcagaywttcaaaggattgaagactaaatatgagcaagaaaaagacagacaaaatcagaaactgaacagtgtaccatctatattgcgtagtaacagattncgcagagatgcaaaagccttggaagaggatgaagaaatgtggtttaatgaagatgaagaagaggaaggaaaagcagttgtggcaccagtggaaaaacctaagccagaagatgattttccagataattatgnnaagtttatgg

SEQ ID NO: 14895 - DNA, 205 bp, Homo sapiens
  misc_feature 53: n=a, g, c or t
  misc_feature 54: n=a, g, c or t
actcggagcggattttttccgcctcctgcgccttcctccctcctcctcctccnnctctcccctccctcctgccagatacctcctggtaggtgtcaatggccagctggtgcgcgcgatgggcttggagcatagcgtggtcaaaaagaccctctggctgtggacaaaataatgaaggacctggaccagtgtagagatggcaaagtgg

SEQ ID NO: 14896 - DNA, 330 bp, Homo sapiens
  misc_feature 121: s=g or c
  misc_feature 240: r=a or g
  misc_feature 256: n=a, g, c or t
  misc_feature 257: n=a, g, c or t
aatctgaagcctgctggacgctggattagaaggcagcaaaaaaagctctgtgctggctggagccccctcagtgtgcaggcttagagggactaggctgggtgtggagctgcagcgtatccasaggccccaggatgcaggccctggtgctactcctctgcattggagccctcctcgggcacagcagctgccagaaccctgccagccccccggagggaggccaaacacagaaaaattaggaargacagccccaaggggnnagaaccaccaccctacacaaagccgtgaggagacagtccctgtgcatctctgcgagtccctgaactcaaaccc

SEQ ID NO: 14897 - DNA, 307 bp, Homo sapiens
  misc_feature 298: s=g or c
aatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagagagctcatgcgtgatcagggagtaaaactcattcccgttttaggccaaacacagaaaaattaggaaggacagccccaagggsccagaacca

SEQ ID NO: 14898 - DNA, 582 bp, Homo sapiens
  misc_feature 2: n=a, g, c or t
  misc_feature 114: y=c or t
  misc_feature 117: k=g or t
  misc_feature 126: r=a or g
  misc_feature 140: r=a or g
anccacccgccgcacgtactaaggaaggcgcacagcccgccgcgcctcggccaaggcttcaacggaccacaccaaaatgccatctcaaatggaacacgccatggaaaccatgaygtktacatttcrcaaattcgctgggrataaaggctacttaacaaaggaggacctgagagtactcatggaaaaggagttccctggatttttggaaaatcaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgcc

SEQ ID NO: 14899 - DNA, 439 bp, Homo sapiens
  misc_feature 10: r=a or g
  misc_feature 366: m=a or c
  misc_feature 367: m=a or c
aaaggaggarggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcmmacaagctaccccagggcccgcatacagtggtcgagagacaatataccccaatgcatccctgctgatccagaa

SEQ ID NO: 14900 - DNA, 2000 bp, Homo sapiens
  misc_feature 846: s=g or c
  misc_feature 1586: k=g or t
  misc_feature 1593: y=c or t
  misc_feature 1595: w=a or t
  misc_feature 1607: y=c or t
  misc_feature 1615: m=a or c
  misc_feature 1620: y=c or t
  misc_feature 1622: k=g or t
  misc_feature 1627: m=a or c
  misc_feature 1629: w=a or t
  misc_feature 1747: r=a or g
  misc_feature 1754: w=a or t
ccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttasggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttkttttttycwatagactttttycagataamatctyckgagtmawaaccagcctggcagtatgatggcctagatgcagagaaaacagctccttggtgaattgataagtaaaggcagaaaagattatatgtcatacctccattggggaataagcataaccctgrgattctwactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaa

SEQ ID NO: 14901 - DNA, 2115 bp, Homo sapiens
  misc_feature 98: r=a or g
  misc_feature 123: y=c or t
  misc_feature 134: s=g or c
  misc_feature 315: r=a or g
  misc_feature 961: s=g or c
  misc_feature 1701: k=g or t
  misc_feature 1708: y=c or t
  misc_feature 1710: w=a or t
  misc_feature 1722: y=c or t
  misc_feature 1730: m=a or c
  misc_feature 1735: y=c or t
  misc_feature 1737: k=g or t
  misc_feature 1742: m=a or c
  misc_feature 1744: w=a or t
  misc_feature 1862: r=a or g
  misc_feature 1869: w=a or t
agaactgagagaggaggggacagagaggtgtcctgggcctgaccccgcccatgagcctgagaagtgctcctgccccgggaagaggctcagcacagaargaggaaggacagcacagctgacagycgtgctcagasagtttctggatcctcggcttatctccacagaggagaacacacaagcagcagagaccatgggaaccctctcagcccctccctgcacacagcgctataatgagaatgatgactcaggctgcggctgtgcacagggcctgggtgctggaagcgggggggagttttcagtatttttttttgtggrggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttasggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttkttttttycwatagactttttycagataamatctyckgagtmawaaccagcctggcagtatgatggcctagatgcagagaaaacagctccttggtgaattgataagtaaaggcagaaaagattatatgtcatacctccattggggaataagcataaccctgrgattctwactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaa

SEQ ID NO: 14902 - DNA, 327 bp, Homo sapiens
  misc_feature 76: y=c or t
  misc_feature 120: s=g or c
  misc_feature 125: r=a or g
  misc_feature 127: r=a or g
  misc_feature 137: y=c or t
  misc_feature 156: k=g or t
agaactgagagaggaggggacagagaggtgtcctgggcctgaccccgcccatgagcctgagaagtgctcctgcccygggaagaggctcagcacagaaggaggaaggacagcacagctgasagccrtrctcaggaagyttctggatcctaggctcakctccacagaggagaacacgcaggcagcagagaccatggggcccctcagcccctccctgcacacagcgcggtagggcatgttgggggtgtaaaagggaaaaatgtgtgaacataggggcaaatttctagaggccctttgacaagacccatttgcccacaatcatttgaggcc

SEQ ID NO: 14903 - DNA, 306 bp, Homo sapiens
  misc_feature 76: y=c or t
  misc_feature 120: s=g or c
  misc_feature 125: r=a or g
  misc_feature 156: k=g or t
  misc_feature 253: n=a, g, c or t
agaactgagagaggaggggacagagaggtgtcctgggcctgaccccgcccatgagcctgagaagtgctcctgcccygggaagaggctcagcacagaaggaggaaggacagcacagctgasagccrtgctcaggaagtttctggatcctaggctcakctccacagaggagaacacgcaggcagcagagaccatggggcccctcagcccctccctgcacacagcgcggtagggcatggtaggggtaaaaggaggncaatttctagaggccctttgacaagacccatttgcccacaatcatttgaggcc

SEQ ID NO: 14904 - DNA, 414 bp, Homo sapiens
  misc_feature 76: y=c or t
  misc_feature 120: s=g or c
  misc_feature 125: r=a or g
  misc_feature 133: r=a or g
  misc_feature 156: k=g or t
  misc_feature 221: s=g or c
  misc_feature 225: r=a or g
agaactgagagaggaggggacagagaggtgtcctgggcctgaccccgcccatgagcctgagaagtgctcctgcccygggaagaggctcagcacagaaggaggaaggacagcacagctgasagccrtgctcagraagtttctggatcctaggctcakctccacagaggagaacacgcaggcagcagagaccatggggcccctctcagcccctccctgcacasagcrcatcacctggaaggggctcctgctcacagccggaagttctggtcctttgggatataggtttcttcaaactcctggtaggtgtcaatggccagctggtgcgcgcgatgggcttggagcatagcgtggtcaaaaagcctggataagggaaccagagcgtacgactgtgtaccagggccacacagccctact

SEQ ID NO: 14905 - DNA, 319 bp, Homo sapiens
  misc_feature 76: y=c or t
  misc_feature 91: y=c or t
  misc_feature 120: s=g or c
  misc_feature 125: r=a or g
agaactgagagaggaggggacagagaggtgtcctgggcctgaccccgcccatgagcctgagaagtgctcctgcccygggaagaggctcagygcagaaggaggaaggacagcacagctgasagccrtgctcaggaagtttctggatcctaggctcatctccacagaggagaacacacaggcagcagagaccatggggcccctctcagcccctccctgcacagagcaccggtgttttctcgtgtgaatgtgcgggcaggtatttttgcccacatctgtatatttgtctattaatgtgatgtatttgagtattgttgtgggg

SEQ ID NO: 14906 - DNA, 504 bp, Homo sapiens
  misc_feature 76: y=c or t
  misc_feature 127: r=a or g
  misc_feature 154: y=c or t
agaactgagagaggaggggacagagaggtgtcctgggcctgaccccgcccatgagcctgagaagtgctcctgcccygggaagaggctcagcacagaaggaggaaggacagcacagctgacagccgtrctcagacagcttctggatcctaggctyatctccacagaggagaacacacaagcagcgtgccaccctttgaacctttgtctcctttggcccctggaaaccctgggaatccaggaaaagtcggccccaagggccccatgggccctaaaggtggcccaggggcccctggagccccaggccccaaaggtgaatcgggagactacaaggccaccaatttgcctatctctacaaataattaaaaaattagccagatgtggtggcacatgcctgtggtcccagttactcaggaggctgaggggggaggatcacttgagtccaggagttctgggctgtagtgcgctatgccgatcgggtgtccgcactaagttcggcatcaatat

SEQ ID NO: 14907 - DNA, 343 bp, Homo sapiens
  misc_feature 324: r=a or g
taacagaaaaggatgaagaaaaaatgatttgtaggcttggagcctaagaatctagggaaatgatgggtgtcatttactgaacaagtgaaaatagagacatgatctgggttaggaggggactttgatctgattttggacatgctattatgtcccatagccaggcagtcaagcaaaaagacctgctaggtatttggacatgcgcaactgaaatttcaatgggaaaacagggctagcaatgtagacttggaacccttcaacacaaaatgaggattgaaaccataaacgtgagccttagggaaaacccacagtagacaaaaagaagaraaaggaggcaggagaagga

SEQ ID NO: 14908 - DNA, 352 bp, Homo sapiens
  misc_feature 270: s=g or c
  misc_feature 282: m=a or c
  misc_feature 340: w=a or t
actattgcggccgccctctgctgcgcctgaagagagaggcgactctacaagcctcacagcatgcactgttactaaaaagacgatgcgtcctcctggagctgagatctgtgtgatcgtgggaaagcgacgaaaaacgaacaaaggaacagtaaatggagtaacttggctagaatatggcagtaactacaaggcatgttctgctctggcacgaagacaacccacctgaggcaccagacacatgagtgaagccatcttggacatcccagtcasagccaaactcamtcctgagtgcatctgcatgatgaacccagcaatcccaaccatggagcaaaggatccawccagtcaaccca

SEQ ID NO: 14909 - DNA, 107 bp, Homo sapiens
aaaagggtgactctttcctgtcccggcctgcgtggtgtgggcttgtgggtctttgagacccgaaaattgagagcgttttcgggtctcaaagacccacaagccctatc

SEQ ID NO: 14910 - DNA, 140 bp, Homo sapiens
tatgaggattaaataagcagatgtacataaacatggttggaagagtgcctcacacatgatgggtgctcagttgatgtcattcctctctgccttcctccttgaaagttttagaaaaagactcagtggaggagagagttcac

SEQ ID NO: 14911 - DNA, 267 bp, Homo sapiens
  misc_feature 233: w=a or t
aaagacactaagattttacatggacatcttgaaaatgttctttgcattttatttcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagawagataaacagacacagaatgatctggttacagga

SEQ ID NO: 14912 - DNA, 172 bp, Homo sapiens
atatctgtataatgggcataaaaagactgctcccctcatctgatggctatgataaataaatgagatgatctaggtgaagcacttagagaaatgccagctcacagagcgtgctcaataaacattagccatcatcattgcatcaccagcactaccactgccgccatcatcatca

SEQ ID NO: 14913 - DNA, 258 bp, Homo sapiens
  misc_feature 201: m=a or c
  misc_feature 218: r=a or g
  misc_feature 256: y=c or t
agcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaggagamtcacttgaacccagaargtggaggttgcagtgacccgagatcatgccactgcatycc

SEQ ID NO: 14914 - DNA, 242 bp, Homo sapiens
  misc_feature 200: k=g or t
aaatctcctccctgaatcgcgcacagcgctgcagatcccactgctccgacatgcgggccgaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttkcgcagagttgttaagaaaaaagagaaacccgcgctctccggg

SEQ ID NO: 14915 - DNA, 466 bp, Homo sapiens
  misc_feature 104: y=c or t
gccgggttccgtgtgtctatgtcaatgtgtctgtccttcactcctccattgtctgccgccactgctgctgctgctgctgctgccgctgctgctgcacgaatcgycgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaaattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatc

SEQ ID NO: 14916 - DNA, 169 bp, Homo sapiens
  misc_feature 86: n=a, g, c or t
agagacagggccgtgcaggcagagtggtgttcagggcagggctgggagcaggtgcctgagctgaggcaggtggggagaggggagangtggtccagtctagggtacttggttatcagccctttcatttgttctctaaaaccagggtgaaaaagagaacagacttaacggg

SEQ ID NO: 14917 - DNA, 161 bp, Homo sapiens
tagacaggaaaaaaaggaaggcgtgagggcgggcagcagcgacaggatgcttgtttttcgctctaccaaagtcgtctgaaggcgagacagcgggcccagggcagcagcgacaggatgcttgtttttcgctctaccaaagtcgtctgaaggcgagacagcgg

SEQ ID NO: 14918 - DNA, 472 bp, Homo sapiens
  misc_feature 2: n=a, g, c or t
anaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtaatagagagcaggttcgacttcaacgctg

SEQ ID NO: 14919 - DNA, 178 bp, Homo sapiens
  misc_feature 2: n=a, g, c or t
anaatactggcgtcgctggcgccgccttctcacactttcaggctctgatcgcggccgcagtttttccttttttcttctgccgtcgccttctctgcctcttctcatcctttctcgctctgctgctctgcagtgtgacgaggaaagccgaagagatgaggcggcagcagaagctaaagca

SEQ ID NO: 14920 - DNA, 368 bp, Homo sapiens
  misc_feature 92: n=a, g, c or t
  misc_feature 202: r=a or g
  misc_feature 203: s=g or c
agagagtggggacgtccggcttcggagcgggagtgttcgttgtgccagcgactaaaaagaggtgagagcgggtcgcggaggccgcacctggnttagaggcagagctgtgggaggcgcgcacttgcgagcgaccgaaacccaagcggggagcattcgagtggagcccgcgctgggtgggagggcggggagtgaagaccctggrstgtggtcagaccgagctgggcgagtaacggcttgaggtgcggcggagcctaactagggacaggtatggtctcggtcagggactggaggcggcttggatacagatccgaggaggaggcggcctcttccgtagtggttgctgaagggctatggaaatgataggcaag

SEQ ID NO: 14921 - DNA, 526 bp, Homo sapiens
  misc_feature 10: s=g or c
gcggcgtgasggttgcttgggccagaaggttctctggtggaggcgctcttcctggtgtcccgcccagtaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatattaactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgg

SEQ ID NO: 14922 - DNA, 609 bp, Homo sapiens
tttgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatattaactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgg

SEQ ID NO: 14923 - DNA, 126 bp, Homo sapiens
  misc_feature 92: s=g or c
tccttggagtccacagcatccaccgccggagcctcgccttcctttctccctctgcagacacaacgagacacaaaaagagaggcaacccctasaccaccgcgaaggacccatctgcaccatgaccga

SEQ ID NO: 14924 - DNA, 444 bp, Homo sapiens
gtctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacaggctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtctggtgctggtagaaacatttgactctgatgtctattttattctacataagagcca

SEQ ID NO: 14925 - DNA, 434 bp, Homo sapiens
  misc_feature 189: k=g or t
  misc_feature 348: w=a or t
tgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtctttttkgtgtgaacttgtgttgtactctgtagaaaattatggattttactttaatggtttaaaaaaaggcaaggagagcccttgtcgcttttcttacctaatcacagagtttgtgtagtgaatttaaaaagaaaaaaaaattgttataagtttggagcaagggawtatgtgtttcaaaggaatctccttcctttttttgtgtgtttttccttttgtcccaatggggaacctaaatctgttttaattgcaca

SEQ ID NO: 14926 - DNA, 1428 bp, Homo sapiens
  misc_feature 325: r=a or g
  misc_feature 625: n=a, g, c or t
  misc_feature 626: w=a or t
  misc_feature 627: r=a or g
  misc_feature 644: r=a or g
  misc_feature 645: n=a, g, c or t
  misc_feature 646: n=a, g, c or t
  misc_feature 692: r=a or g
  misc_feature 699: s=g or c
  misc_feature 810: k=g or t
  misc_feature 813: w=a or t
  misc_feature 814: y=c or t
  misc_feature 822: k=g or t
  misc_feature 829: y=c or t
  misc_feature 1025: n=a, g, c or t
  misc_feature 1131: m=a or c
  misc_feature 1132: m=a or c
  misc_feature 1138: m=a or c
  misc_feature 1170: m=a or c
  misc_feature 1171: m=a or c
gtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggcgctrtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaagggttctccaaaaaatgtggaatcctttgcatctatgctgagacattctcctcttacacagatgggacctgcaaaggataaactggtcattggacggatctttcatattgtggagaanwrtctgtacatagattttrnntggaaagtttcattgtgtatgtagaagaccagaagtggatggagaraaatacsagaaagaagtcatggcggcgctgtgtcggacccgtgctgtggctgccgagagccattttctgcgagtgtttctcttcttcaggccctttcggggtgtaggcactgagagtkgawycgaaaagkggtagtyccaatgccaaggagcctaagacgcgcgcaggcggtttcgcgagcgcgttggagcggcactcggagcttctacagaaggtggagcccctacagaagggttctccaaaaaatgtggaatcctttgcatctatgctgagacattctcctcttacacagatgggacctgcaaaggataaactggtcattggacggatctntcatattgtggagaatgatctgtacatagattttggtggaaagtttcattgtgtatgtagaagaccagaagtggatggagagaaataccagaaaggaaccagggtmmggttgmggctattagatcttgaacttacgtctaggttmmtgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaataaaagctataattatagataactcttattagaattttctttagcaatat

SEQ ID NO: 14927 - DNA, 1341 bp, Homo sapiens
  misc_feature 120: n=a, g, c or t
  misc_feature 122: n=a, g, c or t
  misc_feature 123: n=a, g, c or t
  misc_feature 1213: s=g or c
  misc_feature 1221: n=a, g, c or t
  misc_feature 1313: n=a, g, c or t
ctctttggcaagtttgggcctgccttaagtgtgaaagtaatgactgatgaaagtggaaaatccaaaggatttggatttgtaagctttgaaaggcatgaagatgcacagaaagctgtggangnnatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtastacaagcncaccaagctaaagaggctgcccagaaagcagttaacagtgccaccggtgttccaactgtttaaaattgatcagggaccatgaaaagaacttngtgcttcaccgaagaaaaatatctaaac

SEQ ID NO: 14928 - DNA, 1340 bp, Homo sapiens
agagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttttgcacccca

SEQ ID NO: 14929 - DNA, 1186 bp, Homo sapiens
  misc_feature 333: k=g or t
  misc_feature 706: y=c or t
  misc_feature 824: y=c or t
  misc_feature 825: w=a or t
  misc_feature 914: y=c or t
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaaytggccgaggagaagcgcgagggctacgagcgtctcctgaagatgcaaaaccagcgtggcggccgcgctctcttccaggacatcaagaagccagctgaagatgagtggggtaaaacccywgacgccatgaaagctgccatggccctggagaaaaagctgaaccaggcccttttggatcttcatgccctgggttctgcccgcacggaccyccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgg

SEQ ID NO: 14930 - DNA, 1158 bp, Homo sapiens
  misc_feature 328: r=a or g
  misc_feature 336: k=g or t
  misc_feature 732: n=a, g, c or t
  misc_feature 739: y=c or t
  misc_feature 742: k=g or t
  misc_feature 746: y=c or t
  misc_feature 953: n=a, g, c or t
  misc_feature 954: n=a, g, c or t
  misc_feature 955: n=a, g, c or t
  misc_feature 1079: n=a, g, c or t
  misc_feature 1133: n=a, g, c or t
aagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatagaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcarccgggctkcccgcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacagtttgctgtggnaaaaggytckgcgygtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgnnnaggtgacaggcatcgactgggcccccgagagtaaccgtattgtgacctgcggcacagaccgcaacgcctacgtgtggacgctgaagggccgcacatggaagcccacgctggtcatcctgcgatnaccggggtgcccgctgcgtgcgctgggcccccaacgagaacagtttgctgtggnaaaaggctctcgtgtgatctccatc

SEQ ID NO: 14931 - DNA, 1056 bp, Homo sapiens
  misc_feature 98: s=g or c
  misc_feature 821: n=a, g, c or t
aaaaaattgagcccgcagcctcccgcttcgctctctgctcctcctgttcgacagtcagccgcatcttcttttgcgtcgccagccgagccacatcgctsagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgacgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtcccccactgccnaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacg

SEQ ID NO: 14932 - DNA, 1034 bp, Homo sapiens
  misc_feature 883: k=g or t
  misc_feature 911: k=g or t
  misc_feature 1028: r=a or g
atttttttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagatggggctggtagagggtataacagcattggcagaggagctggctttgagaggatgaggcgtggtgcttatggtggaggctatggaggctatgatgattacaatggctataatgatggctatggatttgggtcagakagatttggaagagacctcaattactgtktttcaggaatgtctgatcacagatacggagatggtgggtccagtttccagagcaccacagggcactgtgtacacatgagggggttaccttacagagccactgagaatgatatttatratttct

SEQ ID NO: 14933 - DNA, 968 bp, Homo sapiens
  misc_feature 188: v=a or c or g
  misc_feature 478: s=g or c
  misc_feature 837: s=g or c
aaacccctttgtaatctgtataaggtccacaccccgggagctgagtgattgcagaaactggccttccatctctctcagacaccaagctgcagatccaggtcactttgtaggtcaccacctagaggggaggaagacctcgctttggagagtgggaataaaacgctcgtggaaaagggtacacgtgagtvtctcattacacgaaaaacctcaggaagtaggatggacgtctttctggctgacctgaaacagaaagtgtaaaccaggcaagccataggtgggagctggagttctttttctaagagggctcttttccttctctctccttttctcaattaggcttttctgggaaagtgaggccaccatggctctggagaagtctcttgtccggctccttctgcttgtcctgatactgctggtgctgggctgggtccagccttccctgggcaaggaatcccgggccaagaaattccagcggcasatatggactcagacagtcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccagtaccccaactgtgcataccggaccagcccgaaggagagacacatcattgtggcctgtgaagggagcccatatgtgccagtccactttgatgcttctgtggaggactctacctaaggtcagascagcgagataccccacctccctcaacctcatcctctccacagctgcctcttccctcttccttccctgctgtgaaagaagtaactacagttagggctcctattcacacacacatgcttccctttcctgactc

SEQ ID NO: 14934 - DNA, 964 bp, Homo sapiens
  misc_feature 184: v=a or c or g
  misc_feature 474: s=g or c
  misc_feature 833: s=g or c
tgatgtttcgatgagccatttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgtgagtvtctcattacacgaaaaacctcaggaagtaggatggacgtctttctggctgacctgaaacagaaagtgtaaaccaggcaagccataggtgggagctggagttctttttctaagagggctcttttccttctctctccttttctcaattaggcttttctgggaaagtgaggccaccatggctctggagaagtctcttgtccggctccttctgcttgtcctgatactgctggtgctgggctgggtccagccttccctgggcaaggaatcccgggccaagaaattccagcggcasatatggactcagacagtcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccagtaccccaactgtgcataccggaccagcccgaaggagagacacatcattgtggcctgtgaagggagcccatatgtgccagtccactttgatgcttctgtggaggactctacctaaggtcagascagcgagataccccacctccctcaacctcatcctctccacagctgcctcttccctcttccttccctgctgtgaaagaagtaactacagttagggctcctattcacacacacatgcttccctttcctgactc

SEQ ID NO: 14935 - DNA, 929 bp, Homo sapiens
  misc_feature 352: s=g or c
  misc_feature 540: w=a or t
  misc_feature 544: w=a or t
  misc_feature 906: s=g or c
attcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttcgaaccaggtggaggagcagtacgaagaagaagaggaagcccaggaggaagctgcagaagtccatgaggaagttcatgaaccagaggaagttcaagaagaggagaaaccgagasccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagwgccwgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggasagcagaggattcgtgcagagaag

SEQ ID NO: 14936 - DNA, 927 bp, Homo sapiens
gaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 14937 - DNA, 913 bp, Homo sapiens
  misc_feature 203: n=a, g, c or t
  misc_feature 204: n=a, g, c or t
  misc_feature 330: k=g or t
  misc_feature 372: r=a or g
  misc_feature 390: k=g or t
  misc_feature 394: s=g or c
gaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattnncagaagcttcacaagactgcatatataaggggctggctgtagctgcagctgaaggagctgaccagccagctgacccctcacactcacctagccaccatggacatcgccatccaccaccccttcttkcctttccactcccccagccgcctctttgaccagttcttcggrgagcacctgttggagtckgatsttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 14938 - DNA, 911 bp, Homo sapiens
attgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 14939 - DNA, 903 bp, Homo sapiens
  misc_feature 268: k=g or t
  misc_feature 408: n=a, g, c or t
  misc_feature 409: n=a, g, c or t
gtgaaaagcggcccgacctgcttggggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggaatgcggggkatgcttcggctcacacacatcacagacaatgtctgctggtcgtgcatgtatatttgatcacccctcttgaagctttcttcactttaatggtggcagtttcacaaggggagtacaattcaccatgagttgtcatggatttnnttgcataattcaagaaatgctctgtttatgtggtcggctgctttttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 14940 - DNA, 896 bp, Homo sapiens
  misc_feature 518: k=g or t
  misc_feature 763: w=a or t
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctgkcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcwttccttctgtagctcaggagagcacccctccaccccatttgctcgcagtatcctagaatctttgtgctctcgctgcagttccctttgggttccatgttttccttgttccctcccatgcctagctggattgcag

SEQ ID NO: 14941 - DNA, 894 bp, Homo sapiens
  misc_feature 86: m=a or c
  misc_feature 250: s=g or c
  misc_feature 432: s=g or c
  misc_feature 714: n=a, g, c or t
  misc_feature 715: n=a, g, c or t
  misc_feature 726: k=g or t
  misc_feature 727: w=a or t
ctagtgcgttacttacctcgactcttagcttgtcggggacggtaaccgggacccggtgtctgctcctgtcgccttcgcctcctacmctaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgasaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcasatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggannttggtgtggakwctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgta

SEQ ID NO: 14942 - DNA, 893 bp, Homo sapiens
gaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 14943 - DNA, 874 bp, Homo sapiens
  misc_feature 393: y=c or t
  misc_feature 469: n=a, g, c or t
  misc_feature 512: y=c or t
  misc_feature 513: w=a or t
  misc_feature 602: y=c or t
ataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaaytggccgaggagaagcgcgagggctacgagcgtctcctgaagatgcaaaaccagcgtggcggccggcgctctcttcnaggacatcaagaagccagctgaagatgagtggggtaaaacccywgacgccatgaaagctgccatggccctggagaaaaagctgaaccaggcccttttggatcttcatgccctgggttctgcccgcacggaccyccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgg

SEQ ID NO: 14944 - DNA, 861 bp, Homo sapiens
  misc_feature 442: m=a or c
  misc_feature 458: y=c or t
  misc_feature 469: w=a or t
  misc_feature 549: s=g or c
  misc_feature 551: y=c or t
  misc_feature 556: w=a or t
agagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaamgaagacactgaagaayatcacctaagwgattattttgaacagtatggaaaaactgaagtgattgaaatcatgactgaccaaggcagtggcaagaaaaggggctttgscytttgwaacctttgatgatcatgactccgtggataagactgtcattcagaaataccatactgtgaatggccacaactgtgaaattaggaaaggcctgtcaaagcaagagatgtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctc

SEQ ID NO: 14945 - DNA, 855 bp, Homo sapiens
  misc_feature 196: w=a or t
cttttgcatccctaccccgacactgcgggttgtcacaacggcaccctcccgctttctctctgcctcggatttagtcgtgactgtgtgtcttcggccgtggtgcagcttcaggcctctcccgcatctactctctcacgcttccgctgcggcctgagggagggcggcgggcggaccacggaccggggttggcatacgwatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacgg

SEQ ID NO: 14946 - DNA, 853 bp, Homo sapiens
gagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactca

SEQ ID NO: 14947 - DNA, 842 bp, Homo sapiens
  misc_feature 8: n=a, g, c or t
  misc_feature 9: n=a, g, c or t
  misc_feature 266: k=g or t
  misc_feature 436: n=a, g, c or t
aagtcgtnncgggagggagacgcagaggcggacaagatggcggcggcagctgtacagggcgggagaagcggtggtagcggaggctgtagtggggctggtggtgcttccaactgcgggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaatkgacaagatggcggcggcagctgtacagggcgggagaagcggtggtagcggaggctgtagtggggctggtggtgcttccaactgagggacaggaagtggccgtagcggcttgttggataagtggaagatagatgataagcctgtaaaaatggacaagatggcggcggcagntgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatcttt

SEQ ID NO: 14948 - DNA, 832 bp, Homo sapiens
  misc_feature 489: r=a or g
  misc_feature 818: k=g or t
gccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggraagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggkctcttaaacctgat

SEQ ID NO: 14949 - DNA, 810 bp, Homo sapiens
  misc_feature 29: s=g or c
  misc_feature 719: r=a or g
tcatactcacaacgctgccgccgcgctcsgtgggcaactcctactactgctgggctgggctgggctgggctgggctgcgccggagctcgcctgcacagatcagctccggagaggggaaaaccacgctcctcggaccaagcctcgggagctaggtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaaatcctcatgtttctgcttcatattttgaaaartaacaattaaaacagacagctgtactgaggtaagatatgtgtgaccttcttggaatgaatattgtctttagaataccctttgataagctga

SEQ ID NO: 14950 - DNA, 806 bp, Homo sapiens
  misc_feature 428: k=g or t
  misc_feature 673: w=a or t
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctgkcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcwttccttctgtagctcaggagagcacccctccaccccatttgctcgcagtatcctagaatctttgtgctctcgctgcagttccctttgggttccatgttttccttgttccctcccatgcctagctggattgcag

SEQ ID NO: 14951 - DNA, 789 bp, Homo sapiens
  misc_feature 250: s=g or c
  misc_feature 432: s=g or c
  misc_feature 660: y=c or t
  misc_feature 718: n=a, g, c or t
ctagtgcgttacttacctcgactcttagcttgtcggggacggtaaccgggacccggtgtctgctcctgtcgccttcgcctcctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgasaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcasatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggygagttttcagaggcccgtgaggacatggctgcccttgagaaggattatgaggaggttngtgttggattctgttgaaggagagggtgaggaagaaggagaggaatactaaagttaaaacgtcacaaaggt

SEQ ID NO: 14952 - DNA, 780 bp, Homo sapiens
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaac

SEQ ID NO: 14953 - DNA, 766 bp, Homo sapiens
  misc_feature 724: s=g or c
agtgaactagcgacagtgggggtgtgcgcagggatgcaggcagctaggctcccccactggccaggcagttggtatgctccaggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatstgtcgaccccatttcctaccacctttgtggccgaccccaagc

SEQ ID NO: 14954 - DNA, 761 bp, Homo sapiens
  misc_feature 94: r=a or g
gcgttctcgctgtgcactcttattctgcgcctgcgcgcggctacagcacggttcgtttttcctttagtcaggaaggacgttggtgttgaggttrgcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacgg

SEQ ID NO: 14955 - DNA, 756 bp, Homo sapiens
  misc_feature 234: r=a or g
  misc_feature 306: w=a or t
  misc_feature 316: k=g or t
  misc_feature 324: k=g or t
  misc_feature 684: s=g or c
  misc_feature 731: n=a, g, c or t
aagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatagaccaaggtgcacgagctcaaggagcacaacgggcaggtgacaggcatcgactgggcccccgagagtraccgtattgtgacctgcggcacagaccgcaacgcctacgtgtggacgctgaagggccgcacatggaagcccwcgctgctcckgcgcggakccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggstgcccgctgcgtgcgctgggcccccaacgagaacagtttgctgtggnaaaaggctctcgtgtgatctccatc

SEQ ID NO: 14956 - DNA, 745 bp, Homo sapiens
  misc_feature 16: n=a, g, c or t
  misc_feature 159: k=g or t
  misc_feature 160: k=g or t
atgtgtagcggcagtngccgccggcggacagtctgagcccgacgatgaggccggggacgggagctgagcgtggaggcctcatggtgagtgaaatggagagccatcctccctcgcagggtcctggggacggggagcggagattgtccggctcaagcctckkctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcac

SEQ ID NO: 14957 - DNA, 744 bp, Homo sapiens
  misc_feature 140: n=a, g, c or t
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaagccncgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 14958 - DNA, 741 bp, Homo sapiens
  misc_feature 2: r=a or g
  misc_feature 99: y=c or t
  misc_feature 101: m=a or c
  misc_feature 137: s=g or c
  misc_feature 138: m=a or c
  misc_feature 158: m=a or c
  misc_feature 216: y=c or t
  misc_feature 217: s=g or c
  misc_feature 242: m=a or c
  misc_feature 714: r=a or g
artggccgcagtggccgcaaggacccggacctcagggaggcctccgcacgaagtcggaccgtcctgcgcgccgcctaagtccaggcttgcccgtctgcygmcaggcaacaacgcccctagtctctccgttcgggaasmcgcgtggccctgcctgccamccaccggaagtgagggcaaatggcaacagcggctctggaattctatacaggcattgcysaggacacctaagatgacgcaatctmcgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggraagccatcagcagagactctatgaata

SEQ ID NO: 14959 - DNA, 740 bp, Homo sapiens
  misc_feature 61: r=a or g
tggaacagatttcaaaaaaaaaccccacaatctagggtgggaacaaggaaggaaagatgtraataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggcaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccag

SEQ ID NO: 14960 - DNA, 739 bp, Homo sapiens
  misc_feature 615: s=g or c
  misc_feature 616: y=c or t
  misc_feature 617: s=g or c
  misc_feature 619: n=a, g, c or t
ggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgsyscnacctgtaagaacagaaaatcgtcttatagttgagaatttatcctcaagagtcagctggcaggtttgttgaaatacagttttgagttattttgatgtggctttttaaaaaagttaatgggt

SEQ ID NO: 14961 - DNA, 732 bp, Homo sapiens
  misc_feature 408: n=a, g, c or t
  misc_feature 637: k=g or t
  misc_feature 644: m=a or c
  misc_feature 645: k=g or t
  misc_feature 646: n=a, g, c or t
  misc_feature 647: n=a, g, c or t
  misc_feature 687: n=a, g, c or t
  misc_feature 688: n=a, g, c or t
  misc_feature 689: r=a or g
  misc_feature 704: n=a, g, c or t
ttccagtacctataggtcgcgtaaacaactccctttctccagctctgggctccgcggccccccgggggacagctccttcagtctcgaggctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggntgcctacatcagacaggaccacatctaggacctcctcctcctcctcctccgactcctccaccaacctgcataggccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccackagcccamknnagagcctgtcgggagaagaccagactctttacttgcagtnnraccagaggtgggaangatggtgggattgtgtacctttctaaga

SEQ ID NO: 14962 - DNA, 702 bp, Homo sapiens
  misc_feature 340: m=a or c
  misc_feature 344: m=a or c
  misc_feature 348: m=a or c
  misc_feature 352: r=a or g
  misc_feature 474: m=a or c
  misc_feature 475: n=a, g, c or t
acattcccgggccagcttctgtactgccaggtccgggtcggcggctgcactgcggatgagaccggtgcgactcatgaaggtgttcgtcacccgcaggatacccgccgaggctgtgaggtggagcagtgggactcggatgagcccatccctgcgaaggagctagagcgaggtgtggcgggggcccacggcctgctctgcctcctctccgccacgtggacaagaggatcctggatgctgcaggggccaatctcaaagtcatcagcaccatgtctgtgggcatcgaccacttggctttggatgaaatcaagaagcgtgggatccgagttggctacaccccagmtgtmctgmcagrtccgggtcggcggctgcactgcggatgagaccggtgcgactcatgaaggtgttcgtcacccgcaggatacccgccgagggtagggtcgcgctcgcccgggcggcagactgtgaggtggagcmntgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacaga

SEQ ID NO: 14963 - DNA, 692 bp, Homo sapiens
  misc_feature 32: n=a, g, c or t
  misc_feature 33: n=a, g, c or t
gtactaagactagggttgggccgagagtcggnnccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagaaggacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggac

SEQ ID NO: 14964 - DNA, 692 bp, Homo sapiens
  misc_feature 55: k=g or t
  misc_feature 217: r=a or g
  misc_feature 326: w=a or t
  misc_feature 360: r=a or g
  misc_feature 364: y=c or t
  misc_feature 366: r=a or g
  misc_feature 478: n=a, g, c or t
  misc_feature 612: n=a, g, c or t
  misc_feature 613: n=a, g, c or t
  misc_feature 614: w=a or t
  misc_feature 657: m=a or c
  misc_feature 660: m=a or c
gacaacagccacacgtgatcggccaacactgagtcttacctcgttgtggcgtcakaaccgccgtcgctcgctcccttctcggcagtggtacctgttcccggtgtccctgaggacgtgcgggccaggtacggccccttcttgatgcagaaaatggttgtttgcggggccaagtgttgcggcgacgcacctcacgtcgagaatcgggaggaggagactrcaaggataggcccaggagtaatggagtccaaagagaacgagcgttaaacaatctcatcgtggaaaatgtcaaccaggaaaatgatgaaaaagatgaaaaggagcaagtwgctaataaaggggagcccttggccctacctttgratgytrgtgaatactgtgtgcctagaggaaatcgtaggcggttccgcgttaggcagcccatcctgcagtatagatgggatatgatgcataggcttggagaaccacaggcaaggatganagaagagaatatggaaaggattggggaggaggtgagacagctgatggaaaagctgagggaaaagcagttgagtcatagtctgcgggcagtcagcactgacccccctcaccatgaccatcatgatgagttttgcnnwatgccctgaatcctgatggtttccctaaagttattacggaaamagmcccctgctttcgaatttacatgttcatgatgt

SEQ ID NO: 14965 - DNA, 689 bp, Homo sapiens
  misc_feature 140: n=a, g, c or t
  misc_feature 373: r=a or g
  misc_feature 490: y=c or t
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaagccncgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcagcactgtgacgaggctaaggccgtggatatcccccacatggacatcgaggcgctgaaaaaactcaacaagaataraaaactggtcaagaagctggccaagaagtatgatgcgtttttggcctcagagtctctgatcaagcagattccacgaatcctcggcccaggtttaaataaggcaggaaagttcccttycctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 14966 - DNA, 683 bp, Homo sapiens
  misc_feature 388: s=g or c
  misc_feature 641: m=a or c
  misc_feature 644: n=a, g, c or t
agctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcascctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcmtcntacgccttcgcgccgctgtcactcatcgtgcccctcagc

SEQ ID NO: 14967 - DNA, 681 bp, Homo sapiens
  misc_feature 24: s=g or c
  misc_feature 31: n=a, g, c or t
  misc_feature 45: n=a, g, c or t
  misc_feature 47: m=a or c
  misc_feature 78: y=c or t
  misc_feature 79: k=g or t
  misc_feature 152: r=a or g
  misc_feature 154: r=a or g
agtgagtgtggaggcgcggacgcsggcgganctggaactgctgcngmtgctgccgccgccggaggaaccttgatcccyktgctccggacaccccgggcctcgccatggctgaccagctgactgaggagcagattgcaggggcttgatatcartrgctgcaggacgagcccaactctctctcccagcttcagccaggttggcttagaagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcg

SEQ ID NO: 14968 - DNA, 670 bp, Homo sapiens
  misc_feature 137: s=g or c
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaasgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 14969 - DNA, 655 bp, Homo sapiens
  misc_feature 7: n=a, g, c or t
  misc_feature 334: s=g or c
  misc_feature 335: s=g or c
  misc_feature 427: s=g or c
agtcttngtgtgtccggaattggtgggttcttggtctcactgagttctagaatgaagctgcagaccctcgcagtgagtgttacagctcttaagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctagsstgacgctcacccacacctgcaacacaccctgggcagagagctccgctaagggcgtccactccttctacaacaacatcagcgggctgactgasttctagaatgaagctgcagaccctcgcattctggtcagcctatgtgccatgccagacccaggaccgggatgccccgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcct

SEQ ID NO: 14970 - DNA, 652 bp, Homo sapiens
  misc_feature 171: r=a or g
  misc_feature 333: r=a or g
  misc_feature 436: s=g or c
  misc_feature 555: k=g or t
  misc_feature 585: s=g or c
  misc_feature 612: s=g or c
  misc_feature 616: k=g or t
  misc_feature 633: s=g or c
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgasaaggaggtcccccacggcccttcaggatgaaagctgcgcgtgctgaccttggccgtgctcttcctgacggcctaaagctccttgacaactgggacagcgtgacctccaccttcagcaakctgcgcgaacagctcggccctgtgacccasgagttctgggataacctggaaaaggasacakagggcctgaggcaggasatgagcaaggatctggagg

SEQ ID NO: 14971 - DNA, 646 bp, Homo sapiens
  misc_feature 305: r=a or g
  misc_feature 362: n=a, g, c or t
  misc_feature 612: s=g or c
caagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcgaaaatgaaacaatctaataatgaagctaacttaagagaagaagttttgaagaatttagctactgcatatgacaactttgttgaacttgtagctaatttgaaggaaggcacaaagttttacaatgagttgactgaratcctggtcaggttccagaacaaatgcagtgatatagtttttgcacggaagacaganagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccastccatcacaaacgcctggctcagctcctccccca

SEQ ID NO: 14972 - DNA, 645 bp, Homo sapiens
  misc_feature 318: y=c or t
  misc_feature 321: r=a or g
  misc_feature 324: s=g or c
  misc_feature 391: k=g or t
  misc_feature 393: s=g or c
  misc_feature 445: k=g or t
  misc_feature 596: n=a, g, c or t
cagttactttcaggctcggggagtgaaggcctcgttgagagaaggtctcattcggtgttttgggcaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctcgytgrgasaaggtctcattcggtgttttgggaagagagtcgtgtgggcccaggtatcgtagcggcgacacgagakasacgggcggtgtgacagccttccactacctgcacgagtgtattggtaacgttkgggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccangttggagggcctaccaccaagctggtacaaggtgttcgacccttcctgc

SEQ ID NO: 14973 - DNA, 639 bp, Homo sapiens
  misc_feature 203: s=g or c
  misc_feature 439: s=g or c
  misc_feature 440: y=c or t
cacctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactsyttcagttcgaggacatgcaggaaatcattcagaactttgtgcgggttcatgtggatgcccctggaatggaagagggagccctgtgttccctttgggatatcagtacccatctctggaccagcttgcagacatgatcccttgcgtcctgcagtacctaaatttctctacaataattggagtggtgttggagctggagcct

SEQ ID NO: 14974 - DNA, 631 bp, Homo sapiens
  misc_feature 137: r=a or g
  misc_feature 138: r=a or g
  misc_feature 182: n=a, g, c or t
  misc_feature 201: n=a, g, c or t
  misc_feature 356: m=a or c
accgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgrrggagaccgctgaagccgacgtagcttctctgaacagacgcatcnagctggttgaggaagagtnggatcgtgcccaggagcgtctggcaacagctttgcagaagctggaggaagctgagaagagcagatgagagtgagagaggcatgaaagtcattgagagtcgagcccaaaaagatgaagaaaaaatggaaattcaggagatccaactgaaagaggcmaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcgga

SEQ ID NO: 14975 - DNA, 631 bp, Homo sapiens
  misc_feature 81: n=a, g, c or t
  misc_feature 148: s=g or c
  misc_feature 250: r=a or g
  misc_feature 253: s=g or c
  misc_feature 289: r=a or g
  misc_feature 309: y=c or t
  misc_feature 310: k=g or t
  misc_feature 348: y=c or t
  misc_feature 463: r=a or g
aacactcggaggtggcggtggatcttactccttccagccagtgaggatccagcaacctgctccgtgcctcccgcgcctgtnggttggaagtgacgaccttgaagatcggccggttggaagtgacgaccttgaagatcggcgggcgcasggggccgagggggcgggtctggcgctaggtccagcccctgcgtgccgggaaccccagaggaggtcgcagttcagcccagctgaggcctgtctgcagaatccrcascaaccagcaccatgcccatgacactggggtactggracatccgcgggctggcccaykccatccgcctgctcctggaatacacagactcaagctaygaggaaaagaagtacacgatgggggacgctcctgattatgacagaagccagtggctgaatgaaaaattcaagctgggcctggactttcccaatctgccctacttgattgatgggrctcacaagatcacccagagcaacgccatcctgcggtacattgcccgcaagcacaacctgtgcggggaatcagaaaaggagcagattcgcgaagacattttggagaaccagtttatggacagcgtatgcagctggccaactctgctatgacccagattttgtagtcccc

SEQ ID NO: 14976 - DNA, 629 bp, Homo sapiens
  misc_feature 230: s=g or c
  misc_feature 313: s=g or c
  misc_feature 316: s=g or c
  misc_feature 317: s=g or c
  misc_feature 319: s=g or c
  misc_feature 321: w=a or t
aggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcsactgtgagtgtctgggcggcgggcgcatctcccaccagagtcaggacaagaagattcacgtgtacggctattccatggcggtsgcssascwcgctctcattcctgatgtggacatcgactccgacggcgtcttcaagtatgtgctgatccgagtccactcggctccccgctccggggctccggctgcagagagcaaggagatcgtgcgcggctacaacggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtacccc

SEQ ID NO: 14977 - DNA, 618 bp, Homo sapiens
  misc_feature 338: s=g or c
atgtgtagcggcagtggccgccggcggacagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccagagtaaatagtatggatgtagcagcaggtacagcatctsgtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcac

SEQ ID NO: 14978 - DNA, 616 bp, Homo sapiens
  misc_feature 7: n=a, g, c or t
  misc_feature 25: s=g or c
  misc_feature 26: s=g or c
gtgccanccgggtctctcgcgcgassatttagtctgaggcgaacttcggagcggccggtactgttgaaagcgacaagtggaggcgccgctctagcggccgggactctgaactatggcggctagtgatacagagcgagatggactagcccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccag

SEQ ID NO: 14979 - DNA, 597 bp, Homo sapiens
  misc_feature 464: n=a, g, c or t
agtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagcnagaaagctatctctgagttgccctgatttgaagggaaaagggatgatgggattgaaggggcttctaattacccagatatggaaacagaagacaaaattgtaagccagagtcaacaaattaaataaattacccc

SEQ ID NO: 14980 - DNA, 593 bp, Homo sapiens
  misc_feature 108: s=g or c
  misc_feature 110: n=a, g, c or t
  misc_feature 116: k=g or t
  misc_feature 119: s=g or c
  misc_feature 497: n=a, g, c or t
cccctccgctccaggcttccttctgcaacaggcgtgggtcacgctctcgctcggtctttctgccgccatcttggttccgcgttccctgcacagcctcctttttattcscnttcctkcasaaatgcccggcgaacacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagcnaagatcgaagatttatcccagcaagcacaactagcagctgctgagaaattcaaagttcaaggtgaagctgtctcaaacattcaagaaaacacacag

SEQ ID NO: 14981 - DNA, 585 bp, Homo sapiens
  misc_feature 32: n=a, g, c or t
  misc_feature 33: n=a, g, c or t
  misc_feature 143: w=a or t
gtactaagactagggttgggccgagagtcggnnccattactgcaggaaaaggtcccggagagctgagcagtcaagatgtgtgacttcaccgaagaccagaccgcagagttcaaggaggccttccagctgtttgaccgaacagwgatgcaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagaaggacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggac

SEQ ID NO: 14982 - DNA, 585 bp, Homo sapiens
  misc_feature 10: k=g or t
accgcgcatkctttttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgttccagtttagaggcggatttggtcgtggacgtggtcagccacctcagtaaaattggagaggattcttttgcattgaataaacttacag

SEQ ID NO: 14983 - DNA, 576 bp, Homo sapiens
  misc_feature 249: y=c or t
  misc_feature 252: r=a or g
  misc_feature 255: s=g or c
  misc_feature 322: k=g or t
  misc_feature 324: s=g or c
  misc_feature 376: k=g or t
  misc_feature 527: n=a, g, c or t
cagttactttcaggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctcgytgrgasaaggtctcattcggtgttttgggaagagagtcgtgtgggcccaggtatcgtagcggcgacacgagakasacgggcggtgtgacagccttccactacctgcacgagtgtattggtaacgttkgggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccangttggagggcctaccaccaagctggtacaaggtgttcgacccttcctgc

SEQ ID NO: 14984 - DNA, 575 bp, Homo sapiens
  misc_feature 144: r=a or g
  misc_feature 441: y=c or t
aagacagggacccgcagctcagctacagcacagatcagttatcctggggcatacagccataccattctgaaggtgtcttatctcctctgatctagagagcaccatgaagcttctcacgggcctggtttctgctccttggcctgrgtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggctgatcaggctgccaatgaatggggcaggagtggcaaagaccccaatcacttcygacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 14985 - DNA, 275 bp, Homo sapiens
  misc_feature 43: v=a or c or g
  misc_feature 169: m=a or c
aagcacaactgctaaagctccagagacacgagcgtgtgtggcvgcaagagccgccagttcgggaccaccgcagctggggtggcagcggcgcaggaggggtcgcggggagggagtggtgagcgcaggcggcaggggtctgggaaagacgaagtcgctatttgctgtctgmgcgcgctcgcagctcctggaagtgttgccgcctctcggtttcgctctcgctcgctgcgctcctagaaggggcggccgcctccaggactgaccagggccaagtggcg

SEQ ID NO: 14986 - DNA, 129 bp, Homo sapiens
gaacttgggacccgctggcctcgctcggtgcgcgcctccctccccgcatgcagcccgccgagcgctcgcgggtccccaggatcgacccgtacggattcgagcggcctgaggacttcgacgacaccgcct

SEQ ID NO: 14987 - DNA, 140 bp, Homo sapiens
  misc_feature 140: v=a or c or g
gagccggagccgagcgccagtttttccagggctaccagctgaagagctcctgtgggactccagccccaccaccatgggcagccccgagggccgcttccactttgccatcgaccgtgggggtaccttcacagacgtctagv

SEQ ID NO: 14988 - DNA, 82 bp, Homo sapiens
  misc_feature 68: y=c or t
  misc_feature 69: m=a or c
gttttggcgggcggttggcgttgcgcagaaggcggcggcggtggtggcttgtggtgcggcctcaccaymcaggaacagggct

SEQ ID NO: 14989 - DNA, 236 bp, Homo sapiens
tgtgaccagaccaagagacgccttggatggtggagaataggtgaccctctgttgggtaaaagaggactcaagccctcacacagtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtaca

SEQ ID NO: 14990 - DNA, 185 bp, Homo sapiens
aataaactgcacaaatttgaagtataaaatttcatactttttttttgagacggagtctcgcactctcgcctgggctagagtgcagtggtgcaatctcggatcactgcaacctccgcctcccgggttcaagcaattctcttgcctcagcctcctgagtagctgggattacatgcacccgccccacc

SEQ ID NO: 14991 - DNA, 76 bp, Homo sapiens
attgtgactcctcgggaggggcgcacgccggggagggggcggagggccattgtccggtcagcgcagctccggggga

SEQ ID NO: 14992 - DNA, 161 bp, Homo sapiens
ctgctgacactctggagcactggatggaacctgtcaaagtccagagcattgtgtgcactggccggcgtcaatggcacccagaccccgtcttagtccactgcatccagtcatgtgagcccttccaagcagatggttggtgtgacactatcaacacccgagcc

SEQ ID NO: 14993 - DNA, 100 bp, Homo sapiens
attttgcttgtaaaatgcttaatatcgtgcctaggttatgtggtgactatttgaatcaaaaatgtattgaatcatcaaataaaagaatgtggctattttg

SEQ ID NO: 14994 - DNA, 98 bp, Homo sapiens
gaaaagagagcgagagcagcgagcgcggctccacattgttgcggatcgccggcacccggcagagcggcggcggctgggacgcgcggcgcctccgaccc

SEQ ID NO: 14995 - DNA, 55 bp, Homo sapiens
gttcgcaggggaggaggcggcgggaggcggaggaggcggcggcggcgacggaggt

SEQ ID NO: 14996 - DNA, 139 bp, Homo sapiens
tgactccatgttgccacaaagattgcatgccaattgttatatatatcctatggtgtcaagccagtttgtgattgcctctatgatgttagctcttgaaacatggagaacttattaggtggttttgccttatgacaaacat

SEQ ID NO: 14997 - DNA, 94 bp, Homo sapiens
aagactggtgggtctatctttcggtctttcctaattttcccgtcctctggggaaaggtcggggatacctgaaccaaagtgtgtgtgtgtggggg

SEQ ID NO: 14998 - DNA, 91 bp, Homo sapiens
  misc_feature 75: s=g or c
  misc_feature 78: s=g or c
  misc_feature 81: m=a or c
  misc_feature 89: m=a or c
ctccgaggttctggcggccggcagtggcgaccggcgcagggaatcgcgcagggttgcggctgaggtcagaccagsgasagmcagagacmca

SEQ ID NO: 14999 - DNA, 109 bp, Homo sapiens
cattttgatttatttggtcagttggttatttgtgtcacttaagttccaaaatttggagattttctagatttttttggttataatttaattcacttatagacagagacga

SEQ ID NO: 15000 - DNA, 73 bp, Homo sapiens
tactttctctttactcatatctaattgatttatattgcctgattgcattggttaatatgtctagtacagtgtt

SEQ ID NO: 15001 - DNA, 123 bp, Homo sapiens
tgtgtgtgtgtgtgtgttacgggattgggggagtaggcagtctgtgtgtgtgtatgtgtgttatgggattgggggagtaggcagtctgtgtgtgtgttacgggattgggggagtaggcagtct

SEQ ID NO: 15002 - DNA, 102 bp, Homo sapiens
ggggagattttatggggctctcggactgctttctatttttggatgggttgaaagaatttgttacttttagccactagaatgaacttagttttaggcagcacc

SEQ ID NO: 15003 - DNA, 88 bp, Homo sapiens
gaaagtaattcattcatcttagaaccctggtagggacattctactaaaatatttgtgtactagttaaagtcaaaatagaaatacagcc

SEQ ID NO: 15004 - DNA, 66 bp, Homo sapiens
ggatgtagccacacggagccggtatgtgaggctggtggacagtgtgaaagagaatgcaggcaaccg

SEQ ID NO: 15005 - DNA, 73 bp, Homo sapiens
ttttcacctaattacacttttgatttaaaatgtgtaattctctttcagaatcaatataatctagcaacagccc

SEQ ID NO: 15006 - DNA, 227 bp, Homo sapiens
taattgaagggattacctagaatattttaacttaaaatgttttgtgctattttgttttaaaaagcagaggaccgcccatcagagcttatggctgattttcttacaaggtcacttctgtctccttcccttttaagtgcaggacatttactaagtacttcctctgcgccagtctccacggaacgtgcacaatgaatacacaattatacctccagctatgacacctcctc

SEQ ID NO: 15007 - DNA, 355 bp, Homo sapiens
  misc_feature 313: y=c or t
agagctgctaccccactgcccccatcctggcctgcaaatttggagggctgggctgagtggggacagaggggctcttgagcctcagagcatgaggttcccaacagatgtcttcttgactactctcttctaaaggcacagtgagggttttttttcttcctgtacagccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcaccygcaactgttcctccactgtagacttgcttatctaccagacct

SEQ ID NO: 15008 - DNA, 150 bp, Homo sapiens
taatagtccaagtaatacctggatgtggcacaaatcatgtggtgattcatgaatgaccaaaatctaggaaatgctgccttagaaacagcttctgtttgacgggtccatatgtttgcaagactggccacatcttcagcaaaactaacccat

SEQ ID NO: 15009 - DNA, 129 bp, Homo sapiens
tggaaaacaaaaaaaggcaggggttgcaatcctagtctctgataaaacagactttaaatcaacaaagatcaaaagagacaaagaaggccattacataatggtaaagggatcaattcaacaagaagagcc

SEQ ID NO: 15010 - DNA, 234 bp, Homo sapiens
ccattgaacttagggacaagaaacagctgagagggtctgaggaaggtgatgtgtacctaggactgaggacggatcgagccatagcactccagcctgggtgacagagcaagactccgtctcaaaacaaaacaaaacaaaacaaaacaaaacaaaacaataaaatttaccacccctaccagtcccacctatactccatatgccccacatgttttgtgagccagtttcaaccatgta

SEQ ID NO: 15011 - DNA, 94 bp, Homo sapiens
atttggtgagcattgaactgagagagaagcactgtctggccgctgaccttagtcatacccccagattagcttgtttgaggcagagcttggcaaa

SEQ ID NO: 15012 - DNA, 181 bp, Homo sapiens
agctgattcatagccccggcccgggccgcctctgcacgtccgccccggagcccgcacccgctccccgatgccgctgaaagaaaaattttacacagtcactgtacatcaaggttgaaaaactgtcctgcatgaaaaatatacttagaaatcatgtgaaggaattaagactgacataccaggt

SEQ ID NO: 15013 - DNA, 145 bp, Homo sapiens
atttgtagctccaacaaatgaatctaaaaagaagaatccaggctgggcacggtggctcatgcctgtaatcccagaacttggggaggccaaggcgggcggatcatgaggccaggagcaagaccagcctggctaacatagggagatc

SEQ ID NO: 15014 - DNA, 62 bp, Homo sapiens
  misc_feature 10: s=g or c
  misc_feature 19: s=g or c
  misc_feature 20: s=g or c
aagccgggtsttcgcagcssagctcgaggctctgtagcacccagttggacccagtcgccctt

SEQ ID NO: 15015 - DNA, 317 bp, Homo sapiens
  misc_feature 24: w=a or t
tctctcggccttagcgccattttwttgggtgagtgttttttggttcctgcgttgggcattccgtgtactttcctcccgtaaatgtaggaaataaagccatcggtttccacagtgaacacgcagtttagcttggggataactttcaggcggtcttctttggtgataattttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaac

SEQ ID NO: 15016 - DNA, 51 bp, Homo sapiens
agagtttctcaagaagccgagagagggacagaggctgagcctgggggggaa

SEQ ID NO: 15017 - DNA, 110 bp, Homo sapiens
ctctttctcgactccatcttcgcggtagctgggaccgccgttcagtcgccaatatgcagcctccaacgtcaaagggcgaaaaaccgtctatcagggcgatggcccactac

SEQ ID NO: 15018 - DNA, 84 bp, Homo sapiens
ccaggatttgtccatacagaaaatgtgtgcgctcccagctaaatctcagttaaggaggttgttctatatacagccaagtagcac

SEQ ID NO: 15019 - DNA, 227 bp, Homo sapiens
  misc_feature 153: y=c or t
atttcaagtaggtcatatttcgggggcgggtgcgcagacaaggagatgagtttccactaaggccagggggcctccaacggggttggaggtgagaatcccaggtagggtagaggtgccgagatcctttcgaatcccagccctggggcgtcagcytgcagggaatggcagagacactctccggactgagggaaccgaggccagtcaccaagccccttccgggcgcgcgt

SEQ ID NO: 15020 - DNA, 117 bp, Homo sapiens
acaggcctcaattgaaaaatcacagtagggaatttaggccaaggaaagccatcaagttgcaattatttcctaaattttctttggaaaatttcatttcaaataccaaaaccatcctaa

SEQ ID NO: 15021 - DNA, 150 bp, Homo sapiens
aagtaagcctgccagacgcctgcgcgcctgtagtcccagctactcgggaggctgtggtaggagaatcgcttgaacccgggaggtggaggttgcagtgagctgagattgcaccactccactccagcctggcaacagaacgacactccaccc

SEQ ID NO: 15022 - DNA, 109 bp, Homo sapiens
agaagagagagaaggaactgggggcagtggctcacacctgtaatcccagcactttgggaggcggaggcgggaggatcacttgcacccaggagttcgataccagcttgga

SEQ ID NO: 15023 - DNA, 136 bp, Homo sapiens
caactcttttccttttctctttctgttgtacctctcatttccccgacccttcctgtcctgtagatggcatttcataattcacattgataataattgctagaatttataggcatttattgtagattaagtagagcat

SEQ ID NO: 15024 - DNA, 126 bp, Homo sapiens
gaatgaggtactgagggccaaggtgttggaagttcctaattctttcctcggttaactgtgaaactctgcgtattgggaaggcctggcctcagtcatcaggccaggagaggtactggacgccgctgc

SEQ ID NO: 15025 - DNA, 143 bp, Homo sapiens
aacaaaatagatagactgctagacagactacttaagaagaaaagagaaaagaatcaaatagacacaataaaaaatgataaaggggatatcactactgatcccacagaagtacaaactaccatcagagaatactatagacatcc

SEQ ID NO: 15026 - DNA, 148 bp, Homo sapiens
  misc_feature 68: y=c or t
ctccagctcctaacctcgagtgatccgccagcctcggcctcccgaggtgccgggattgcagacggagytccttcactcagtgctcaatggtgcccaggctggagtgcagtggcgtgatctcggctcgctacaacctccacctcccagc

SEQ ID NO: 15027 - DNA, 104 bp, Homo sapiens
ttctatttcaagatgccagtcttaactcaaatgtcatctcagagaggctttctctggccaccccaggtaaaagggtgtgttgttttctttcacctgccataaag

SEQ ID NO: 15028 - DNA, 54 bp, Homo sapiens
aagtttttgcaacggctaaggaagggcctgtgggtttattataaggcggactgg

SEQ ID NO: 15029 - DNA, 108 bp, Homo sapiens
agaagagagagaagaactgggggcagtggctcacacctgtaatcccagcactttgggaggcggaggcgggaggatcacttgcacccaggagttcgataccagcttgga

SEQ ID NO: 15030 - DNA, 64 bp, Homo sapiens
atcggcggctcgcggtcactggtccctggctcggttccccgcaccccggggctcacacttaccc

SEQ ID NO: 15031 - DNA, 135 bp, Homo sapiens
tacttttgcagctgtaagagatgctcttttaaaaatttcaaagtagcctaagagattgcagtgtctctaaactgcagaaggaatgctggattttctatatagaggacattgataatggaatggttaaggggactc

SEQ ID NO: 15032 - DNA, 78 bp, Homo sapiens
tcagttctgcggtgccagggagtggagcagagctcagccccgtcccaaacacagatgggaccatgaactccggacaca

SEQ ID NO: 15033 - DNA, 103 bp, Homo sapiens
ttttctccagccggcccggggcggtggccgcaagttgggcttacagcgcggccgatccggcgtggacccgggatggctggaccgggcagcacggggaggcaca

SEQ ID NO: 15034 - DNA, 157 bp, Homo sapiens
agttagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggcaaaaaatcaccatgtaccaacc

SEQ ID NO: 15035 - DNA, 66 bp, Homo sapiens
gttgttgtccggccgggggaggcggaggtcgctcgctcgctcgctcggctcgctgactcgccggaa

SEQ ID NO: 15036 - DNA, 129 bp, Homo sapiens
ttagcagcaagaattgaagacttaagggtttgagcagatggttttctacctaaattgaataattcaattacgtattctcaactagcatggatttgggtcatggaattaaagtagaaacgtatccggcct

SEQ ID NO: 15037 - DNA, 80 bp, Homo sapiens
agcattttaatgcccactagtgtggaaggtaaaaaatatatgcaagtattaagaataagttctattcttatagtcccgcc

SEQ ID NO: 15038 - DNA, 159 bp, Homo sapiens
aatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggcaa

SEQ ID NO: 15039 - DNA, 109 bp, Homo sapiens
agaaggatttgtataaagagtgactctcctatgaaggtaaaggccacccctcttcagttccagtgactgagatacatttttccaatcctgggggcaaatacagaccaca

SEQ ID NO: 15040 - DNA, 68 bp, Homo sapiens
aaggaacgcagttctcaccagcaacggaacaaagctggacggagaatgactttgacgagctgagagaa

SEQ ID NO: 15041 - DNA, 53 bp, Homo sapiens
actctcactctcctccgctcaaactcagctcacttgagagtctcctcccgcca

SEQ ID NO: 15042 - DNA, 123 bp, Homo sapiens
  misc_feature 88: w=a or t
gtctttcatgagggatccactcctttgacccaaacacctctcacgaggccccatcttcaacattgggagtgagatttcaacatgagtwttgaaggggacaaatattcaaactgtatcagccca

SEQ ID NO: 15043 - DNA, 115 bp, Homo sapiens
  misc_feature 38: r=a or g
  misc_feature 101: b=c or g or t
aagtactcctttcatcgtcactggccagaatctgaatrtgtctcctctttccccagatctgttcctcctgggaagatgcagaggctcatgatgctcctccbacatcgggcacctc

SEQ ID NO: 15044 - DNA, 128 bp, Homo sapiens
acatatgaagtacttttgtttcttcttttgacataggttcttgctctgttgcccaggctggagtgcagtagcacaatcatggctcactgcaacctctgcctcttgggcccaggtgatcatcccaccca

SEQ ID NO: 15045 - DNA, 54 bp, Homo sapiens
agaccgccgaggctgccgccggagtcgccaccgccgcgccctcgcccacccgca

SEQ ID NO: 15046 - DNA, 70 bp, Homo sapiens
aaaaagaggacctgatgaccagctgcagagagcagctacggttgtcaggagttcgagacctgcctgacct

SEQ ID NO: 15047 - DNA, 50 bp, Homo sapiens
ggtgggagcggcattgtggggcagggaaaaggtgagccgagccgacggaa

SEQ ID NO: 15048 - DNA, 82 bp, Homo sapiens
cttacaaccatcacttccactcatccacagaacgtttttaccttgcaaaactgaaactctgtgctgttaaacagtaacggcc

SEQ ID NO: 15049 - DNA, 171 bp, Homo sapiens
cttcaggaatctgtcaagttcttccacaaaacatacatatgcttagtagtttaatttgaacacagaatcttttaattaaaatatactttaactttttccccagggaacatttgtattttgcatatttgtgtatgtatttattcatttggtgtactgaattacctgccaaat

SEQ ID NO: 15050 - DNA, 135 bp, Homo sapiens
ttagttatgcaaggaagatccctgacctctactcatttatactcacttgtccaaatgactagaaaaaacactctacagccttcttggtgtttcactcgtctgaaaataaaggaacttctctattttcccagggaa

SEQ ID NO: 15051 - DNA, 68 bp, Homo sapiens
  misc_feature 59: r=a or g
aaggaacgcagttctcaccagcaacggaacaaagctggacggagaatgactttgacgarctgagagaa

SEQ ID NO: 15052 - DNA, 88 bp, Homo sapiens
agtggcaagcgcgggcaggaccgcgttgcgtcatcggggcgcgcgcctcagagagagctgtggttgccggaagttgagcggcggcaca

SEQ ID NO: 15053 - DNA, 91 bp, Homo sapiens
  misc_feature 6: y=c or t
acagtycacttccgtcctccacctgcgtctctgcttggcacttgctggctaaagtaaagtacaaatgtgtttcatcaaactacctaaatct

SEQ ID NO: 15054 - DNA, 103 bp, Homo sapiens
tttaggattatttggaaccccaaaattctgttccatataacatggtcaagttgggtttcaaaaaagttttaggactggtcttcctcaaagagctcagcagacc

SEQ ID NO: 15055 - DNA, 123 bp, Homo sapiens
gtctttcatgagggatccactcctttgacccaaacacctctcacgaggccccatcttcaacattgggagtgagatttcaacatgagttttgaaggggacaaatattcaaactgtatcagccca

SEQ ID NO: 15056 - DNA, 160 bp, Homo sapiens
actcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgactaa

SEQ ID NO: 15057 - DNA, 58 bp, Homo sapiens
ctcgctgggtcgctcgggtcggcttcggtcgctaccgctcccgctctgccacccccgc

SEQ ID NO: 15058 - DNA, 66 bp, Homo sapiens
agaccagagtggggactcatggtgcctctttcgaccctcccatggccgcccatgaaccagtcggct

SEQ ID NO: 15059 - DNA, 126 bp, Homo sapiens
tataataaaaagccccattggagtgaggcgggggtggcggcggcaaccgcggcgggggtatccggggagactgctgctgtcgctgctgctgatcgcggcccaggtcggcctcagagagcggacacc

SEQ ID NO: 15060 - DNA, 116 bp, Homo sapiens
attcatccattcactcattcattcattcatctacgcattcacttatgcatccattcctttgttccatttatccattcattcatccatccatccatccatccattccctcactcact

SEQ ID NO: 15061 - DNA, 69 bp, Homo sapiens
aaaagaggacctgatgaccagctgcagagagcagctacggttgtcaggagttcgagacctgcctgacct

SEQ ID NO: 15062 - DNA, 54 bp, Homo sapiens
tgatgacagtgcaatctaggaaaaactaacgtacacacacacacacacacactc

SEQ ID NO: 15063 - DNA, 104 bp, Homo sapiens
aaactttatgtctctcaagaacccataaaagatttcacaaaatatcttcactgcgattcctatactttggatggatggatggatggacagacagacagagccct

SEQ ID NO: 15064 - DNA, 251 bp, Homo sapiens
tatttaactccatgtatttaatatatattatatctgcaggtaatcaatataaaatgctatcagtattttttacatctttttttcatatgaagtttttgaaattcagtgtatattgtatacttacagcacatatcagttcacactagctgtttttcaagtgctcattagccatatgtcactagtggctgcacactggacatagcaaggttagaatctgggaaagtagaggggaaggtcaagtacaggggaaa

SEQ ID NO: 15065 - DNA, 72 bp, Homo sapiens
ccctccaagaagctggccgcctctgtgctggatgccctcgatcccccgggccccacgctggacccccgggac

SEQ ID NO: 15066 - DNA, 56 bp, Homo sapiens
atttatgcacccaatacaggagcaccagatcataaaacaagtttgtaaagaccgta

SEQ ID NO: 15067 - DNA, 153 bp, Homo sapiens
tactttaatatttttacttaataatttttgtagtgttttatagttttacagtgattttgtatattacctcttcaggtaaaatataagctttatgaaaagagtgatcatatctctctatgtacttaatctctttatatctttactcaataggga

SEQ ID NO: 15068 - DNA, 127 bp, Homo sapiens
ccttgctgatttttaaatattttgtagagatgagagtcttaatatgttgcccaggctgatctcaaactcctggcctcagcaatccttcccccttgaccttccctctccttttttttttttttttttt

SEQ ID NO: 15069 - DNA, 68 bp, Homo sapiens
aaggaacgcattcttcaccagcaacggaacaaagctggacggagaatgactttgacgagctgagagaa

SEQ ID NO: 15070 - DNA, 59 bp, Homo sapiens
ctatcactaatggccaccttatttactaactccttcaggccacacacctcccagctaat

SEQ ID NO: 15071 - DNA, 147 bp, Homo sapiens
tcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacaggc

SEQ ID NO: 15072 - DNA, 115 bp, Homo sapiens
aaaaacctgctgcgggaggcggcggcgaccggccagggagcgagggaggagagttcacttttacttcagtgtcagcgcgcggcggccgtggctggctctggcgagagagcaccgt

SEQ ID NO: 15073 - DNA, 126 bp, Homo sapiens
agattgaggtaagaagccttccagacacagcccaacaatgcagcaaagcccaatgcttgactaactggggcacacagggaacactgcaaagtttggtttggatcctagagtggaaaagggaaccaa

SEQ ID NO: 15074 - DNA, 121 bp, Homo sapiens
gaactagaccagaagccattccttatcaggtgactctggaagggaagccatatttgatgaaatccagaagaaatcctggaccataatgctacattttttctttttttgtaatgggatgcat

SEQ ID NO: 15075 - DNA, 149 bp, Homo sapiens
ctccagctcctaacctcgagtgatccgccagcctcggcctcccgaggtgccgggattgcagacggagtctccttcactcagtgctcaatggtgcccaggctggagtgcagtggcgtgatctcggctcgctacaacctccacctcccagc

SEQ ID NO: 15076 - DNA, 129 bp, Homo sapiens
agaatttaatggaaaacctgactccctcttttttaatgatggccagcgaagaattgactttgttctagtatatgaggatgaaagcagaaaagagaccaataaaaagggtacaaatgaaaaacaaagtga

SEQ ID NO: 15077 - DNA, 113 bp, Homo sapiens
attttgaaagactgtgaaactggagccaattctccatcatcacacaggaagctgagtacttcctacttggtcaggatcttgaaacttgaattcataaaaacccagaaagcccc

SEQ ID NO: 15078 - DNA, 123 bp, Homo sapiens
  misc_feature 88: k=g or t
gtctttcatgagggatccactcctttgacccaaacacctctcacgaggccccatcttcaacattgggagtgagatttcaacatgagtkttgaaggggacaaatattcaaactgtatcagccca

SEQ ID NO: 15079 - DNA, 122 bp, Homo sapiens
atcctgaaggttttgtttttcctattcctccttagcctgtactcaagggaaacaagcttccttgtttccctcctttgtactccctcagttctgtggagtcaagtcccaggagagcagagcat

SEQ ID NO: 15080 - DNA, 123 bp, Homo sapiens
  misc_feature 63: k=g or t
  misc_feature 64: k=g or t
gtctttcatgagggatccactcctttgacccaaacacctctcacgaggccccatcttcaacakkgggagtgagatttcaacatgagttttgaaggggacaaatattcaaactgtatcagccca

SEQ ID NO: 15081 - DNA, 70 bp, Homo sapiens
atacatcgccctacagcagaaagaccggggacagcccagcctcagggcgactttaaacccaaaaggaagt

SEQ ID NO: 15082 - DNA, 184 bp, Homo sapiens
atatactccacgcccggacacaggtttttgcatgaacaaaattttcacttctctgggatacatgctcaagagtgcaactgctgggtcttatggtaattgcatatttagttttataagaaactgccggccgggcgcggtggcgcgtgcctgtagtcccagctactcgggaggctgaggtgggagg

SEQ ID NO: 15083 - DNA, 69 bp, Homo sapiens
aatgtgatgggtttggcactcttcatttctcgggattacgcctgtaatcccagcactttaggaggctcg

SEQ ID NO: 15084 - DNA, 214 bp, Homo sapiens
  misc_feature 73: k=g or t
  misc_feature 111: w=a or t
  misc_feature 142: s=g or c
agcactttgctcgggtcacggcctcctcctggctcccaggaccccaccgtagaccgcgcaactacaaccagtkcaaagaggaaaaacaggaaaaataaaattactccagawaacgttcaaattatatttgatgatccactascaatttcatacagtcagccagagaaggtgaatggagagtccaagagcagcagtaccagcgagaatggggaca

SEQ ID NO: 15085 - DNA, 80 bp, Homo sapiens
agagataaacagaggaggaggagggaggggagtgcgtgtgtgagagcgcgcgagggagtgtgagtgtgtgtgagcgcgca

SEQ ID NO: 15086 - DNA, 64 bp, Homo sapiens
gactgtaccgaattttttttcatattctcttctaaggtattcccagctgtatttatccaccaag

SEQ ID NO: 15087 - DNA, 93 bp, Homo sapiens
ccagggcctgcccaaggagatggacattccttacctcccattgctcgccgcctgggccaccaccctccacagtccctaaatgttggcaaaccg

SEQ ID NO: 15088 - DNA, 86 bp, Homo sapiens
acgggtggctgggtggctggctggatggacgagtggatggatggatgaatggatagatgggtatataaatggatgatggaaggaaa

SEQ ID NO: 15089 - DNA, 81 bp, Homo sapiens
  misc_feature 47: s=g or c
  misc_feature 63: r=a or g
  misc_feature 67: r=a or g
  misc_feature 75: s=g or c
agagataaacagaggaggaggagggaggggagtccgtggtgtaagascgcgcgagggagtgtragtrtgtgtaascgcgca

SEQ ID NO: 15090 - DNA, 67 bp, Homo sapiens
ataagtggacagcctgctccaagggaaggatcaggagagaagaaacgcaaatcccagaaccgacgcc

SEQ ID NO: 15091 - DNA, 57 bp, Homo sapiens
agattaacatttggtgtgtcagacaagaagagtgttgtaaaaaggtcagagggtatt

SEQ ID NO: 15092 - DNA, 59 bp, Homo sapiens
taagctggaggtggacaactcaatgtaaatttcatgggaaaacccttgtacctgaagcc

SEQ ID NO: 15093 - DNA, 56 bp, Homo sapiens
ccaaagtgctgggattataggcatggagccgccacacccagccaatgtgccgaagt

SEQ ID NO: 15094 - DNA, 296 bp, Homo sapiens
  misc_feature 193: s=g or c
gggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccasctcactctcagtcttcccgggagttcgtgggatttggaccttagattattagtattattttgagggcctcctgtgtgtaagcactggttgtgcgcagatggct

SEQ ID NO: 15095 - DNA, 142 bp, Homo sapiens
aattcgcacgagtagtgggtcgtcttgtttctagcaaaacaggtggcagcagccttatcacactcacacagttgactatctgaatcatttttaagtatacattcagtagtgttaagtatgtcgccattgttgtacaaccaaa

SEQ ID NO: 15096 - DNA, 124 bp, Homo sapiens
agaaaccaggcggcgcgttcccggtggcggcgcctggactcccgggcccgcgcatccgccagccttccttaaggcggatgggtggcccccgagaccccgtcggacccatggtttccagtgcagc

SEQ ID NO: 15097 - DNA, 95 bp, Homo sapiens
atatcccctgtgacctgcaggtacacatccagatggcccgttcctgccttaactgacgacattccaccacaaaagaagtgaaaatgacactgcaa

SEQ ID NO: 15098 - DNA, 97 bp, Homo sapiens
tcataatagccaaaaggtgaaaacaatctaaatatccatcaacagaaagatggataaacaaagtggcatgtcaatacaatgcatttttggaagggaa

SEQ ID NO: 15099 - DNA, 123 bp, Homo sapiens
  misc_feature 88: n=a, g, c or t
gtctttcatgagggatccactcctttgacccaaacacctctcacgaggccccatcttcaacattgggagtgagatttcaacatgagtnttgaaggggacaaatattcaaactgtatcagccca

SEQ ID NO: 15100 - DNA, 97 bp, Homo sapiens
agttctcactcttatttcatgagagagcgggttgtttaaaagatcccggcacctcctcctctttctcttggttgctctcaccatgtgatacaccggc

SEQ ID NO: 15101 - DNA, 83 bp, Homo sapiens
cttacaaccatcacttccactcatccacagaacgttttttaccttgcaaaactgaaactctgtgctgttaaacagtaacggcc

SEQ ID NO: 15102 - DNA, 79 bp, Homo sapiens
  misc_feature 38: s=g or c
gtgtcttctgcatctcctaggaacctcgggagcggcastcggcgcctggtagcgagaggcgggttccggagatcccggc

SEQ ID NO: 15103 - DNA, 57 bp, Homo sapiens
atttatgcacccaatacaggagcaccagattcataaaacaagtttgtaaagaccgta

SEQ ID NO: 15104 - DNA, 60 bp, Homo sapiens
taggtgacagatcgagactccatcacacacacacaaaaagagtaataactcagtgccccc

SEQ ID NO: 15105 - DNA, 111 bp, Homo sapiens
tatagtaataatggaattgtgatcttcagttgcacctcaaccattttttttgcttatgaactaaaatttctaacattaacatttcggcatgtaataaaacaagggcctatc

SEQ ID NO: 15106 - DNA, 52 bp, Homo sapiens
atatgtttcctgattacctcttgctaataaatctattctatctcagggtgaa

SEQ ID NO: 15107 - DNA, 68 bp, Homo sapiens
ggggtcaggagttcgagaccagcctggacaatatggtgaaaccccgtctctgctaaaaatacaaaaat

SEQ ID NO: 15108 - DNA, 53 bp, Homo sapiens
tgaggtcgggagttcaagaccagcctgacaaacatggagaaacccccggccat

SEQ ID NO: 15109 - DNA, 124 bp, Homo sapiens
  misc_feature 9: r=a or g
  misc_feature 12: w=a or t
  misc_feature 102: y=c or t
  misc_feature 104: w=a or t
  misc_feature 122: k=g or t
  misc_feature 123: w=a or t
aacactaarggwtttctgtcttcttggatgaccattacagttggtgaggcttcaggtccctggggatctgccatattacagtggctataaatgagatttctytwtcttttttcagcagcaakwc

SEQ ID NO: 15110 - DNA, 164 bp, Homo sapiens
  misc_feature 78: k=g or t
  misc_feature 86: k=g or t
  misc_feature 88: k=g or t
gagtgcgaatgatttcagcaaaccctaacttaactaacaagaatgggtaggtatgtctacgtttcattaacaaatttktattattktkattctattatatgagatccttttatattatcatctcacttttaaacaaaattaactggaaaaatattacatggaac

SEQ ID NO: 15111 - DNA, 53 bp, Homo sapiens
tatttgaattgaatttatactttttttggtcccttattttaaaatacccaagc

SEQ ID NO: 15112 - DNA, 82 bp, Homo sapiens
aatgaaatacatgaatgttctgtattccagtaaaaggacagaaatgccaatccccagggttcagccagccttttacagcagc

SEQ ID NO: 15113 - DNA, 70 bp, Homo sapiens
ttgaacagtatatttcaggaaggttagaaagtggcggttaggatatattttaaatctacctaaagcagca

SEQ ID NO: 15114 - DNA, 140 bp, Homo sapiens
tttggtagtatcatcagcatacttatcagtaataggcgaacaggataaatagaataaatgaatctaggctaattcttaatgctttcacttagattaaggggagaattcgcccagctaagttttctttttttttttttttt

SEQ ID NO: 15115 - DNA, 63 bp, Homo sapiens
tcctacaaaaaatatcattcgagaatttgcatctgactttgaagttggagaatgctggggcca

SEQ ID NO: 15116 - DNA, 73 bp, Homo sapiens
atgaagtttccataactaaattgttgttgttgttgtttgagacagaaactcactctgtcacacaggctggaat

SEQ ID NO: 15117 - DNA, 70 bp, Homo sapiens
acacttttttaaataatcaaaacccttgatatttgaaagagaagtgttacaggtaggtgaaagggtcgcg

SEQ ID NO: 15118 - DNA, 100 bp, Homo sapiens
ctttgggaggccgaggtggatggatcacaaggtcaggagtttgagaccagcctggccaacatgctgaaaccctgtctctactaaaaatacaaaaaaaaaa

SEQ ID NO: 15119 - DNA, 113 bp, Homo sapiens
atctagtgagacagattccaaacacagccattatgatggccacctatgaattggtggtttacctactcaatggatagcagcacgaggactgctgtactgcaaaaaaagaagac

SEQ ID NO: 15120 - DNA, 104 bp, Homo sapiens
ttcacattacccccattatgtgtcattgacagcagcgtcacaggcagcacccacggtgtcatgctgtccatgcagaaatattttaaagaaaattaccgactacc

SEQ ID NO: 15121 - DNA, 121 bp, Homo sapiens
gctacaagaagaatattatgagttatatcagatcagattataaaatacaatgagaattacataaaagttatacaatcattttggagaactgatatttttaccaaattgagtaatcccactc

SEQ ID NO: 15122 - DNA, 115 bp, Homo sapiens
agggcagcaaaaagtatgtcctttctgaagcctttttttccgtaggtttcttcattcttttctctcttgtcttatgttcattttagccatagacttgactggagtttagagggaa

SEQ ID NO: 15123 - DNA, 203 bp, Homo sapiens
agccttcgaaggaccatggtgcttccacgtcatcgtgttgtggcgctcccggctatggcagtaccgtagttttcctctcttctgcctgcggtgaccattgggctgtagggtgccccgaggcctccctggccccctcacgccggcagaatggcctcagcccgaggggccaagcagtcttcgccccgggtggggaccaccgcaaa

SEQ ID NO: 15124 - DNA, 51 bp, Homo sapiens
atatgaatatctttaaccgtagatgatatccagaagtttccaagactgcct

SEQ ID NO: 15125 - DNA, 204 bp, Homo sapiens
tgctttagaaataactacatagcctagaattttggagagttagtttcttcttgtaaagtgtgcccaaaacaggccatctatgctgttgaattaatagaccatccttgggatagtggtatagtaactggaagagaactaactttggcttattcatattctgttcaaagacagtctattttttcactgtagaaagcgtccttgtgt

SEQ ID NO: 15126 - DNA, 73 bp, Homo sapiens
aaatgatcattggaattcagaaagccttgcatgattaagtcgaccttatcacaaatctttgctatctggggca

SEQ ID NO: 15127 - DNA, 69 bp, Homo sapiens
atttaaaaacatttgaattaaaaattgccatctctctttgcatacagtaaaacaataacttctggcaaa

SEQ ID NO: 15128 - DNA, 83 bp, Homo sapiens
  misc_feature 73: r=a or g
aatctcaataccgatatcgcccggacgcctctcccccggccctcgggggtgtgaacgtgtgtgagcgggagcraaggcaccgc

SEQ ID NO: 15129 - DNA, 162 bp, Homo sapiens
cagaaaaatgtcaggaatggaggaatggttttggcaaagagcattcgcaaatataatcatgtgaatgtcttgagaattgaatgggcttgaggtatgcagaaaatatggaaaactactgagagtggggcacaatatgtgacacccagcatggtaagtggtgct

SEQ ID NO: 15130 - DNA, 61 bp, Homo sapiens
tggccataattcaggccagcactgtgctgtccctggcagagaagtggatccagcagattga

SEQ ID NO: 15131 - DNA, 183 bp, Homo sapiens
cttaattctgaagtggttcctaatatctcacctggaacaataactaactactatgtcccgcgctaggtgctgtagcctctccattcagagcactgctccccgtcaaggtgccatgagccccaaaatcttttaccattttttgtttgcaactttggacctcaagaggtttcccttcccttcctc

SEQ ID NO: 15132 - DNA, 51 bp, Homo sapiens
atttaacaaattgaagaataccatcagcaagttttttgactcccaaggacc

SEQ ID NO: 15133 - DNA, 55 bp, Homo sapiens
agtggggggtccagacgaggctcagtgtgatctccaacatggacagtggcgcgcc

SEQ ID NO: 15134 - DNA, 99 bp, Homo sapiens
atgaagagtccagaggacaccacctgagaagcttttcaactgccttccaaggctcccttgaacttcactgcggtagagcagggaccccagacctcccca

SEQ ID NO: 15135 - DNA, 71 bp, Homo sapiens
caccagagtagctgggactgcgggtgcgcgccaccatgcccggctagttttttaaatttttttgtggagac

SEQ ID NO: 15136 - DNA, 241 bp, Homo sapiens
ctgcagggctttgggtgaggattaaaggagtgaacataaagcacctttctcagtggctgcacatggtaggtactcagtaaatggcatgtcccacaccttggaagctattttagaaccttgatccttattaagggtgctcagaagcccaagctcgaagcccctgggtttgaggcgtctttgggattctgccccctgtatgtggggagagcagaagctaaaggggaaagggagttacagagcc

SEQ ID NO: 15137 - DNA, 91 bp, Homo sapiens
tttgcttgaaccagattttaagtccagcacttcaagtggagagtctacaaaccagtcagcaggagaattttctgcagatcatagagcatca

SEQ ID NO: 15138 - DNA, 208 bp, Homo sapiens
ttcttgggaggctgaggcaggagaatcacttgaactcgggaggcaggggttgcagtgagccgagatggcaccactgcactccaggctggccaacagagggaggctccgtctcataaataaataaaataggttactttagttgggtgtggctcatgcctgtggtcccaccactttgggaggccgaggcaggtgaatcacccgggtcagg

SEQ ID NO: 15139 - DNA, 78 bp, Homo sapiens
aaatgagacgtcgcctttagctggcttaggagttcgcacactaaggggagaagatatttaattgaaacccgcacgcgg

SEQ ID NO: 15140 - DNA, 126 bp, Homo sapiens
  misc_feature 32: s=g or c
  misc_feature 92: r=a or g
  misc_feature 93: s=g or c
acactctggcccggttctcggtggtgcgggasgggcgggagcagcggccgctctggtcggcggacgtgctgccgagtagtcccggaagcgarsagcgatggcggagagtccgactgaggaggcgcc

SEQ ID NO: 15141 - DNA, 131 bp, Homo sapiens
tacttgttttggacaacccaccatcagatctgcacatgtttccattactgcatgcacacacacactctctctctctctctctgcagcaaaactaacaataaactcatcttgatgttttttccctggcaata

SEQ ID NO: 15142 - DNA, 53 bp, Homo sapiens
cctctcttggactagaaggcctactgtcagcccttcgcttacaaactgctgcc

SEQ ID NO: 15143 - DNA, 163 bp, Homo sapiens
tggatttcattgagccaaaagttagaaattttataaattacagttctgcgatatgattaaaaagtaatacaaaaaacaaattataaactggaattgtgtcaattgagttgacatatttcttgcaagatgattatatttatataggaaaatgtttggaaagtct

SEQ ID NO: 15144 - DNA, 72 bp, Homo sapiens
tagaaaccactcgagattatgaagctggttgggtatattgaatttgaggccccggtactggcattttttttt

SEQ ID NO: 15145 - DNA, 64 bp, Homo sapiens
  misc_feature 45: r=a or g
aactccaagctgctcaagaaaaagaaaagcttaaagttgaaggtrttttctcttaacaaccatc

SEQ ID NO: 15146 - DNA, 89 bp, Homo sapiens
ataaaattggaacatacctatgatggaggtacgatggagagggagtaaaatgtagtctgtttttaaagattattttaaagtcaggtaga

SEQ ID NO: 15147 - DNA, 94 bp, Homo sapiens
acactaggcataaatggtttattcagttgtgcaaatgaaagccatctgacagttggctcacattgaacacctgtggagattaaggacgaggacc

SEQ ID NO: 15148 - DNA, 247 bp, Homo sapiens
aattagctgggcatggtggtgcacacctgtaatcccagctactcgggaggctgaggcgggagaattgcttgaactcgggaggcagaggttgcagtgagctgagattgtgccatggcactccagcctgggtgacaagagcgagactccgtctcaaaaaacaaaacaaaagcaaagttgactctggcctgggacccagaaaactctgtcagccagatatcttctggccccttaggtggacagccagacg

SEQ ID NO: 15149 - DNA, 83 bp, Homo sapiens
ccagatagcgggcctgaggtggggccttgaaaccagggtgggtgcccaggatggacagctaggtagggtcaggcccaggcact

SEQ ID NO: 15150 - DNA, 74 bp, Homo sapiens
  misc_feature 24: n=a, g, c or t
  misc_feature 51: n=a, g, c or t
acgggatcctgctccgctccgcgnctcccccgccccggagagctccgcgantcagcacccgggacagcgcgcac

SEQ ID NO: 15151 - DNA, 63 bp, Homo sapiens
cagatgtcttccacatttacacagatgtggaagacatgaaagagcaagaaatagtgagcagcg

SEQ ID NO: 15152 - DNA, 63 bp, Homo sapiens
cctggtctcctaatctctttacttgtattctggatgctcctgaatcctgactcagtaagccca

SEQ ID NO: 15153 - DNA, 98 bp, Homo sapiens
  misc_feature 21: s=g or c
  misc_feature 22: r=a or g
  misc_feature 54: r=a or g
  misc_feature 96: k=g or t
  misc_feature 97: y=c or t
attctctatacccctcttgasractttaccctgttctgatttttcacctgtgtrtcccccaatctctgatcttgaaggggcctgcctccgggccakya

SEQ ID NO: 15154 - DNA, 106 bp, Homo sapiens
aatttgaaataaattagtgatttatattgtaagtacattaaatatgatactatattaattattttggatttatttgcatcacatgaaatgttttataggccaatat

SEQ ID NO: 15155 - DNA, 61 bp, Homo sapiens
ttaggggcagggggcctggcctcttccgcggccaccgctcagcgcggtccctcctcctact

SEQ ID NO: 15156 - DNA, 90 bp, Homo sapiens
gctcttaggaggactctggagaagtagttgtcctgggagaggagcgatcttaatcctgctgcatgacgggaggacaaaatgcgacgctac

SEQ ID NO: 15157 - DNA, 74 bp, Homo sapiens
ttttaaaaatctatgcttgtaatacaggcagtttccaacttgacaaatgttttatggtctatatgagcaaccaa

SEQ ID NO: 15158 - DNA, 68 bp, Homo sapiens
gctgaaccaagatggccggtggcggccgggccccggcgtgagccaagcgcgggctgcagccgggataa

SEQ ID NO: 15159 - DNA, 88 bp, Homo sapiens
tgcttaatgactttgtgttcttatttttcagatggaggtaaagtttgggggtgaagttgctaggagtgtcaaaatttgtgatatggaa

SEQ ID NO: 15160 - DNA, 103 bp, Homo sapiens
ttttttctttgagatggagtcttactctgttgcctaggctggagtgcagtggcgcgacctcagctcactgcaacctccacctcccaggttcaagcaatcctca

SEQ ID NO: 15161 - DNA, 62 bp, Homo sapiens
ttagcaatatgattagtccagagcatgtgttgcttttttgtttgtttttttttttttttttt

SEQ ID NO: 15162 - DNA, 54 bp, Homo sapiens
cttttgacagagtttggctcttgtcacccaggctggagtgcagtggcgcactaa

SEQ ID NO: 15163 - DNA, 75 bp, Homo sapiens
ataatgttgctaaaccacctgcatagcagagacactctgctcctacgatttcatatgctttagatacccggaagg

SEQ ID NO: 15164 - DNA, 61 bp, Homo sapiens
acgggtggggacgctggtcgctgccgggggcaagtctgccgactccagaaagaaaggcgac

SEQ ID NO: 15165 - DNA, 64 bp, Homo sapiens
actgcagtggggagaattgagaatagtcaggcctatcagtctcacagaatcacccccccttagc

SEQ ID NO: 15166 - DNA, 59 bp, Homo sapiens
agatcgatctaagatggcgactgtcgaaccggaaaccacccctactcctaatccccctt

SEQ ID NO: 15167 - DNA, 256 bp, Homo sapiens
  misc_feature 98: k=g or t
  misc_feature 112: k=g or t
gtcttctgtgttcggcgtgctttgctcggggaagctcaggtggccgccacggtgggccgctggtgcctcccaagcctgtgtgtttattaccacagctkgagagtggcttgckgaacatggtgatcgattctggcacttgtagcataaattacacgctctttcatcattgaaagagtgtcaaagaaaagaacattctaacccaattcccttacccaatgatccccctcacccaattcttcattggaacaacatatga

SEQ ID NO: 15168 - DNA, 54 bp, Homo sapiens
ttttagtccaaaaatattcttaggctcttcaggctattctgttttcaggctcga

SEQ ID NO: 15169 - DNA, 149 bp, Homo sapiens
  misc_feature 127: w=a or t
ttttagttccaaatatagactctcaattgcctttaaatgggacttgcacagttgatagaccactagctacattaactaagaaaaagagccaggtgaagttggtacccacaatgataaccaagaagawagacagaattgccctgggagct

SEQ ID NO: 15170 - DNA, 56 bp, Homo sapiens
gggtgtgcgagtcccctgggcgcggggaagggaagaagaggacgaggtggcgcgat

SEQ ID NO: 15171 - DNA, 64 bp, Homo sapiens
agttcacagctaggatctttagagaagtttaagaggcaatatgggaacagatacgaatacccaa

SEQ ID NO: 15172 - DNA, 224 bp, Homo sapiens
  misc_feature 211: v=a or c or g
tgagctcttatgaccagcagccaggtgagacacaaaagcagctgccagaaaactgtcagcagagtctgctctgtcctgagatagaaaagaatcaaaaagtggtctcatgttggggaggggtcggggtgggggacgccccgccttccctgcagcccgggatggcaaggggcgacgaagaggcttctggtgcggtcggtctccggggccagtvaccaccagccgta

SEQ ID NO: 15173 - DNA, 63 bp, Homo sapiens
  misc_feature 36: w=a or t
  misc_feature 41: y=c or t
  misc_feature 42: k=g or t
  misc_feature 43: k=g or t
acttgttttgaagagggttttggttttggttattgwgtctykkaagttttctgatatgccccc

SEQ ID NO: 15174 - DNA, 189 bp, Homo sapiens
ttgacaagtgagacagacctatttaaactaaagagcttctgtacagcaaaataaattatcaacactttaaagaaacagtgccctcatgtctcccttgtgttgcccagactggtttcaaactcctaggctcaagcagtcttcccacttcagcctctcaaagtgctgtaattacaggcatgaaccaccaac

SEQ ID NO: 15175 - DNA, 61 bp, Homo sapiens
atagtatatattttgtacactttgttacacagacacacaaatgcacctatttataccgggc

SEQ ID NO: 15176 - DNA, 96 bp, Homo sapiens
aaaaaagggtgaatcctgcagagccagcagtcaccccctgatgtatgtttttcctgactcttcgtattttagaacggcccgcagtcaggcgcccga

SEQ ID NO: 15177 - DNA, 122 bp, Homo sapiens
caaaagagacaaagaaggccattacataatggtaaagggatcaattcaacaagaagagctaactatcctaaatatatatgcacccaatacaggagcacccagattcataaagcaagccctta

SEQ ID NO: 15178 - DNA, 76 bp, Homo sapiens
atttttcctttgttaggagatcctacttcagaaaataagaccgatgaaaaaaaaatagaagaaaagaaggcccgca

SEQ ID NO: 15179 - DNA, 94 bp, Homo sapiens
  misc_feature 18: y=c or t
  misc_feature 40: y=c or t
acttgggatttttttttyctttcttccagtgatacttttyctttgtgagcagcaactgaggtgccagataatataggtcacctgaaggacagcc

SEQ ID NO: 15180 - DNA, 62 bp, Homo sapiens
gtaggccttccccacccagagagaagtgtttccaccccagagacattgcctgtcagcccctc

SEQ ID NO: 15181 - DNA, 74 bp, Homo sapiens
gatcactcggctcgtgcgtcgatgaagaacgcagctagctgcgagaattaatgtgaattgcaggacacatgacc

SEQ ID NO: 15182 - DNA, 94 bp, Homo sapiens
  misc_feature 56: w=a or t
aaaaatcttggcaaaaaaagaaaaaaattgtctaacgtgtgtgggtgaaaactgtwaatcaagtgtttctactcccccccgaaaatcccctgct

SEQ ID NO: 15183 - DNA, 116 bp, Homo sapiens
atgtgaaaaaagtggtactaaatggatcgcaaaaaggacacctctttacagtataagaactgaaacaagataggggaatgtcacttagctcaacctcagctaggaacatgtgcatc

SEQ ID NO: 15184 - DNA, 97 bp, Homo sapiens
tgtttttgggtcaaggtttccctttggaaactttatggagtgctgtttcctcagccactcctcagtgttttcctggttttgagttttagtactgtct

SEQ ID NO: 15185 - DNA, 242 bp, Homo sapiens
ctctgcattcatgatctacttctctctctttctctgatttctgctaattttaggacactgccatatctgtggagctttttgtttgttttctagaggcaggatctcactaccttgcccacgttgaacttgaactcctgggctcaatcaatcctcccactttggctttccaagtagctgggactccaggcacataccagcccacctgccccagctagtcttaaaatttttagtggagacagaga

SEQ ID NO: 15186 - DNA, 63 bp, Homo sapiens
aaactcctgtatgttcaggttcagtcaccgacaagcccttgagccagggtaactcaggaagga

SEQ ID NO: 15187 - DNA, 65 bp, Homo sapiens
tagcagctcatcacatgatgcgtaacttgacagctggaatggctatgattacatgcagggaagcc

SEQ ID NO: 15188 - DNA, 82 bp, Homo sapiens
ttaatggatatttatgtaataactagacttctcagattattgtgagaagggtcaggttggaaggggtgtaggaagaggggta

SEQ ID NO: 15189 - DNA, 75 bp, Homo sapiens
tgtcagcatagtttgcaaaacttttctcccattatgtaggttatctgtttagtctgttgataatttctgtggcca

SEQ ID NO: 15190 - DNA, 116 bp, Homo sapiens
  misc_feature 46: s=g or c
  misc_feature 47: d=a or g or t
  misc_feature 50: n=a, g, c or t
gtaataatcctggtggggctcacagcactgcgtggcaggagcggasdggncctcgtaggcgttccaggtgttccctgagccggattaaatgcctctgcgctgtgggggtggggaaa

SEQ ID NO: 15191 - DNA, 70 bp, Homo sapiens
atacaagaagaccgcaatattgaccatgaatgtgatcatccaacattcatctagacagcataaaagggga

SEQ ID NO: 15192 - DNA, 126 bp, Homo sapiens
ttatttgttctattgatggtagaccttgcgtgatgctttcctatatctctattgaaatcttctgaaagtgacagaatgttcccattaaaaacaatttactgccactttgcttcaagacgctggacc

SEQ ID NO: 15193 - DNA, 61 bp, Homo sapiens
aacccttgttatcacagatcctacgcgaattatattggccccaattaatgccgatatcaac

SEQ ID NO: 15194 - DNA, 70 bp, Homo sapiens
attgaactcgcctgcagctcttgggttttttgtggcttccttcgttattggagccaggcctacaccgcaa

SEQ ID NO: 15195 - DNA, 109 bp, Homo sapiens
tttattttccagcaggctgggtgcggtggctcatgcctgtaatctcggcactttgggaggccgaggcgggcggatcgcgaggtcgggagttcgaggccggcctggccgt

SEQ ID NO: 15196 - DNA, 80 bp, Homo sapiens
gccttctttgtgagcatcgttgtcgtccagtgggccgatctgatcatctgcaagacccggaggaactcggtcttccagca

SEQ ID NO: 15197 - DNA, 56 bp, Homo sapiens
gaaacttaaaagagaaataataatagttatatattacagtactcccagatagccaa

SEQ ID NO: 15198 - DNA, 84 bp, Homo sapiens
gcagtcattcagggagtcctgaacagaggccgattggtgttcctgcttgggaggatctgtgggaatcggcaggagaatgagtcc

SEQ ID NO: 15199 - DNA, 109 bp, Homo sapiens
  misc_feature 23: m=a or c
accagcccccgggagccgtgcgmggccaacaatgaggagcagaatgcaaggggcggcctcgctcccctggccaccgcgggggtcgcggcctcccattacatagcacgag

SEQ ID NO: 15200 - DNA, 189 bp, Homo sapiens
tacttaacattgtgttacaatggcctccaatatcagtacagtaacatgctgtctaggtttacagcctaggtgtgtagtaggctatagcatctaggtttgtgacgtacactctgcgatgttcacctcgtgaaattgcctaatgaaacatttcttagaacatatttctgtccttaagtgatgcgtgactgt

SEQ ID NO: 15201 - DNA, 58 bp, Homo sapiens
cttttggtgaggcacatgtatcgaatttatggattacagttattgatggaggacggaa

SEQ ID NO: 15202 - DNA, 58 bp, Homo sapiens
ggggagagctcagccagccctgcagggcgagcagtccagccttgtgttcaccggctca

SEQ ID NO: 15203 - DNA, 50 bp, Homo sapiens
aattgtgttcgcagccgccgccgcgccgccgtcgctctccaacgccaaca

SEQ ID NO: 15204 - DNA, 82 bp, Homo sapiens
ttggagcaaaagttcacgatgtgagtctccacatgctgctctgtccgtctcagtgagagctgcaagttagtcctgcctccat

SEQ ID NO: 15205 - DNA, 76 bp, Homo sapiens
agagagaaagggagccaggcagagagagagagggacttctgtaaggcggcacgaccacaccaaataacagcagcta

SEQ ID NO: 15206 - DNA, 60 bp, Homo sapiens
  misc_feature 54: r=a or g
  misc_feature 58: r=a or g
gttggctgggtgtggtggtgtgtgcctgtagtcccagctactagggaggctgargcarga

SEQ ID NO: 15207 - DNA, 303 bp, Homo sapiens
taagacacacacacacacacacacacacacacacacacacgtatatatgagcatttagtatcaagcttattcttttatcacggtcatcagcaatacttttaagtatctgcgtcagtctagtattatatttacggggctttggaggagatgagagatggtggtcctttcgcttcagccttacctcgttggacaaaatgcttccgttggagatgatatcaggctgctggtcggtgtaaccggtgacgatggccggcagctagctgacaccttgggttcgagttctttgaggcaagcgccaagaac

SEQ ID NO: 15208 - DNA, 124 bp, Homo sapiens
aatttatgtgaaggatataaaatctgtgtctagatttttaatttttgaagtttttttgtttgtggatgtccagttagcaccatttctgaaaagacattccccaactccattgaatgcctgcctg

SEQ ID NO: 15209 - DNA, 176 bp, Homo sapiens
ctatacttacaatactcagattatatagtaatacttctgatgaagctaaaaataatttaaagagaacaaatgcagaactataatctcctgggaggaaaatattattaatttcattgaaaatattaggtttgaagggggattctcattcctcaggaacccaaacagagcagtcaagt

SEQ ID NO: 15210 - DNA, 56 bp, Homo sapiens
atattggatgccgcagccgctgctgccagcgcttcctcctctgtcttcgccgaggt

SEQ ID NO: 15211 - DNA, 103 bp, Homo sapiens
gaggaggcagctcgcctcagctgcgctgtgcacacctcgcccgggggaggacgcagacccgggcaggcggcagggatgtcggcgaaggagaggccaaagggca

SEQ ID NO: 15212 - DNA, 381 bp, Homo sapiens
  misc_feature 11: k=g or t
  misc_feature 216: r=a or g
  misc_feature 217: s=g or c
aagtacatatktattagctcccattaaacccatccactgtgagcttatccctacctcaaaatttctcctagtggagaggtagtgttctttcttgccaaagctaatctttccaactatgctctgggtctcaccgtcttcttccttctctcatacctttctctccccctctacccgggtggctgtggctgaatgcctcaggggagagattagaaaggrscatattactaaaacctagtctcatgctttcagagtcaaaagcttcaatctctctggcttgacgttccaacaggcttcgtattcgttctgtgcgctcatatttgaatagctcagatcattcagccattcaactggtctacattgagcacatactatttgccttgt

SEQ ID NO: 15213 - DNA, 88 bp, Homo sapiens
ttacaccaactgttttcacttactctctttttgactacattaagagtaacatcctatgatgaatatctttttaacacaaaggccgctt

SEQ ID NO: 15214 - DNA, 119 bp, Homo sapiens
cctcgccttcagcctggccctgcgctccatgcagaacagccccagcattgcagccgctttcctgcccacgttcatgtactgcctgggcagccaggactttgaggtggtgcagacggcca

SEQ ID NO: 15215 - DNA, 58 bp, Homo sapiens
agaccatgcggcacaggcggaaggcggggacacggcacagaccgtggggcacaggcgg

SEQ ID NO: 15216 - DNA, 143 bp, Homo sapiens
acatctttctgtttcgtccttgccttgactgttaattagctcagtggatttttatgtcatgaatgcatttgttttctaatacatcttcattttaatgtaagatagttgaaaagaaggaccaagtcctctgagaaccccataga

SEQ ID NO: 15217 - DNA, 76 bp, Homo sapiens
  misc_feature 16: s=g or c
ggacccgggcgcggasctggcgacgacggggggcgccccagatttcatgtgttctttgtatacaagcgacgcccca

SEQ ID NO: 15218 - DNA, 61 bp, Homo sapiens
aaaataggttggtttgagttgtatgtaatgagatttctaatattctatttgaaatgcccca

SEQ ID NO: 15219 - DNA, 76 bp, Homo sapiens
aaaaaccctcagggacctggtatagacgcagaatctgtttcacacaacaactgctatttgaaggaaaaaaaaaaaa

SEQ ID NO: 15220 - DNA, 56 bp, Homo sapiens
ttttaagctgggaggaagagatagtcgctctggatcacccatggctagacgctgaa

SEQ ID NO: 15221 - DNA, 71 bp, Homo sapiens
attggtgatgaagagagctggaatgatggcactctcattcctacaacaaggaaaatagctggacaaacccc

SEQ ID NO: 15222 - DNA, 114 bp, Homo sapiens
caagcatctgtattaattgatttgatggcataaggttatgaaaataatgtactgccccatgtattactgttccaaaaggagaaagctatgtagaaagatacattaagggtgaaa

SEQ ID NO: 15223 - DNA, 72 bp, Homo sapiens
  misc_feature 13: b=c or g or t
atgaacaggtatbaagtgagttccatgagttttgacaattgaacacgaccctgtagtcaccacccaagacaa

SEQ ID NO: 15224 - DNA, 89 bp, Homo sapiens
gtgtggctggaagacactgaaatctggaaaacagctatttaggtataaatttactttgacttactgagatcaagaaagaactgacatcg

SEQ ID NO: 15225 - DNA, 111 bp, Homo sapiens
tttactctttgtagttttcattggatcttaattaggtggcctcgaagcaacgccttttgaagtgaccctgtggccgttggtagctctgttggcggcttgatggaggatcga

SEQ ID NO: 15226 - DNA, 99 bp, Homo sapiens
tatgtggtttgccttctgtgtccgtgagtgccgctctctacctccctcctgaagtgttcccgggccctgaggagtccctgttctaagattaccctggca

SEQ ID NO: 15227 - DNA, 64 bp, Homo sapiens
agtctgattttattggctaggagtctaacagtcctgtgtggatatacagttttgcccatgacaa

SEQ ID NO: 15228 - DNA, 77 bp, Homo sapiens
aaagcaacagcaagcaatgaaaggagccatggccaaggagctgagctccacataactagaaccggaaccagaacgca

SEQ ID NO: 15229 - DNA, 73 bp, Homo sapiens
tgctattttccttctacatcctattgatggaatgtattgctttgatcaagttttgaatattgagccagcctgt

SEQ ID NO: 15230 - DNA, 73 bp, Homo sapiens
caaaatcacttctaattacaaaatgtgctgttttggtggggtgggcaatcagattattatagttgatgactgt

SEQ ID NO: 15231 - DNA, 132 bp, Homo sapiens
ttgcaatatagattttctctttttaacaaaggaagaatataaattaatttggatcaaatttatttgccttctttgcaatcttggtgatcattttggaaagtaaattgaaaggaaagttaaatagccacataa

SEQ ID NO: 15232 - DNA, 98 bp, Homo sapiens
aaaatctcactcagattcggaagagccatgcaaaagaaattggacaaaggcttcctccacctgtttctttttttcttttgaacttgtaaacgaccgct

SEQ ID NO: 15233 - DNA, 52 bp, Homo sapiens
  misc_feature 8: r=a or g
agagagtrgggacgtccggcttcggagcgggagtgttcgttgtgccagcaac

SEQ ID NO: 15234 - DNA, 64 bp, Homo sapiens
acataagacccggcgcgctcgagtggagttgtataaagcgagcgcgcggcgtcggggcgggtac

SEQ ID NO: 15235 - DNA, 62 bp, Homo sapiens
  misc_feature 50: r=a or g
ttaggtcagaggaattacgtcgtaaccagatatgtttctccaggggggargccggatgctgc

SEQ ID NO: 15236 - DNA, 57 bp, Homo sapiens
attctttaaggtgttttatgaccggatgaaggtggcccagcaagaaatcaaagcaac

SEQ ID NO: 15237 - DNA, 77 bp, Homo sapiens
aaagggaaacgctgaggcgccgggggtgactgtgggggagggggaccccgagccgcggagacccccggggaggcgac

SEQ ID NO: 15238 - DNA, 128 bp, Homo sapiens
tgacttgatttccagaagaccccatctctcactactaccacagtggagatttaagtttcaacacatgactttgggggacattcagaccatagcaagcagtgaggagactatcgtaattatccaggcgt

SEQ ID NO: 15239 - DNA, 62 bp, Homo sapiens
aaaacactgccctctcccttcttgacccctagcccttccttccctccctccttccctcctgt

SEQ ID NO: 15240 - DNA, 51 bp, Homo sapiens
tttattggtctattcagattttcggttatttctttgtaaaatttcccagac

SEQ ID NO: 15241 - DNA, 60 bp, Homo sapiens
tttatttttctactctgcgacaaactgaaaagattccagcacgctaatttaaccaccctc

SEQ ID NO: 15242 - DNA, 86 bp, Homo sapiens
aataggctgctcgttcgtggtcaacaggaagttcttcggtgaaattggtcttctggatcctggcatggatgtatacggaggagtga

SEQ ID NO: 15243 - DNA, 50 bp, Homo sapiens
cccttccaccgcaggctgccccatggcagccagtgacaccgctgagacaa

SEQ ID NO: 15244 - DNA, 66 bp, Homo sapiens
aatagagacggggtttctccttgttggtcaggctggtctcgaactcccgacatcaattgatccacc

SEQ ID NO: 15245 - DNA, 94 bp, Homo sapiens
  misc_feature 41: r=a or g
tcaattcagcaaccatttattgagcatctattatgtgccargcactgtgccgggcactggggatatacacaaagccataagcactggggactgc

SEQ ID NO: 15246 - DNA, 92 bp, Homo sapiens
tcttgatttggctacctagcctcaagggtttgttgttgttatttttgagacaaggtctccctctgtcacccaggctggagtgcgtggcacgt

SEQ ID NO: 15247 - DNA, 186 bp, Homo sapiens
  misc_feature 27: s=g or c
  misc_feature 33: s=g or c
  misc_feature 36: n=a, g, c or t
aagtgggtcagggccgggccggcggasgcgcasggnggctgcagattctttccaccatggccagacgcccccggaacagcagggcctggcacttcgtcctgagtgcagcccgccgagacgcagatgcccgggccgtggctctagcaggctccactaactggggctacgactctgatgggcagcaca

SEQ ID NO: 15248 - DNA, 209 bp, Homo sapiens
  misc_feature 123: n=a, g, c or t
  misc_feature 197: v=a or c or g
  misc_feature 198: n=a, g, c or t
ctcattgacttaatttctgtccttatatgctgtgtctaggacatttagatataggaggtaaattctagcacattttgggaacactgtgaatagaggagctgataaacacatggagtgaaacgngccaagaattgctgtgaatattaaagataaataaaggccagtaacaggaaaaagaaagggacacacaattcatvnatcagattcga

SEQ ID NO: 15249 - DNA, 93 bp, Homo sapiens
agtcccccagcggcggctgcgagaagggcagccgctcggtctccggcagccgccgctcgggcaaagccagagaaagaccgaggctcggggcgt

SEQ ID NO: 15250 - DNA, 110 bp, Homo sapiens
attgccaggaccatctgaactgtgctttacagggcatggcactgccctctgataaggggcaggcatccagtaccccaggacagggtcagggcaggaatccagtgggcaac

SEQ ID NO: 15251 - DNA, 89 bp, Homo sapiens
aaagcctctttcactttctggagatcactgagctctccatcctctctgggaatttaccgatgcccagaacgcccttctttcccccacac

SEQ ID NO: 15252 - DNA, 70 bp, Homo sapiens
ctccatttctgcagggacacgggcagcctggctcccaggacacgacttgtaatgaaagtttggggaccta

SEQ ID NO: 15253 - DNA, 50 bp, Homo sapiens
aaacacctcaccggacgtgtaggaaatagctgtgctggcaagaacccaat

SEQ ID NO: 15254 - DNA, 50 bp, Homo sapiens
  misc_feature 41: s=g or c
  misc_feature 42: r=a or g
cttgtacaatagtgtgtacacacacacacacacacacacasrcacacttc

SEQ ID NO: 15255 - DNA, 75 bp, Homo sapiens
tacagagagtatgttttgacactttgaagtagtttaaccgtttggttatggtcagaaagaacttacccagtagac

SEQ ID NO: 15256 - DNA, 122 bp, Homo sapiens
gcgatgtctccggcggctgcggcggctggagcaggcgagcggccagggcggtgctcctgggcctgtcgctggttggcctcttactgtacctcgtgccggctgcggctgcactggcctggcaa

SEQ ID NO: 15257 - DNA, 61 bp, Homo sapiens
atatgatccgctcggcttcctgggtctggctgctgccgcccgccggtgtccgcccgtgacc

SEQ ID NO: 15258 - DNA, 57 bp, Homo sapiens
aagagttaagtgaggatagaatcatcctcttgaacctcatttgcacagcaggcacca

SEQ ID NO: 15259 - DNA, 70 bp, Homo sapiens
tgctggttctttttaatctctttctgttggatgtgttatagaatcttgaggctcaggccttggactgccc

SEQ ID NO: 15260 - DNA, 120 bp, Homo sapiens
ctctctcagggccctgctggcctcccaggaatccccggcattgatgggatccgaggcccaccgggcactgtgatcatgatgccgttccagtttgcaggcggctcctttaaaggcccccgg

SEQ ID NO: 15261 - DNA, 98 bp, Homo sapiens
tgcagtggtgtgatcttggctcactgaaacctccgcctcctgggttcaggtgattctcttgcctcagcctcctgagtggctgggattgcaggtgccca

SEQ ID NO: 15262 - DNA, 62 bp, Homo sapiens
tgccactgtagcctgggcaacagagtgagaccccagggcaaaaaaaaaggtggggggttaaa

SEQ ID NO: 15263 - DNA, 75 bp, Homo sapiens
tttgtaaaaatcagcccatttttatgaataaaaaaatagtagatacaagtttgcaatataagaaatgaccacagc

SEQ ID NO: 15264 - DNA, 110 bp, Homo sapiens
attactctcttctgccaggaaataagcagggagcataggcttcttgcaagaatggagtgcgaagatgggctttgtttggcttaggaaatgccatacattttggaggttaa

SEQ ID NO: 15265 - DNA, 50 bp, Homo sapiens
tttcccagtcagcaagggcttgggaagtgcatacagttcctgctcctggt

SEQ ID NO: 15266 - DNA, 179 bp, Homo sapiens
cagatggataattgcagaacttttctcccattctgtaggttgtctgttcactctgatgatagcttcttttgctgtgcagaagcgctttagtttaattagatcccatttgccaattcttacttttgttgcaattgctttcgatgtttttgccatgaaatctttgcccatgtctatgccct

SEQ ID NO: 15267 - DNA, 127 bp, Homo sapiens
  misc_feature 103: r=a or g
  misc_feature 104: r=a or g
ttcctagccgtcttcccagaacgtaatgtgtcttaaatccgtcatgctgacctggggccctgggtgcccttgggcaggagctgatggcactagtaccttgatrragttcttactggcaccagaagga

SEQ ID NO: 15268 - DNA, 98 bp, Homo sapiens
  misc_feature 66: w=a or t
  misc_feature 67: k=g or t
tgcagtggtgtgatcttggctcactgaaacctccgcctcctgggttcaggtgattctcttgcctcwkcctcctgagtggctgggattgcaggtgccca

SEQ ID NO: 15269 - DNA, 91 bp, Homo sapiens
cagagaaggtacccaaatggtggttcaaacacaggctggctaataagctgtgaggtgacttaccaaaaaacaacaacaacaaaaacccaaa

SEQ ID NO: 15270 - DNA, 52 bp, Homo sapiens
gtttcatctctatggctgtcagaggtgggcggctttgaccgagaggctgctg

SEQ ID NO: 15271 - DNA, 186 bp, Homo sapiens
  misc_feature 104: r=a or g
agcggtggcagcggccaggccgggagccaggcccctgagggagggagctgtcagccagggaaaaccgagaacaccatcaccatgacaaccagtcaccagcctcrggacagatacaaagctgtctggcttatcttcttcatgctgggtctgggaacgctgctcccgtggaattttttcatgacggcc

SEQ ID NO: 15272 - DNA, 76 bp, Homo sapiens
gtcctcagcccgcgcccgccatcgccgtcatgctgggcgccgctctccgccgctgcgctgtggccgcaaccacccc

SEQ ID NO: 15273 - DNA, 102 bp, Homo sapiens
caaaacacatttagccccaaacaagaattgtggattggtatttgttttgttggtgatagttccttgtcacacagattcttcttgaaacatactccaggggcg

SEQ ID NO: 15274 - DNA, 152 bp, Homo sapiens
  misc_feature 144: s=g or c
  misc_feature 145: b=c or g or t
gtgatccacccacctcagcctcccaaactgttgggaggctgaggtggaaggatcgctttagcccaggaagtcaaagctgcggtgagctgtgatcacaccactgtactccagccagggcaacagagagagaccctgtctctctgsbagcgcac

SEQ ID NO: 15275 - DNA, 64 bp, Homo sapiens
tgagggttgtataattgttttgaaataattgtcgttggttacaaagatcaatagcaagggtggc

SEQ ID NO: 15276 - DNA, 57 bp, Homo sapiens
acttttcattgcaggagaagaggacaaagatactcagagagaaaaagtaaaagaccg

SEQ ID NO: 15277 - DNA, 67 bp, Homo sapiens
taaagcgcggccccgcgcacagttgcggcgggagagcggcggggccgagagcgtgactcgcccgagt

SEQ ID NO: 15278 - DNA, 108 bp, Homo sapiens
ttaaatgactataaatgtgggtctctttgttagactccttaatctgttgcattgatctatttgttgatccttaagccagtaccatactgtttagattacccagcccta

SEQ ID NO: 15279 - DNA, 92 bp, Homo sapiens
catggagaagacaagtctaccagagactgaaacaataaacagtgagaactaatgcacaacttcaggagaaaactacagaacaccccaagaaa

SEQ ID NO: 15280 - DNA, 130 bp, Homo sapiens
  misc_feature 84: r=a or g
gacaaactcgcctccgagcgctgctctggccgtggtcgtggcggctgccgcttcgtcggaggatttgagggccggctggcccgrccaccctgcccatccctgtgctccttccggacacaagccttagccc

SEQ ID NO: 15281 - DNA, 56 bp, Homo sapiens
aattttttgctttttgctttatttatgttttagcaaaactggtgatccaagcaagt

SEQ ID NO: 15282 - DNA, 63 bp, Homo sapiens
ctttctgaaggaagttagactgcgatggtaaagggggaaatgggttaatgagattgcaggcgt

SEQ ID NO: 15283 - DNA, 180 bp, Homo sapiens
taagacgtatgtaacatgatgttaactttgtggtctaaagtgtttagctgtcaagcccagcaggctgaggcagaagaatcacttgactccgggaggtggaggttgcagtgagctgagatcgcgccattgcactccagcctgggcaacaagagcgaaactctgtctcaaaaaaaaaaaaaa

SEQ ID NO: 15284 - DNA, 89 bp, Homo sapiens
tagaactgggaaggcagaggttgcagtgagccgagatcgtgccattgcactcgtgggcgacacggcgagatctgtctcaaaaaaaaaaa

SEQ ID NO: 15285 - DNA, 132 bp, Homo sapiens
attatattcttaatataaatacaatcacatcttgaaatcactttgaaattttctttattttccttttttctttccccaacatatgttctgaagtacacaggctgcatcagtcagccatttgtcctgagctaa

SEQ ID NO: 15286 - DNA, 121 bp, Homo sapiens
  misc_feature 13: w=a or t
  misc_feature 29: s=g or c
  misc_feature 39: r=a or g
  misc_feature 41: s=g or c
  misc_feature 45: y=c or t
  misc_feature 46: s=g or c
tgcccagggaggwgttcggtgcaggagtsaatgactcartsggcysaagtggtagcagagtcacaagggctctcgtgacattcttgtaatgactctcagagcagaagtcacttcctagcct

SEQ ID NO: 15287 - DNA, 103 bp, Homo sapiens
  misc_feature 2: k=g or t
  misc_feature 3: k=g or t
ckkcacttcccagacggggtggcggctgggcagaggctgcaatctcagcactttgggaggccaaggcaggcggctgggagatggaggttgtagctagccgagg

SEQ ID NO: 15288 - DNA, 82 bp, Homo sapiens
accaaacatattttagatatatcttgactaaatactgaactatttcagtgccttcagttacaatgtgttgctcacactaggc

SEQ ID NO: 15289 - DNA, 298 bp, Homo sapiens
atgaatattcaagattgatattactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgacct

SEQ ID NO: 15290 - DNA, 135 bp, Homo sapiens
  misc_feature 109: r=a or g
ctgtaccaagatgaagcccctaagggaacagaggcttcttcggggacagaagctgccactggccttgaaggggaagaaaaggatggcatctcagacagtgatagcagtrctagcagtgaggaagaagagagctga

SEQ ID NO: 15291 - DNA, 63 bp, Homo sapiens
tttccaacgactgtaggaggaaaaattaaggggagagaggaaaacaaaaccaaccaacccctt

SEQ ID NO: 15292 - DNA, 58 bp, Homo sapiens
agatccggttccatgccatgttttggaatttgtgtttacgtctgccttcatccccatc

SEQ ID NO: 15293 - DNA, 67 bp, Homo sapiens
  misc_feature 52: s=g or c
atccatctgtccggccgactgtccagcgaaaggggctccaggccgggcgcasgccacccggggtacc

SEQ ID NO: 15294 - DNA, 192 bp, Homo sapiens
cgttgattcacttattcaataacttccctaatcacctactatgtgcctagcacggttccaggagctggggacagatacagcaatgaaaaaacagaaaaccctgcccttgtggagcttctgctttgtgtagagagatgggcaataaacaaagcaaatattttctctattagaaaatggagtgcacagagagct

SEQ ID NO: 15295 - DNA, 94 bp, Homo sapiens
tcatcaaagagaaagaagaaatcctatttattgaactccagtgaagtgctggaagttgtgctagatgctttacaatactttattttgttggggt

SEQ ID NO: 15296 - DNA, 118 bp, Homo sapiens
atgggaaaataaggcacttcaaccctcaagtagtttatgccccacaaaggtgagatatatacatcattggaattatagaccagtgcataactggcagtgtttaaagaatgccactaga

SEQ ID NO: 15297 - DNA, 168 bp, Homo sapiens
  misc_feature 44: k=g or t
tttgtagtttttacaggcggcgttgtctttgatagatatttgtkattaatatcggagacaaaatgcccacaggggctgcccagtcagcacttatactgaattgagtgacttaattgccctcagtacaatatatacatactaaatttgattatatatttcaccacccct

SEQ ID NO: 15298 - DNA, 118 bp, Homo sapiens
catttattttttttgttgtcattgttattaggaagcaaaaaaatgtacagttacaagaatcattttccaaacagaggttaaatatgagctgaaaagtgtaaaaaaggaagaggaacac

SEQ ID NO: 15299 - DNA, 116 bp, Homo sapiens
  misc_feature 13: y=c or t
  misc_feature 20: r=a or g
tactgagattatytgtccaraagtttagtcttatatcccttccattcagaaaagggggcagtttttaaaggcctctgtcataaaaggaaatgtatattttgactagtggagcatca

SEQ ID NO: 15300 - DNA, 202 bp, Homo sapiens
  misc_feature 14: m=a or c
tgattttgatgcamaactagttaaaagcctttcataccagtcagtattcccagccttgagcgcacgcgcgcacacacacatacgtcttctttcctggggcagcccctctcatcttgccccacatcattctcaaccgccgcacctcgggcatcatcgagatcgagatcaaaccgctacgcaagatggagaagagcaagtccac

SEQ ID NO: 15301 - DNA, 58 bp, Homo sapiens
  misc_feature 39: s=g or c
atttgtttccacggcggcgaggagcgccggcgagcgcasccgggaccgagcggggact

SEQ ID NO: 15302 - DNA, 56 bp, Homo sapiens
  misc_feature 51: k=g or t
ctggtttctatttatcactttggaaggagaaagagggtcaggagacaagakagccc

SEQ ID NO: 15303 - DNA, 77 bp, Homo sapiens
tcaaaagtcatcaaattgcacacatattatttcacagtatgtatgttttaccttaaataaaaatgttttggccaggc

SEQ ID NO: 15304 - DNA, 242 bp, Homo sapiens
ctaaaatcttccagaaagaaatccagtcaactgaaaccaccttagaccacaatcaaacccttaagggcaatcacggcccaggatagtgttacacagctggaaattgctgctagaggaggaggcttggctgaatgactgaattaatagtacatgtacagggcttacgaaagcactcaaatgtcaaaattttggcttgggagactctacccccatcctctccctaggaggcctgcccccgccga

SEQ ID NO: 15305 - DNA, 81 bp, Homo sapiens
taaaattagaaccaggttttcttatgttcttagaaactagcaggaatgacacagaaactttatggatctaacccaggacga

SEQ ID NO: 15306 - DNA, 225 bp, Homo sapiens
aaaggactatggaagctgttcaagatacatttgatcttcagaaaagcagaatttggttcaactgttgacagagacggccgagggtttcactgtgttagccaggatggtctcgatctcctgacttcgtgatccgcccacctcggccttccaaagtgctcggattacaggcgtgagccactgcgcccagccgctaattttcatatttttagtaaaaacagggtttca

SEQ ID NO: 15307 - DNA, 109 bp, Homo sapiens
  misc_feature 109: n=a, g, c or t
tttattttccagcaggctgggtgcggtggctcatgcctgtaatctcggcactttgggaggccgaggcgggcggatcgcgaggtcgggagttcgaggccggcctggccgn

SEQ ID NO: 15308 - DNA, 98 bp, Homo sapiens
attaaaaaataaaatatgccactatcatatgttccaacaactgtgcctttggacatttatcctagaaaactgaaaactctgttcacaaaaccccatat

SEQ ID NO: 15309 - DNA, 54 bp, Homo sapiens
aatgattagtttttgttggtggttttgttttcatttatttttgcaagagccgct

SEQ ID NO: 15310 - DNA, 103 bp, Homo sapiens
agtcaacaaaatccaactaaaatgaacttgaactcaaggaaatctacaatgagaaatcttacggtcacacttgaaaattacaaagagaatttgaaagcagaca

SEQ ID NO: 15311 - DNA, 88 bp, Homo sapiens
agattacctgatgcagctgatgaacgacaagaagctcatgagcagcctgcccaacttctgcgggatcttcaaccacctcgagcggctt

SEQ ID NO: 15312 - DNA, 96 bp, Homo sapiens
cataaaagcagtgtggacctaaagagtgagcagtagcaagacttattgcaaagagcgaaagaacaaagcttccccagtgtggaaggggacccgagc

SEQ ID NO: 15313 - DNA, 94 bp, Homo sapiens
gaattttcttttccctctaaatccattttacaccctgcttccacactactcttattgaagcacagccccctgccctaaaatcttctgttggctt

SEQ ID NO: 15314 - DNA, 227 bp, Homo sapiens
  misc_feature 216: h=a or c or t
ctttttctctttctcttctggcccacagccgcagcaatggcgcctcaggagtccctcaaatttttccttgctctcttctccttcaaacactgactggtgaacattgcacgcaaacaacgagttggggaggtcattgaagtcagtgattgcttgaaaggcttcttctgcaaaacaacgagttaagccctactgtccctgcgccatcctctctcctchgcctccccaac

SEQ ID NO: 15315 - DNA, 416 bp, Homo sapiens
  misc_feature 213: k=g or t
  misc_feature 214: d=a or g or t
  misc_feature 215: w=a or t
caggtatcagagatggagacacaaaaaaaatgataagttgcctcaagagccttaaggtattccccttccccatctccaacatcttccccaagccgtccaatggatttgggggcaattactcagagaaggatctccgaagtccagtagcaatagggaaaaaaaacttgagtgcagtagtttatttggcgtttggctccaggatgcaggagtggkdwagatggtagagagacgcgatgagtgtgaggaatgagggagccatgtcatcacaacagccctagaatttattgctagacactgtcctgaatgatctgtttctcaggacaccacgcttgcccttgttcccctttgagagggttggtagcaaaaccctgaaggctgggtgaagaaattccaagaaaagtttgcacacttgccgg

SEQ ID NO: 15316 - DNA, 129 bp, Homo sapiens
tttcttatgtgcggcggcgtgatgttgggcggccacagagagattggtgtttttgtgaggcagtgagacctaaggtaacctttatcaaaaggatggagttgggaaaaggaaaactactcaggactggac

SEQ ID NO: 15317 - DNA, 56 bp, Homo sapiens
  misc_feature 36: m=a or c
cctgctgcggcagcaccccctacccgctgtgaccamgtcccgctgcttgccaccca

SEQ ID NO: 15318 - DNA, 61 bp, Homo sapiens
  misc_feature 50: s=g or c
aagacaaggtcctctctgccgccagggatcccacgcttctcccacctgasacaggggtagc

SEQ ID NO: 15319 - DNA, 109 bp, Homo sapiens
  misc_feature 12: m=a or c
agcgcgtagcgmtgagcctcccggggcgggcccgggacgcgcccctgggggccccggccgtaagactcgcgtagtctgttgggagttgagggagggggacaacgcggac

SEQ ID NO: 15320 - DNA, 55 bp, Homo sapiens
aatttagcagccgctatcagaaatctaggatttttcatctcagtgtccctcagac

SEQ ID NO: 15321 - DNA, 66 bp, Homo sapiens
ctgtctcaagatgcaaggagaggatacaccaccatcctgctggctgctctgagtgtcacccccaaa

SEQ ID NO: 15322 - DNA, 92 bp, Homo sapiens
atgttaaagaagtgtttgctattattacattgatgaaaacaaagctcatatttgttccagagactcgctcacgtttctgatgacagcaccag

SEQ ID NO: 15323 - DNA, 115 bp, Homo sapiens
ttccactgttctttatctctcttactaagttctcagggtcgaatgaactctaactgctccttgctagtgataagcaagttgcaaattacagaattgtcagtgattgaatacacta

SEQ ID NO: 15324 - DNA, 209 bp, Homo sapiens
  misc_feature 83: k=g or t
  misc_feature 95: m=a or c
  misc_feature 145: w=a or t
  misc_feature 209: k=g or t
aagatgaggcaattaattgcctgtttcctggcttccaatgtttgttctcagtttctcagaatttttcttagcgcaaagcagtkagcggacacgcmcggcctagttcattatctttaataatgaactagacaataaactaattgtwgtctaaaaacttctggtatgcctgctctccagcagctggaaacagatcttcctgcctgacccak

SEQ ID NO: 15325 - DNA, 155 bp, Homo sapiens
  misc_feature 26: s=g or c
  misc_feature 27: v=a or c or g
  misc_feature 123: v=a or c or g
gttttaatcccaagcagatgcgagasvtaaaatagtgtatttgccctccctccaggcttttctggtagtattttgtctgtgaaactaagaggctctagctgctattagaagagggaaggagtvaggatgagcttttgaaaaaaaaaaaaaaaaaa

SEQ ID NO: 15326 - DNA, 93 bp, Homo sapiens
tttggactggaggcttgggcccgccgaaagtgggcttctgggccatctcgcatattctcaacggctgtgcgtgtccttaaaagtccctgggat

SEQ ID NO: 15327 - DNA, 57 bp, Homo sapiens
agtttctggagctacttgccaaggctgagtgtgagctgagcctgccccaccaccaga

SEQ ID NO: 15328 - DNA, 186 bp, Homo sapiens
  misc_feature 45: k=g or t
tgatatcagggcattaaagattttaggtatttattgtagtcttckgggcttgtttatatacttccttcttgggaagactttccaggtatttgtaggtacttgggggtatgatctaagtctttggtcactgaagccatgtctgctttaggggccaccctaagtcctaatcttctgtaggaggcacca

SEQ ID NO: 15329 - DNA, 55 bp, Homo sapiens
actgatgtagcattcacaactgtgtctcattttattcttaatcccatgaggccaa

SEQ ID NO: 15330 - DNA, 230 bp, Homo sapiens
  misc_feature 115: m=a or c
  misc_feature 190: y=c or t
  misc_feature 191: r=a or g
  misc_feature 192: s=g or c
  misc_feature 226: n=a, g, c or t
tactgtgtatataatggaaaacttaagtccagtttgaaacatctagtctttctaggtgtttaaaagtgtacaacggcctgtcgcagtggcgcaatgtggtgccatcttggctcamtgcaacctctgcctcccggttcaagcgattttcctgcctcaggctcccgagtagctgggattacaggcgcccgcyrscacgcccagctaattttttgtatttttagtaganacgt

SEQ ID NO: 15331 - DNA, 76 bp, Homo sapiens
  misc_feature 23: s=g or c
  misc_feature 26: w=a or t
  misc_feature 27: r=a or g
catgtaccgctacctgggcgaasgcwrttgctgtcccgggccgggcccgctgccctgggctcggcgtccgccgacg

SEQ ID NO: 15332 - DNA, 60 bp, Homo sapiens
ttctgattggctccattcatgagcaaaggtgattgtgagctgtatattacacaggtgtgc

SEQ ID NO: 15333 - DNA, 104 bp, Homo sapiens
attatcagacatagagtggtgcttacagtctcagagcattaccctgtattattcaggtagatgatggtttggggggaaattactattaatttgaaagactctac

SEQ ID NO: 15334 - DNA, 99 bp, Homo sapiens
  misc_feature 17: s=g or c
agaacagtatgcgtcasagtacattcacgttctgactgaaggacaaaaggatgagagagcagtctgcgtggctgccgcctgcaacaccgcgagcccggc

SEQ ID NO: 15335 - DNA, 65 bp, Homo sapiens
cttaaaaatatttaaattcttaaaaaattgaaaagattattcttctcaaatttagttgagcccga

SEQ ID NO: 15336 - DNA, 209 bp, Homo sapiens
ataaatgaatttggccgggcgcagtggctcacgcctgtaatcccagcactttgggaggccaaggtgggcggatcatgaggtcaggagatcaagaccatcctgactaatgtggtgaaaccccatctctactaaaaatacaaaaaaatgagccgggcgtggtggcgggcgtatgtagtcccagctactccagaggctgaggcgagaagtgg

SEQ ID NO: 15337 - DNA, 71 bp, Homo sapiens
tctctggagtcggctagccggggctcggggagcggggtgcgcagggctcggggccacgccttgccacctac

SEQ ID NO: 15338 - DNA, 62 bp, Homo sapiens
  misc_feature 12: s=g or c
ctattttgtctsatattggtgtgaatgctgtacctttctgacaataaataatattcgaccaa

SEQ ID NO: 15339 - DNA, 172 bp, Homo sapiens
  misc_feature 51: s=g or c
  misc_feature 86: s=g or c
  misc_feature 108: y=c or t
accaccgccttccaagtttccccttgtggatgcgcggccccgcggctctgstcctcccggcgcagaggggccgggagaggccacasgagcggacctggcacgggattyctgaggaacgggagaagactggcgcccgacccgctctggagggtcggtgaacgatgaagggacc

SEQ ID NO: 15340 - DNA, 87 bp, Homo sapiens
aaagattggctgcggtgtggtggtgagcgcctgtaatcccagctacttgggagtctgaggcatgagaattgcttggacctgggagta

SEQ ID NO: 15341 - DNA, 61 bp, Homo sapiens
attgacagaacagagctctagcgactgggccctgtagtcagcaattatccaaatacctgct

SEQ ID NO: 15342 - DNA, 348 bp, Homo sapiens
  misc_feature 13: s=g or c
  misc_feature 14: m=a or c
  misc_feature 21: k=g or t
  misc_feature 233: s=g or c
cccatgggggctsmagacatkgtattttactttgtgcaatatgaggggactgcatgcaagctcagggtgctccctcctcagtctttgggggattcaaatgcatgatattgtatgtacctgggagtagagtgcgttcgtagtttgagtttgctaggcaactgcgttgaaaggacgttcgccaagggccgtgtgtaaatacgaactgcgccatggagaggagaggcactgccggsagcccttgccagatctccctccctctctctgtgcagtagctgtgtgtccgaggtcagtgtgcggaatcacagccaaggacgtgaagagatgtacgggggaaagagaagctgggga

SEQ ID NO: 15343 - DNA, 73 bp, Homo sapiens
tcttagaataaatgtattttgcatgaaattcatttatcaaaatttggacttcagtctcacagcacaccggacc

SEQ ID NO: 15344 - DNA, 108 bp, Homo sapiens
  misc_feature 12: k=g or t
atagactgcttkagcaaagtacacaataatggcttataaatggtgtttaaatatgcattcattttaatctactgaacaaatattgggataactccaaaccgcatgaaa

SEQ ID NO: 15345 - DNA, 61 bp, Homo sapiens
ccactctgaaagccaagaatatggagattaaagtaaaggactacatctcagctaagcctct

SEQ ID NO: 15346 - DNA, 116 bp, Homo sapiens
  misc_feature 39: s=g or c
  misc_feature 56: s=g or c
  misc_feature 61: s=g or c
  misc_feature 107: s=g or c
  misc_feature 109: s=g or c
  misc_feature 115: s=g or c
ttaacagcatcggggaaaccacccccatgatccaatcasctccccccaggcccttsccttsacatgtggggatcacaatttgagatgagatttgggtgaggacacasasccagasa

SEQ ID NO: 15347 - DNA, 72 bp, Homo sapiens
  misc_feature 13: s=g or c
  misc_feature 14: r=a or g
gtccttcggctcsrgagccgcgactgcgctcgcctaggtggtgggcggggagggaaggaagggagcgggccg

SEQ ID NO: 15348 - DNA, 102 bp, Homo sapiens
ttttctctctctctctctctttctgtctcttcctcgctccctctctttctctcctccctctgccttcccagtgcataaagtctctgtcgctcccggaaccca

SEQ ID NO: 15349 - DNA, 56 bp, Homo sapiens
  misc_feature 14: w=a or t
aattttttgctttwtgctttatttatgttttagcaaaactggtgatccaagcaagt

SEQ ID NO: 15350 - DNA, 75 bp, Homo sapiens
  misc_feature 13: r=a or g
acattggaactcrcaactcttctaactccagggatttgaatgtgatttcttctttttaattcagagtagcgtaat

SEQ ID NO: 15351 - DNA, 86 bp, Homo sapiens
aaagattggctgggtgtggtggtgagcgcctgtaatcccagctacttgggagtctgaggcatgagaattgcttggacctgggagta

SEQ ID NO: 15352 - DNA, 62 bp, Homo sapiens
cttaaagccaatgcagaatacattaagatggcagatcactatgtgccagtgcctggaggctg

SEQ ID NO: 15353 - DNA, 58 bp, Homo sapiens
  misc_feature 11: r=a or g
  misc_feature 13: r=a or g
  misc_feature 14: w=a or t
  misc_feature 26: w=a or t
  misc_feature 44: s=g or c
  misc_feature 45: h=a or c or t
agaagtgagtrcrwgagcggcgcagwagatcccagctcggaccshggacggcgcgcat

SEQ ID NO: 15354 - DNA, 78 bp, Homo sapiens
agattcttaactccaggaggccagatactctcattcctctctgtacccacatctgacacatcctcagttccggtgtgc

SEQ ID NO: 15355 - DNA, 59 bp, Homo sapiens
cctgagtgtcagtttgttgtccctattgtagatgaaatagtgatgtagcaaaaacctat

SEQ ID NO: 15356 - DNA, 92 bp, Homo sapiens
acattttctcgcgctctctccggctctcctttgtttattttctaatctatatttttactggaagatttcctctttattctctcccgccctaa

SEQ ID NO: 15357 - DNA, 175 bp, Homo sapiens
  misc_feature 83: k=g or t
  misc_feature 105: r=a or g
  misc_feature 106: r=a or g
  misc_feature 109: d=a or g or t
  misc_feature 110: r=a or g
  misc_feature 144: r=a or g
  misc_feature 145: s=g or c
caagaatatcagcacgagaggctgaagagggaagaatatcgcagagagtatgagaagcgagagtctgagagggccaagcaaakggagaggcagaggcagaaggcrrttdragagcgccgtgtgatttatgtcggtaaaatcagrsctgacacaacacggacagaactgagggacc

SEQ ID NO: 15358 - DNA, 57 bp, Homo sapiens
gcttcatgctcgcagggtaccgcttccatgacacgtagataaccagcaggatgacga

SEQ ID NO: 15359 - DNA, 63 bp, Homo sapiens
  misc_feature 63: k=g or t
agagacgggtttcaccgtgttggctaggatggtctcaatctcctgatctcgtggtccacccak

SEQ ID NO: 15360 - DNA, 50 bp, Homo sapiens
agagagtggggacgtccggcttcggagcgggagtgttcgttgtgccagac

SEQ ID NO: 15361 - DNA, 70 bp, Homo sapiens
  misc_feature 26: n=a, g, c or t
gtcggctcgcgccccgcccccgtcanccccctcccctgtcgcgcgctggggctgtttctcgctccttcca

SEQ ID NO: 15362 - DNA, 143 bp, Homo sapiens
agtaaggctgtgtggccgccagatgatgcccgagaccgcggctccgcggtagtgccccgacaaggtggagcccggcgggcccgcgagtccgagacctgtcctaggagctccagctcacgtgacctgtcactgcctcccgcata

SEQ ID NO: 15363 - DNA, 72 bp, Homo sapiens
  misc_feature 56: s=g or c
tcttttcccttccccaggcccctcggctccctcccagatcccacccccagccccastggttgccaaacactc

SEQ ID NO: 15364 - DNA, 53 bp, Homo sapiens
  misc_feature 46: r=a or g
caccacacggcgcgacaagatggcggataaggagaagaagaaaaargagaggc

SEQ ID NO: 15365 - DNA, 115 bp, Homo sapiens
aagaccaataataggctctgaaattgaggcaataattaaaagcctatgaaccaaaaaaagtccaggaccagatggattcacagctaaattctaccagaggtacaaagaggagcaa

SEQ ID NO: 15366 - DNA, 81 bp, Homo sapiens
aacgtgtagtaggtatgggatcttgctgtgtcgcccaggctggtctggaactcctgggctaaatgattcttctgcctcgga

SEQ ID NO: 15367 - DNA, 84 bp, Homo sapiens
caaagaagtgtgtcgcctacttttttaaacccctcagacgaaaatttgaaaacattatgcaattttgcgggtgatctggcgcga

SEQ ID NO: 15368 - DNA, 212 bp, Homo sapiens
  misc_feature 14: r=a or g
cttaccgtgtagtrgtaactattcacttcttaatttatgacctcaatcaatttaattgtctagaatgtaaaaagtctttaagacataagaattctcaccaggccttagctgccttcctgtgggacagggctcgggacctgcagcctgccatgcctaagcctcccacctcctccgtggtctcctgtggggccccagcctcctcgacgtgcacc

SEQ ID NO: 15369 - DNA, 102 bp, Homo sapiens
  misc_feature 82: r=a or g
caatttccaggacattcctcctcttgtggaatctagccttccaactggtggtattcacctgataataagcacactgccagtratatggtctgaatctgcccc

SEQ ID NO: 15370 - DNA, 69 bp, Homo sapiens
aagtagctgggattacaggtacctgccaccatgcccggctaatttttatatttttaatagagacgggtt

SEQ ID NO: 15371 - DNA, 70 bp, Homo sapiens
atatccagaatctacaaggaacttaaacaaatttacaagaaaataacaaccccatcaaaacatgggcaca

SEQ ID NO: 15372 - DNA, 87 bp, Homo sapiens
cagcactgaactctgcaaccagtctgccccctcccctagataattggagcagccgtagccatctcatcctctccttgttgacccagt

SEQ ID NO: 15373 - DNA, 70 bp, Homo sapiens
agagaagcttagatttgagattcgaaggaacattgtagggtagatctcaacagggatttgagaaggagca

SEQ ID NO: 15374 - DNA, 159 bp, Homo sapiens
  misc_feature 36: d=a or g or t
agtagttcgccgcgcccaacctcccgagaggcagtdtaggcttttcaactgagccccaaattcctcatagccgtaagaaaggctcctaaaaaattatttcccttctcctctatgcgcttctcttccttctttaggaaaatataagaaaattatcaggcc

SEQ ID NO: 15375 - DNA, 102 bp, Homo sapiens
  misc_feature 31: n=a, g, c or t
agtgcgggctggcagtgcgggcagagccggnctgagaggggcggccctggaggagacggaggccgcgggtgggcccgaggcgcaagaggaagatgaggacac

SEQ ID NO: 15376 - DNA, 133 bp, Homo sapiens
cagattttatttttagaaggcatattacattttgaaggacaggccaatatattgagggcttggggtcaatttagaaactgcattatttttcagattaccttagtttcaatattaaaaccaatttccagagaaa

SEQ ID NO: 15377 - DNA, 111 bp, Homo sapiens
aagtgaaataatcagactcaaaaagacaactactacatgattccacttaacagagctggagtgcatcccggggacttgggagctctggaaagaggagcaggaaagggacca

SEQ ID NO: 15378 - DNA, 145 bp, Homo sapiens
agagccatggcctcccacctgcgcccgccgtccccgctcctcgtgcgggtgtacaagtccggcccccgagtacgaaggaagctggagagctacttccagagctctaagtcctcgggcggcggggagtgcacggtcagcacccgaa

SEQ ID NO: 15379 - DNA, 51 bp, Homo sapiens
gtctccgcttttttttcacatttccttgcgaccctggcccttgagcgactc

SEQ ID NO: 15380 - DNA, 65 bp, Homo sapiens
aagacatgacttttagctcataataggtaacatttaattatgtatcaaaaggtaaagacgccccc

SEQ ID NO: 15381 - DNA, 98 bp, Homo sapiens
taaatttagaaaaacttaatttaacatatttaaataaggctatattttcacattgttaggtgtagaactttaaaaaatctaaatctataaacatcacc

SEQ ID NO: 15382 - DNA, 57 bp, Homo sapiens
tcagagacagctgatacttcatttaaaaaaatcacaaaaatttgaacactggctcaa

SEQ ID NO: 15383 - DNA, 51 bp, Homo sapiens
ttgtgttcatgtagccataggcacatggagcagaatacttaagcctggccc

SEQ ID NO: 15384 - DNA, 89 bp, Homo sapiens
  misc_feature 25: m=a or c
  misc_feature 42: w=a or t
tagctatatgatatttgacagttgmaatggtaagggcttttwttcttgctgattaaaatatataaaatatacttgtcatcagggatatg

SEQ ID NO: 15385 - DNA, 68 bp, Homo sapiens
aattttaaaagccattctgaatgacatggcaaggggcgagagaaagtggtgtctcaactgacagatgc

SEQ ID NO: 15386 - DNA, 55 bp, Homo sapiens
atttttcccccctctagaagaatcaaattgaatcttttacttacctcttgcacaa

SEQ ID NO: 15387 - DNA, 74 bp, Homo sapiens
ggacggtaaaatggcgcctgtcagagtgggaaacccagctgcagaggctgcagccccggtccccagcggccaaa

SEQ ID NO: 15388 - DNA, 111 bp, Homo sapiens
catgatcaccgagaccgcggcggacctacggtccctgcagtgcctgctgctgaggaggccaccgaagctcggggacgcgaggagccggcgtggccctggaaagacgcccca

SEQ ID NO: 15389 - DNA, 118 bp, Homo sapiens
  misc_feature 77: s=g or c
cttccgtgtgggccctccctgtcccctctctgtcacctcacagtagtcgttgccggtagcgggtgtgggggcgcgasagcgcagggcggcctctcccccacccctcagcccggaccaa

SEQ ID NO: 15390 - DNA, 137 bp, Homo sapiens
ctgaagtttcctattgaatgaaatgaaatcttcttaatgtaaagtgatacccaaaccgtagtttgtgagcattttcatgttttaaactgcatttgtctttcattatattaaattatgttgtcgccaaccgagcgtta

SEQ ID NO: 15391 - DNA, 62 bp, Homo sapiens
aggccaagcatcatgccatctctgctaaactgaacaagcccttcctgtttgacaccaagcat

SEQ ID NO: 15392 - DNA, 114 bp, Homo sapiens
agaccaataataggctctgaaattgaggcaataattaaaagcctatgaaccaaaaaaagtccaggaccagatggattcacagctaaattctaccagaggtacaaagaggagcaa

SEQ ID NO: 15393 - DNA, 231 bp, Homo sapiens
caaccgtctataatgtcagacccaactctcgcaagttccaggctctcctggggtgttcacatccatcatgtactatttgacaaatgtctgcttcaacaagctccctgtctccgtaagtggggttagagcagagaggggaacagctaggagtcttttctttcttaagcacctgcttttattattgcaactcacttagaccaggggtctcaaactcatgcccacagggacccc

SEQ ID NO: 15394 - DNA, 111 bp, Homo sapiens
cggtgcgccaccagccagaggggctggaccagctgcaggcccagaccaagttcaccaagaaggagctgcagtctctctacaggggctttaagaatgagtgtcccacgggcc

SEQ ID NO: 15395 - DNA, 60 bp, Homo sapiens
agtcttttctaggaggaagaccaagattctccagcggcagggcagcctatcacccaacat

SEQ ID NO: 15396 - DNA, 75 bp, Homo sapiens
tcctaaaactggggttcctataggtcattggcctgttccagagtctttttggccagatcaaaattcgccaacctt

SEQ ID NO: 15397 - DNA, 199 bp, Homo sapiens
  misc_feature 11: y=c or t
  misc_feature 108: r=a or g
  misc_feature 109: s=g or c
tttttgcagtyactgggagggggcttgctgtggccccatctgggagagttgagccctggtccagccccgcacctggacttctaacagccctagacctcaactacctarscaactgtactttaaaatatgtacaaagaaaaaaatttctttaaactgagagagaagttttattttctaattgtaaacatatctgtcgcac

SEQ ID NO: 15398 - DNA, 74 bp, Homo sapiens
aatacatcaaatcaaatagaatcttatatctgtatgttaaaatagagcacttacctgaagtcagtggcctgcga

SEQ ID NO: 15399 - DNA, 105 bp, Homo sapiens
tgttctgtagagatggcctttcacttgaggagtactcagttttcaggttcttcctagctcggggcttttaaattttgaaatctaaacattctttcccacctggga

SEQ ID NO: 15400 - DNA, 82 bp, Homo sapiens
tttttataaaatcgggtttcagatgagatgtttatcttagactattttagggaaaaattttacatgtttgagacggcggagt

SEQ ID NO: 15401 - DNA, 61 bp, Homo sapiens
  misc_feature 45: w=a or t
  misc_feature 46: w=a or t
tatccttgtttgtatatgtcctgtcacagagtgtcctcttggtgwwttctaaaacgaggcc

SEQ ID NO: 15402 - DNA, 54 bp, Homo sapiens
ttgtttgcttaaacaaagtgactgtttggcttataaacacattgaatgcgcttc

SEQ ID NO: 15403 - DNA, 83 bp, Homo sapiens
catccccagggctgacgggtctgcagggcacagagatgtgggcctgctgtgtctctgccccacagtggccatgccgggactgc

SEQ ID NO: 15404 - DNA, 53 bp, Homo sapiens
atttagataaccacttgatgcacaaataggaaaaagcagattgtggcagtaaa

SEQ ID NO: 15405 - DNA, 192 bp, Homo sapiens
gcttcataaaaagagggacaagtggctggtgctgtggacagagaagctttatttttagtatgagacaacctctcgctgaggcaggggaagtgcttgaacccgggaggcagaggttgcggtgagccgagatcacgccactgcactccagcctgggcgacagagcgagactctgtctcaaaaaaaaaaaaaaaa

SEQ ID NO: 15406 - DNA, 72 bp, Homo sapiens
acgcgcgcgaacacacacacacacacacgcacacgccgcggcggtcagctagagtttggctactggaccctt

SEQ ID NO: 15407 - DNA, 78 bp, Homo sapiens
  misc_feature 13: s=g or c
acactccgcggastcctgccacagccgtcgccttcgcggcggctctccagccccgcgcctcagcctcggcgccgcata

SEQ ID NO: 15408 - DNA, 54 bp, Homo sapiens
ccctaataaaatgaggaactgagctataagccaaaacctagtacaaagagaagc

SEQ ID NO: 15409 - DNA, 69 bp, Homo sapiens
  misc_feature 29: r=a or g
aaaaaaagccccgatggtgatcgtgagtratggcaagaggatttagcctcggcattaacttggagcggt

SEQ ID NO: 15410 - DNA, 63 bp, Homo sapiens
tatataaagtttatatggtaaatataattatgcccacttttcaattgaggcaactgaggcccc

SEQ ID NO: 15411 - DNA, 266 bp, Homo sapiens
gggtgtctcctgccttgatctcagtgccatctttctcccccggctcgctggcctgtatgttttttctccttcttttttttctttttgagactggctctctgtcacccagggtggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtgga

SEQ ID NO: 15412 - DNA, 159 bp, Homo sapiens
attttaaaatggtcactgtgaccaccacgtggagagtgaattgacgaggggacttcttccgcctcagcctcctgagtagctgggactacaggcatgctccactactcccagctaatttttctgtttttagtagagacagggtttcaccatgattggccc

SEQ ID NO: 15413 - DNA, 91 bp, Homo sapiens
  misc_feature 64: s=g or c
gacaaggatggcgaccatctcttcggaagcctaacgatccagcacaggtcccagccctgcgcascgcccgccaagccgccagaggaccgcc

SEQ ID NO: 15414 - DNA, 77 bp, Homo sapiens
tatgcagtgtcacggcatttttctctggtgaccaagcttccactgacaaggaagaggattatattcgttatgcccat

SEQ ID NO: 15415 - DNA, 92 bp, Homo sapiens
tttttgtatttttagtagagacggggtttcaccatgttggtcaggctggtcttgaactcctgaccttgtgatccacctgccttggcctccct

SEQ ID NO: 15416 - DNA, 72 bp, Homo sapiens
aatttcaatttgaaacctagcggagggaggaggcaggcgcggctgccggcggctgggactgaagagggacgg

SEQ ID NO: 15417 - DNA, 71 bp, Homo sapiens
atctgtatcgagactctctccagcccaacaggaggatgggaaggagacttgtgtgggggcctcgggctagc

SEQ ID NO: 15418 - DNA, 162 bp, Homo sapiens
  misc_feature 136: k=g or t
tgcttctatgagtttgactttcttagattctacatgtaagggagataatgccaatattcatctttctgtgtctggctgatttcacttaacataatgtcctccaggttcatatgtgttgttgcaaatgacaagagtkccttttatttttgagacagggtcgcc

SEQ ID NO: 15419 - DNA, 101 bp, Homo sapiens
gtttgccaggctggtctcgaactcctgacctcgtgatctgcccgccttggcctcccagagtgttgggattacaggcgtgagcaaccatgcccggcctacaa

SEQ ID NO: 15420 - DNA, 83 bp, Homo sapiens
accatgccatcttagatgagtatagggatgcttagatcacataaaaagatgctccaaatcagaatttttggttgcagaggaca

SEQ ID NO: 15421 - DNA, 69 bp, Homo sapiens
atcctcctgtgttaattgaagaacaccatggaaagatcttctgaaataatgtctaatataacccccaat

SEQ ID NO: 15422 - DNA, 82 bp, Homo sapiens
agacagagccccgcgcggcgcggcggcagcttcactctggttcaagcgcaggggatcggcgggaagctctttcacccccgga

SEQ ID NO: 15423 - DNA, 50 bp, Homo sapiens
aggcgtctgcgctgatcgggtccgccgcgcgccagagccagagtcgcagc

SEQ ID NO: 15424 - DNA, 63 bp, Homo sapiens
  misc_feature 19: n=a, g, c or t
acctttccgcgggccgcgnggatggcggcgcagggcgtagggcctgggccggggtcggcgact

SEQ ID NO: 15425 - DNA, 59 bp, Homo sapiens
tctaggcaaacattgaatgcaaacgtgtatttttttaatataaatatataactgtccga

SEQ ID NO: 15426 - DNA, 139 bp, Homo sapiens
atctccctccccggcccttggcaggagcctcgccctacattggctcttcaagtccgggcgtccccttcatgtgggagacacagcccagaccattccatcgccctggattctgcccggaccagcgacctcgccggcctct

SEQ ID NO: 15427 - DNA, 146 bp, Homo sapiens
  misc_feature 35: r=a or g
tctaatatgctggggagacatataagttgacagtraatatgctatttgcaaatgtgtctctcttctctccctaatgaaattcagctccctgaagtcagaaatcaaagctggattatactttataagccccatgctgcctgatgcgg

SEQ ID NO: 15428 - DNA, 203 bp, Homo sapiens
  misc_feature 140: w=a or t
aaatcatctcacaatgtagagatgaatgtgacttaatgtcactacatcctgatagttttttttttctatacatattacacataggaaagacgtattgtacatatagggttagtcaagacatcctgtctgtgactgatgtwatgcaatctactttttcattttatattgtgaacatttccccatttctttaaattatcccccac

SEQ ID NO: 15429 - DNA, 59 bp, Homo sapiens
cgtgctattttgttttgtattgtgcaaaaataggttctggtcctttaagatgtaacaat

SEQ ID NO: 15430 - DNA, 70 bp, Homo sapiens
agcatcctgagggttgaggcttggaggacaggaatgatcttcggcttgagaaaccactgtgggcaggact

SEQ ID NO: 15431 - DNA, 88 bp, Homo sapiens
aagacatcgaagaaaaactgagaggctgtagctcgacctagtttctgtgaagaattttgtcaagtgatccctctcggaccctgagcgg

SEQ ID NO: 15432 - DNA, 142 bp, Homo sapiens
atttaccatctgatgccgatcattaaatatcagttctgtttatctgaaggctcctacccagagattctacccagtgaaactcccacagcagcgcaggtagatggggctgacctggcctctccaatgtctcctcgaactaact

SEQ ID NO: 15433 - DNA, 67 bp, Homo sapiens
gaagcagacatgaaaagtcatatattgtacaattccatttatatgcaatgttcagactaagccaatc

SEQ ID NO: 15434 - DNA, 63 bp, Homo sapiens
agatttagcatcaagcacagacctacactcgctctttctctccggtacacacagctccgccac

SEQ ID NO: 15435 - DNA, 127 bp, Homo sapiens
catatatgtaatatatattacatgtgttatattttgaagaatatatgtgtcttttatgagaaaaggcactttgagtttcaactcattgatatagaagcaggttttcttaatctttaagattggccct

SEQ ID NO: 15436 - DNA, 199 bp, Homo sapiens
catatactgctagtgcgtggttaagatttagatctttaaagtataatgttagctttcttgttatataataatacttctatgcctacttacgggtaaatatgagtaaaagttttgccaatgtcagtaggaatttttttatgagatcagttttcacaatgtgttaattattaagcactcccactacacagtcactatcaca

SEQ ID NO: 15437 - DNA, 67 bp, Homo sapiens
taaaaagcaagctgtagaagaatatatattatataatacttaaatacatttcaaaatcaggcaaaac

SEQ ID NO: 15438 - DNA, 143 bp, Homo sapiens
gggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccc

SEQ ID NO: 15439 - DNA, 119 bp, Homo sapiens
tcaatatcttcattttttaagagtgctttctcttttttttctcgctctttcttttttttcccgtaactccagaaagattatgcatgggaaaagtcctagagcctgcttccaaactgccg

SEQ ID NO: 15440 - DNA, 84 bp, Homo sapiens
ccaagatggtttaaagacttaaatgtgtccgggcatggtggctcatgcctgtaatcccagcacgttgggaggctgaggtgggcc

SEQ ID NO: 15441 - DNA, 92 bp, Homo sapiens
atcgcattgggaataaaatcaaaatccttgccttggcctgcgcaggttcttgacctcacctgtagttctctcctgcttctcctgaccacccc

SEQ ID NO: 15442 - DNA, 82 bp, Homo sapiens
agagaaaagaggtagtgagcggtgtttcaggatgtgagggcccgcaggagccgagtcaggctctctccactgcctgcccgcc

SEQ ID NO: 15443 - DNA, 127 bp, Homo sapiens
tgattttttttgccttgtcattaatctgaggaggtttgaaactaagactgctgtcatcgtttctcctttcttgtacagcctatcttgctacggtttcttacatataccatagaagcaacaggcactg

SEQ ID NO: 15444 - DNA, 255 bp, Homo sapiens
tgtgttgggtgaagtgttcagtagatgtctgctaagtctaggtggtttataggtttgttcaggtcccccatttccctgttcatcttctgcttagttctatcaattattaaaaatagagtattgccatgtccaattattgtttttgaattatcttttccttttttcaattctttccgttttcgattcatgtatttgaaggctctgttaggtgagtatattttccacttgttatagcctcctgatgagatgacccca

SEQ ID NO: 15445 - DNA, 111 bp, Homo sapiens
taaaatctcatttcaggtttcctctctattccatgactcaaactttggaattattcctatgaaagaaataattactaaatttagccacaagttagcctcttccagtggacc

SEQ ID NO: 15446 - DNA, 54 bp, Homo sapiens
atgattttctttgtctcctaaggtccattctctcaggaacttgatgatcgaggc

SEQ ID NO: 15447 - DNA, 95 bp, Homo sapiens
tgacatcctcctgcctatgagtccttgactctggagttttacaaagcagtcacatttcaaataaaagtctgggaaagcaacacatcatcgccaac

SEQ ID NO: 15448 - DNA, 288 bp, Homo sapiens
cttcatgctgaggacacatggacacgtctcttatgtctcaagcaaagatacccccgtggggccattcaagaatgcatcttatcaatgcctaggtcttattattgactcaaaatatttacattcctttgttaacagcactaccacaacttactgtgcatcagttcaatggtaaggactgacctaggcccatacattcattttttgtaaatttgagtttgaaaattacgagttatattgccatattaattggttatgctgccactcagtggtagattttagaatagcagt

SEQ ID NO: 15449 - DNA, 69 bp, Homo sapiens
  misc_feature 29: m=a or c
gttttccgaggctgcgggcaggggcccgmcgcgcccatcccgatggctggaggcgtctgaggggcggtt

SEQ ID NO: 15450 - DNA, 107 bp, Homo sapiens
aatcatgttgagtaaggagcaattccatcatttattcttcagcaaacactgcttgaatatatatgtgcaaccagcgctgtggaacgtattagggatttagatgggct

SEQ ID NO: 15451 - DNA, 58 bp, Homo sapiens
taaacccatgttgcgcagaataaaaaagtatgcataacttattcatccgcacacagca

SEQ ID NO: 15452 - DNA, 84 bp, Homo sapiens
atccggtagggaaatggtcgtgctttcggtccccgccgaagtcaccgtgatcctgttagatatcgaaggtaccacaaccccgca

SEQ ID NO: 15453 - DNA, 75 bp, Homo sapiens
accttattttcttgtggctataagaaaagtcagcacatttgttgacataattttcattgaaggtaacaaaagtac

SEQ ID NO: 15454 - DNA, 63 bp, Homo sapiens
atcaaatgtagtaatctttgtattctgttacatcaaaatccagatatgttcttgtagtttctt

SEQ ID NO: 15455 - DNA, 141 bp, Homo sapiens
attccagctgcgactgctgagggagaaaatgatgcccaggttgggctccccggcccaccggccgaggagaggcctgcgctgcacacgcgcagaccgagcatccgcgtcaagaggcgaagagagcgcgcgctccccacctga

SEQ ID NO: 15456 - DNA, 98 bp, Homo sapiens
  misc_feature 12: r=a or g
  misc_feature 13: s=g or c
tgcagtctcccrsatccagggcctgatgacatgcccccttgtcccaagtttcttgggaacccctgaccctgctggcccctctcatccaccccaaccct

SEQ ID NO: 15457 - DNA, 99 bp, Homo sapiens
tgtcattcatggaccctgtggtctcagtagaatttagaaggaagtgaagacgggagtgaattgatggtctaggggaaaatggaagagcaggaggtcttc

SEQ ID NO: 15458 - DNA, 444 bp, Homo sapiens
  misc_feature 12: d=a or g or t
  misc_feature 160: s=g or c
cacaatagcaadgacttggaaccaacccaaatgtccaacaatgatagactggattaagaaaatgtggcacatctacaccatggaatactatgcagccataaaaaatgatgagttcatgtcctttgtagggacatggatgaaattggaaaacaagcgcaasaggagagagaacccttggaagtgaggggtagggagccggaagggatggaaaggcacacagctcctgagcatgaattaaaccatttctcagatatctgccaagctgcatgaggtcccgggcgccgggaggcttgggcagaaaccctcgggaatgcttccgagcacgccgcgcgcatctgtagtcccagccacccgggaggctgaggcaggggaaccgcccgaaaccaggaggcacagattgcaccactgcactcgagcctggtggaagagcgagactccatctca

SEQ ID NO: 15459 - DNA, 69 bp, Homo sapiens
taggctgaggaggaggaggaggaggaggaggaggaagagggattggtgatgctgtgccagggagacaaa

SEQ ID NO: 15460 - DNA, 105 bp, Homo sapiens
ataggaggcggaggcaggggattgcttgaagccaggagttccagaccagtctgggaaacatagcaagaccttgtctctacataaaaaagttttaattatccatgt

SEQ ID NO: 15461 - DNA, 89 bp, Homo sapiens
gagtgggcccaagcatcacacacgtgctggagctgagtgttctctgagcaacatgctaggatgttacttgggtgctagaaaacagcaga

SEQ ID NO: 15462 - DNA, 109 bp, Homo sapiens
agccaccttctttctatgtctctgctcaggacctgcctcatattgagaatggtggtgtggctgtcctcactgggaagaaggtagtacagctggatgtgagagacaacta

SEQ ID NO: 15463 - DNA, 74 bp, Homo sapiens
atagttagggttaagtccaagcagtgaggcctgacctgggctctgctctccttgttgagacactaacaggccac

SEQ ID NO: 15464 - DNA, 197 bp, Homo sapiens
cctaatgctctatgtctgtcctccccttcatagtctaacttgtcttaagaggtatctacctggttgtctttaatatcacacctcccatttgtccctctgccctggtctcccaaagtgctgggattataggtatgagccactgtgctctgctcaatttttttttttctttaacatttggggaaaaaagtggggaagaa

SEQ ID NO: 15465 - DNA, 58 bp, Homo sapiens
aggtggcgcgcgggtccggcgggcggttggcttgagcgggaccggagctgaggcagaa

SEQ ID NO: 15466 - DNA, 107 bp, Homo sapiens
tttattttccagcaggctgggtgcggtggctcatgcctgtaatctcggcactttgggaggccgaggcgggcggatcgcgaggtcgggagttcgaggccggcctggcc

SEQ ID NO: 15467 - DNA, 66 bp, Homo sapiens
atgaaataattaaacttatagctattaataatatatctacacaattcacaaaaatatgatgcccgc

SEQ ID NO: 15468 - DNA, 83 bp, Homo sapiens
gaggttaaatggttttggcatcctgtaccctaaaaaacatcgattatgtagtatgaaagtttataaatatttagtacgaccga

SEQ ID NO: 15469 - DNA, 58 bp, Homo sapiens
tctccgcaccgcatgtaaacagtcccagccggcccagcccggccccggaggagcccgc

SEQ ID NO: 15470 - DNA, 65 bp, Homo sapiens
  misc_feature 20: s=g or c
cctttccgtctggcggcagsatcaggtaagccaagatgggtgcatacaagtacatccaggagccg

SEQ ID NO: 15471 - DNA, 111 bp, Homo sapiens
tttctctcagcatcttcttggtagcctgcctgtaggtgaagaagcaccagcagcatccatggcctgtcttttggcttaacacttatctcctttggctttgacagcggacct

SEQ ID NO: 15472 - DNA, 67 bp, Homo sapiens
gcctagatctaaccattttcatactcttaactgattgaaacagattcaaagaagtatcgagtgctgc

SEQ ID NO: 15473 - DNA, 92 bp, Homo sapiens
cagctttcttcagctgtgaacattatgaatggttctcagatgcacataaacccagcaaataagtctttgccacctacatttggcccagccag

SEQ ID NO: 15474 - DNA, 54 bp, Homo sapiens
caaaaatggtttggtcggaagcgaacattatcagcatttctgtgcctaggagac

SEQ ID NO: 15475 - DNA, 96 bp, Homo sapiens
tagaacttcagggtgaaggacagagtcctgggtggggcagcggctgcagggcgcaccagagaacccagccagagggggtgtgactaccagtggccc

SEQ ID NO: 15476 - DNA, 75 bp, Homo sapiens
aaggatacattcttagcattaaaaaaaaagttatataaatatatataattatatatatatttgagacaggggcct

SEQ ID NO: 15477 - DNA, 79 bp, Homo sapiens
attttaattctagatgtgttatctctctgggaagtatagtttatagaaacacaaaatatttgatttcctgtgtcggctc

SEQ ID NO: 15478 - DNA, 85 bp, Homo sapiens
ctgtacagcctgcagaactagacggggtttttccacattggtcaggctggtctcaaacttctgacctcagatgatccgcccgccc

SEQ ID NO: 15479 - DNA, 113 bp, Homo sapiens
ggatatttttaacacaacaatctgtgcttattacacaaaattactttgtggtaaacagacagtattgtaatcccatcaaaagatgaaagaaaaacaaaaacaaaaaccaactg

SEQ ID NO: 15480 - DNA, 99 bp, Homo sapiens
gctttccccagagcccggactgcggagaacaatatcctcctccctaacagataaacagcccttgttcctcgggataaggactggcagtcccctgacact

SEQ ID NO: 15481 - DNA, 75 bp, Homo sapiens
  misc_feature 15: m=a or c
atttagagcgcagamctgacgggccggatcgccttcgccgccgcccgcccgcaaaccttcgtgcccggcccctca

SEQ ID NO: 15482 - DNA, 65 bp, Homo sapiens
tgaaaaatcatgatacatactgtacagtctcagtcccataaaattggatgttgtgcccacacaca

SEQ ID NO: 15483 - DNA, 103 bp, Homo sapiens
  misc_feature 4: k=g or t
actkccgggggagcggcgcggcggcggggaggatctctcaccccgtcactcagggtggcgcaatcacgactcattggctcactgcagcctagacctcccaaca

SEQ ID NO: 15484 - DNA, 79 bp, Homo sapiens
gatgctcacgctccggtccctgctcttctggtccctggtctactgctactgcgggctctgcgcctccatccacctgcaa

SEQ ID NO: 15485 - DNA, 70 bp, Homo sapiens
actttcgaaagcagagcgaggagccctcgcacgcgctagtctgcgagtgagcgctcagcccggcacctga

SEQ ID NO: 15486 - DNA, 70 bp, Homo sapiens
  misc_feature 19: r=a or g
  misc_feature 53: r=a or g
aggatgcaataagcttgcragcgggcgcccgcttccgccctccttccctcgcragccaagacggctgcaa

SEQ ID NO: 15487 - DNA, 72 bp, Homo sapiens
ggaagcgctggaagcaagatggcggccgccgagagggttcacaaaggctctggtccattagaggaaggaggt

SEQ ID NO: 15488 - DNA, 77 bp, Homo sapiens
ctgtacttgcagaaacttctgtcgctcatgcaagggaacttggcactggaaacacaaatgcttttcttgtccccgct

SEQ ID NO: 15489 - DNA, 72 bp, Homo sapiens
ttctcctgattttgtggatttaaatgtccaaatgcaaacctttgtgacttcctttggaggacttggcagtga

SEQ ID NO: 15490 - DNA, 103 bp, Homo sapiens
caatctggactccccagtgtaaaataaaactggttatatttagtaagtgcatgtgcgtgcctgtgtagattttttacttaacgtagaatgaattactgtcccc

SEQ ID NO: 15491 - DNA, 69 bp, Homo sapiens
acgcaactcctatattttaaaaaattaagatccaagacttataaatacattcctagtttccagacacac

SEQ ID NO: 15492 - DNA, 50 bp, Homo sapiens
  misc_feature 32: s=g or c
catggatggtacagccctttatgaagcggtascgccatctttatagccca

SEQ ID NO: 15493 - DNA, 59 bp, Homo sapiens
ttaactaagaaaagaagagagaaaatctaaataacctcattaagaaacaaacgggagga

SEQ ID NO: 15494 - DNA, 267 bp, Homo sapiens
ctttttgaggatacaatgaggaatgtcagaatagctagacagtgcagagctagtgatgggggaatattgagagaaaatgttgaaaaggaaattgggctagttttgtcgttaggggcgtacagctgctttcttttcttgtataaatttaaaaacctgctttaaatagcaatgaatgttgatgctgatgctgatatactaacatacacacaaacaggtataaaggggcattctggcccttcaaaacaatgatcttcaacagtaaatgca

SEQ ID NO: 15495 - DNA, 76 bp, Homo sapiens
gtttctgacttttttaaacatggaaatattgttactgcaaaacaactaaatttcttaaacacctaccatgcgccac

SEQ ID NO: 15496 - DNA, 171 bp, Homo sapiens
tcgtaagtcagataaaaatccagctcttaagaagtagaggaaatagagcttggtgtggtggcatgtgcctatgatcccagaccagacgggttaatcctcacatgccaaaatgtaaagactatcaagactaggaagaaactgcatcaactaacgagcaaaataaccagcttt

SEQ ID NO: 15497 - DNA, 140 bp, Homo sapiens
tctattaatgggtaataaattacaagagcttagtggctttaaacatttatttattagcttacagttatgtaggtcagaaatgtgggtggactcaactgggttttctgcttagggtttcatgaaataattcgcacgacgcc

SEQ ID NO: 15498 - DNA, 56 bp, Homo sapiens
cggttgtttctgaagatcgacttaatgaaactgaactgacagatttagacggcaca

SEQ ID NO: 15499 - DNA, 73 bp, Homo sapiens
aagcggctgctggacgaagagcgggcgccgggagctccgagagcgcggccgggcgaggcgggagcgcgggaat

SEQ ID NO: 15500 - DNA, 124 bp, Homo sapiens
ctgtgtggttggcaatatcaaacctaccccctccccacaaagtggcatgttgggtcatatttgtccttaggaataggtagctgctgggaatccaggaggcataagggtaggctgggccagggat

SEQ ID NO: 15501 - DNA, 69 bp, Homo sapiens
ctgcgcggatgtagcatgttctatgtgtttttaaacgaagatccgagcgacggctcctccccgacccca

SEQ ID NO: 15502 - DNA, 56 bp, Homo sapiens
aaattctttatcttttctgtgtgtttgaaaatttttaaataaaatattggaggaaa

SEQ ID NO: 15503 - DNA, 176 bp, Homo sapiens
tgaacaccttgaaatatcttttaaaactttctaatgtgtaatacaagataagtattcagtaaattgttgttaatgatttataaaagttcagtaataaaattaagtattagggtagattaaatggcctccagtctttttccattgaccttttctcattgatgataataatagccagc

SEQ ID NO: 15504 - DNA, 73 bp, Homo sapiens
aggaaaaccggaggagagcgcaggaggaaacagtaccggctggaggccggtcttgcaggagcgcgggaggaat

SEQ ID NO: 15505 - DNA, 89 bp, Homo sapiens
tagtttaagtaatttttattacatcatgtattgctttattcagtttgaatacatttatttatttatttgcagtatcaaccagaaacaca

SEQ ID NO: 15506 - DNA, 52 bp, Homo sapiens
ccgtgtgacctcccaagggggtgggaacttgatataaacgtttaaaggggcc

SEQ ID NO: 15507 - DNA, 172 bp, Homo sapiens
cgcctgtaatccgagcacttatgggaggccgaggcgggcggatcatgaggtcaggagatcgagaccatcctggttaacatggtgaaaccccctcacaacctgatcaccacgtaccagaaaaacgccaaaagaccctccccaagtcagtaataattgtacccactcacccacc

SEQ ID NO: 15508 - DNA, 186 bp, Homo sapiens
tcgtactatttctatatatttggtcacaggctttcttaacattcttagtaaatacatttactgacctattaattacagaaattcatctagatgctcacataggttgtgttagggttctgcagagaaacagaaccaaaaatgtgtatgtgtgcagtgcacacacatgtacacatgtatatgggggac

SEQ ID NO: 15509 - DNA, 64 bp, Homo sapiens
gcactagggacgcgccctgtgggggcatggcgtccgatcgaggcgggcgttcacgggcggccga

SEQ ID NO: 15510 - DNA, 284 bp, Homo sapiens
cattgaaacctctggtacacagtagcaggcaagcatcatttcaaaacaccaaggaaaccccttactctctgctcttggcgcctgagacttggtagagtgaaaatttaaaaaaaaaaaattaagttctggccaggtgcggtggctcacgcctgtaatctcagcactttgggaggccgaggtgggcggatcacaaggtcaggagatcgagaccatcctggccaacatggtgaaaccctgtctctactaaaaatacaaaaatttagctgtatgtggtggcacgtaca

SEQ ID NO: 15511 - DNA, 190 bp, Homo sapiens
ctcttgtggttaataccaggtggaacccagaaacatacagagataaaaccttgtgcggagaagaaaataataaacattaaaagttcaccttgaccaaagagacaacctccagaagaacaccacacatgggaggacccgatgtacacacacacacacacacacacacacacacacacacacccctacccct

SEQ ID NO: 15512 - DNA, 273 bp, Homo sapiens
  misc_feature 249: d=a or g or t
  misc_feature 264: b=c or g or t
aggttgccagtatatgacaaaagtagaattagtaaactactacattgagtacactttgtgttaaaattcatagggaagacgccctacagaaaatttactcaaaaacagcttatgttcagttttatattcagagcagatatttaagttaattattttcacaaggaagagcagaactattctaaggctagttctcaaattgcataaaggtgcaaatcttttcaccttcttactaacctttgttgatttagdttgtctatttcttabccccagcat

SEQ ID NO: 15513 - DNA, 89 bp, Homo sapiens
agtttgcggcatccggaggagcagcagcagcagtagcggcggcggctggcgcacgcggagacggacgagcgggcacagacggcagcgga

SEQ ID NO: 15514 - DNA, 113 bp, Homo sapiens
acaccggtcaggcccggcgcgggctgcgctctccagctgtggctatggccccagccccgagatgaggagggagagaactaggggcccgcagcctgggaatttccgtccccccg

SEQ ID NO: 15515 - DNA, 87 bp, Homo sapiens
  misc_feature 7: h=a or c or t
  misc_feature 8: v=a or c or g
  misc_feature 35: s=g or c
agctgchvcgcgttggggcggcaggagccgcggascggcgctgagaggggctgcggccggagcgggcggctgagacaaaggcgacta

SEQ ID NO: 15516 - DNA, 110 bp, Homo sapiens
ctcttttccgccgccgcctgggaggggacccgggctgccaggcgcccagctgtgcccagatggatgggacagagacccggcagcggaggctggacagctgtggcaagcgc

SEQ ID NO: 15517 - DNA, 116 bp, Homo sapiens
tgttaatagtttgttctttttggtgttaggtattctctcgtgtgatcatgccccagtttatttaaccatcccatagatgatgtttattttcccttgtaaagttggatagcgtggtt

SEQ ID NO: 15518 - DNA, 85 bp, Homo sapiens
aaaatgctagaggcctgggtccagcacatgaggccagaaaagagtgtaggtacctgggaatgtcagtgccattcagtgtgaccgc

SEQ ID NO: 15519 - DNA, 73 bp, Homo sapiens
tgaattgtggggtgggagactaacttcagctccaggctgcagtaatgtgttggtagttacacttgaggcactc

SEQ ID NO: 15520 - DNA, 243 bp, Homo sapiens
aactccaaagcatacaaacggagcaagcgccagactctgagagaagctcgcatgaccgagaagctggagaagcagcagaagattgagcaggagaggaaacgccgctcggggtctcactctgccacccaggctagagcacagtggtgcaatcacagctcactgcagcctcaaacacttaaattcaagtgatcctcccacctcagtctcctgagtagctgaaactataggtgtgcaccatgcgcc

SEQ ID NO: 15521 - DNA, 67 bp, Homo sapiens
attgaacataattatttttattgtagctatatagcatgtcagattaaatcatttacaacaaaaggga

SEQ ID NO: 15522 - DNA, 66 bp, Homo sapiens
  misc_feature 5: s=g or c
  misc_feature 6: n=a, g, c or t
  misc_feature 7: n=a, g, c or t
gcgcsnncccctctccggctccccctctctcccccctcgcggcttgcctcgcgctcccgcccccgc

SEQ ID NO: 15523 - DNA, 59 bp, Homo sapiens
aaacttttgtgttagtagtaccatggtgaaaacatattttactgcgttgcgcgcgcacg

SEQ ID NO: 15524 - DNA, 182 bp, Homo sapiens
cacagacggagaccagtagctattttcaaacacctaaaagcactgtcatgtgaaaagtggattagacctgtactgggcaactctagaaatcagagataggaccaataaatggcaaacatggagggacataatttcaacataacttacagaagaacttctttttttttttttttttttttttt

SEQ ID NO: 15525 - DNA, 97 bp, Homo sapiens
ggttgaggcggacggcggggtccgggccggagtacgtcgttcccgctgcgctaggggaagcgggcagtcagaaaaatgggtaagaagagtcgagcca

SEQ ID NO: 15526 - DNA, 234 bp, Homo sapiens
  misc_feature 212: k=g or t
caagtatttctgttgttgtgagactttaggacaagacaacatttggtgttaacatagaagaatattctatggcttttttagctttaaagttcattactctaaaataaagtacacgcccagaccatgagcagcttacactcccgagttgaaaaaattgatggacatgtctgccaccatttaattttcaatgataactttttgtccatcaattktttcaactcgggagtgtaagct

SEQ ID NO: 15527 - DNA, 83 bp, Homo sapiens
  misc_feature 81: n=a, g, c or t
  misc_feature 82: m=a or c
ggatgttgtgaaccgggtcgcggcggccgaggctcgggttactcgggaggctgaggcaggagaatcgcttgaaccggaggnmg

SEQ ID NO: 15528 - DNA, 123 bp, Homo sapiens
ccaccactcagaggcaaacattgtggggcgttttcaccacatctttttgctgtgaattttaaaaacatgattgtgattgtaggtaatactgagccagactctgtggttgtaggtagcaggcgc

SEQ ID NO: 15529 - DNA, 64 bp, Homo sapiens
tagggtttgctcagcttcttgaatctgtatgtttgtttgttcatttgcaaaaattgggaacccg

SEQ ID NO: 15530 - DNA, 55 bp, Homo sapiens
ggatgtttacggcggccgaggttggagcggcgctgctcggccgcggacacaacga

SEQ ID NO: 15531 - DNA, 67 bp, Homo sapiens
atggcttgattgaagggagaaaggggctccaaattgctccaaatagcactctccagacaacggccta

SEQ ID NO: 15532 - DNA, 89 bp, Homo sapiens
  misc_feature 67: y=c or t
aaaaaagccggagaaggggcggggtctcagctcctacttcattctacggccgagaccggaggatgtyccctgctcaggaggaggccgga

SEQ ID NO: 15533 - DNA, 97 bp, Homo sapiens
caagagacattttcataattgctttctagcaatcagcttttatttgccttaatataagcttttaagcagttatctaactagtgtccacaaccctgat

SEQ ID NO: 15534 - DNA, 63 bp, Homo sapiens
acaattttgcagtctgtgctggactcagcaactgattcttctgcttgtcttgctgccggtcac

SEQ ID NO: 15535 - DNA, 171 bp, Homo sapiens
aagtaccagagcaacgtggtggtcaaataccacttccgctcgcgctctgtgctggtgcagaggagcctcccgggcgccggttacaacaacaccttcccctactcctggggcggcttctccgacatggacttcatggtggacgagagcgggctctgggctgtgtacaccacc

SEQ ID NO: 15536 - DNA, 66 bp, Homo sapiens
caccagatgaaaagcaactgagatatttatctagtttttgtgatcttgtttcataagctgtgatgg

SEQ ID NO: 15537 - DNA, 107 bp, Homo sapiens
atatattacaggccgagcgcggtggttcacacccgtaatcctagcactttgggaggccaaggcaggcagattgcctgaggtcgggagttcaagaccagcccggccga

SEQ ID NO: 15538 - DNA, 137 bp, Homo sapiens
agtctgttcccggcacccggtgcgtgtgaagggacttgagggcagcgagatggaatcagcaagagaaaacatcgaccttcaacctggaagctccgaccccaggagccagcccatcaacctgaaccattacgccacca

SEQ ID NO: 15539 - DNA, 93 bp, Homo sapiens
ttacggaacctagtctccgttctgtccatggccttcttctggacacttctaggatccagaagagtatgttatcaattctcaagcctaggagat

SEQ ID NO: 15540 - DNA, 57 bp, Homo sapiens
  misc_feature 1: k=g or t
  misc_feature 2: k=g or t
  misc_feature 22: k=g or t
  misc_feature 23: k=g or t
  misc_feature 57: k=g or t
kkataaaacgataaagctaaakkagtggccatttgtgtctgcttcgggacagcgtgk

SEQ ID NO: 15541 - DNA, 86 bp, Homo sapiens
ttatttattgttgcatcctgaagcttcccccatgctgggctcagtgtgaacaaacagcgcgggagaatgcaaccactgcagaaagc

SEQ ID NO: 15542 - DNA, 82 bp, Homo sapiens
agttggtgttaacgctgcagtttaagtgttcggattccaagggaaacagacaaacctcacgaaaggaaggaagcaagcaagc

SEQ ID NO: 15543 - DNA, 62 bp, Homo sapiens
aacgcggcgcagtagcggctgtgactagcgggccggcccgggccaggacagcgggcggcgac

SEQ ID NO: 15544 - DNA, 62 bp, Homo sapiens
aaaagaaaggaaagaaaaagaaaggaaaggaagggagggaagggaaggaagagagagccaga

SEQ ID NO: 15545 - DNA, 53 bp, Homo sapiens
agatgctatcttgcaggcctcactctagagactcaacccaatcaaccaggcgg

SEQ ID NO: 15546 - DNA, 108 bp, Homo sapiens
atgttttttcaaatctgtgatatatcaaagtgtaatccatcttttgactggatgtaatctcctttaaatcttaaaaagattcatgttctctgaatgatgccaccatag

SEQ ID NO: 15547 - DNA, 87 bp, Homo sapiens
ctctcccaggccaatgcagcctacctaccttacaagtggcacaggcctgggcaacccgccccccacccccatcccttccaccgcaca

SEQ ID NO: 15548 - DNA, 62 bp, Homo sapiens
tggcccgcgctcgccccccagggcctcatgtcggaaccacagcctgacctggaaccgcccca

SEQ ID NO: 15549 - DNA, 53 bp, Homo sapiens
ctacaaaagatgcacattaaatatacaaatagcctgaatgcaaatggatggct

SEQ ID NO: 15550 - DNA, 241 bp, Homo sapiens
  misc_feature 145: n=a, g, c or t
caatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaangccaaatctgtcctctttcccctgacttccttacagcatgtttatttatattacaagccattcagggacaaagaaagaaaccttgactaccccaca

SEQ ID NO: 15551 - DNA, 100 bp, Homo sapiens
caaaaaaaaagtcagtcccatctgtcaaattgcctggagaatgcatttaacaagaaatgaagctacattaaaggccataaaatatgcagcgagggagcga

SEQ ID NO: 15552 - DNA, 52 bp, Homo sapiens
tcttcttcgtcccgggcggtgcgttccactgctctggggccggcgccgcaca

SEQ ID NO: 15553 - DNA, 105 bp, Homo sapiens
tccgtttggtccagccccgtcgtgcacgcaatcggagatccagatgtgattgtactgagagccaatgccctttcactcagcaatcgtgcctaagaaaaaaaaaaa

SEQ ID NO: 15554 - DNA, 131 bp, Homo sapiens
  misc_feature 31: s=g or c
  misc_feature 34: y=c or t
  misc_feature 96: s=g or c
  misc_feature 100: y=c or t
  misc_feature 131: s=g or c
acagtggaggtctaacctttggtttgcggasggytcgggtgtattctccgccgcccccacgccctcgaggtccccgccaccgaaccagcggcggasccgyccgcgcctcccgcggcattcccgcaccggas

SEQ ID NO: 15555 - DNA, 136 bp, Homo sapiens
cacctctgtgttttcttctagaagatgcattttgggtctgagaggagcattttcctggaaggccatcttttaaggcccctgcttgctgtcatagtgcagacagaaacttgcacactatttagagagctccctcccc

SEQ ID NO: 15556 - DNA, 82 bp, Homo sapiens
ttcgatttcctcatagtcctttaagttgacatttctgcttactgctactggatttttgctgcagaaatatatcaatggccca

SEQ ID NO: 15557 - DNA, 94 bp, Homo sapiens
catgaactgaagcttgtcagcaaagacaggaaaataaattttgaagatactcttatagatttgataaactgaaaaatatgcaatgcctggggaa

SEQ ID NO: 15558 - DNA, 129 bp, Homo sapiens
cagttgtaaaaattgtcatgttgtaattcattactcagctaacatttagtctactcttgctagtgagtgccaagaaccaacttggtaaggttgaggctttgcaagttaactgctggggttataggatca

SEQ ID NO: 15559 - DNA, 128 bp, Homo sapiens
atttacctctctccctcctcctctcccctccctccccccgctaccctaactttgccaggcaccttttcccttccatccatcttaaaggaaggaagggacgggctgagttccccgacgagagacacacg

SEQ ID NO: 15560 - DNA, 239 bp, Homo sapiens
acaggacacaggcatgggcaaagacttcatgactaaaacaccaaaagtgattgcaaccaaagccaaaattgacaagtgggaatctagggtcgtgctcagttggatgtgaaatctcagctacagcttccttttcttctctatcaccttggttctatttgataatcttccctcaccaaggacatgaaaggaaaggacttctatgagccaaaaaaaaacacataatttgaatcaacacaacc

SEQ ID NO: 15561 - DNA, 72 bp, Homo sapiens
aattcttgagattcctctactctcgttatctgacctcatggatgaacttcaggatgttcagctcacagagat

SEQ ID NO: 15562 - DNA, 54 bp, Homo sapiens
cagcaaatctcccagcaaaaccagctgaagaagctcagaagcacagacagcaga

SEQ ID NO: 15563 - DNA, 77 bp, Homo sapiens
attgtctggcccctctgtggaggagctggaaagagagcttgaggcaaacaaaaaagaaaaaatgaaagaagcacacg

SEQ ID NO: 15564 - DNA, 64 bp, Homo sapiens
atattttttgatgcacaagaatcccaaggtccaattgtggtctacttatcaagttaggagtgca

SEQ ID NO: 15565 - DNA, 73 bp, Homo sapiens
atattggactctaactctggtcagccgcggcgccgggactgtggactcgcggttcctcccgcccagcgcgccc

SEQ ID NO: 15566 - DNA, 67 bp, Homo sapiens
tcatattttcaggatctctgtcagataaccatttaacctcttgcatgtcttcaatagtgggaaatcg

SEQ ID NO: 15567 - DNA, 73 bp, Homo sapiens
ggtttgtatgctttgtctgtggcagctataacagtggtaagaacattttgaagatagctttttaaaggaaccc

SEQ ID NO: 15568 - DNA, 50 bp, Homo sapiens
cttgtacaatagtgtgtacacacacacacacacacacacacacacacttc

SEQ ID NO: 15569 - DNA, 114 bp, Homo sapiens
  misc_feature 8: k=g or t
  misc_feature 9: y=c or t
aaaactgkytttcctcccccgaggagggagcagggagagagggtggagtgtggtttgcggccaaacctaaaggctgcaattaaccagccgcccggccttcgctactccggactc

SEQ ID NO: 15570 - DNA, 118 bp, Homo sapiens
caaatgagcagtgcctgttcaatttcacagtctctgttgagttcagttgtaaatatgtttcaaatgacattttcttgggaaaaaaaatctctacaacattgtagaatgtgaggggcca

SEQ ID NO: 15571 - DNA, 125 bp, Homo sapiens
ttttttgaggtggagtttcactcttgtcacctaggttggagtgcaatggcgtaatctctgctcactgcaacctctgcttcctgggttcaagggattctcctgcctcagcttcctgagtagctgat

SEQ ID NO: 15572 - DNA, 107 bp, Homo sapiens
  misc_feature 19: r=a or g
  misc_feature 57: r=a or g
  misc_feature 58: r=a or g
tatgaagtatttgcccgtrcctatgtcctgaatggtattgcctaggttttcttgttrrgtttttatggtgttaggtcttacatttaagtcttcaatccatcttgagt

SEQ ID NO: 15573 - DNA, 201 bp, Homo sapiens
tgggctccacccccacggacctaggtaaggacaggcacttctgctttcatgccgaaatgtagcattttccaagaccaccctggcctgccgtgcccccatcatgggcctataaaaaccagagaccttagcaaggcagggacgcaagcagctggacatcataaggaacacatcagcagaagaagacacaagcagctggtctaa

SEQ ID NO: 15574 - DNA, 94 bp, Homo sapiens
tgaaaatataaaaatactaaccaaaagaagtctgaggtaactatggtaatattaaaactccaagatttaatgtaggaaatattattaaaggcaa

SEQ ID NO: 15575 - DNA, 94 bp, Homo sapiens
atatctgcgcgtgcgcggcgtcgctgctgggccagtcgggacagaggagacaagatggcgctgcgggcgatgcgggggattgtcaacggggaca

SEQ ID NO: 15576 - DNA, 155 bp, Homo sapiens
  misc_feature 113: r=a or g
acaataatggacataccttagattaagacacaaatagattgaaagtaaaagtgagatcatgcaaataggagagctggagtaactatattaatgtcagacagtttaagcaagaratattactagagacagggacatactgtaatgacaaaatgggc

SEQ ID NO: 15577 - DNA, 140 bp, Homo sapiens
atatgatggagtctcgcactgctccccagggtggagcacagtggtgcgaccttggctcactgcaccctctgcctcctgtgttcaagcgattcttgtgcttcagcctcccaagtagctggtattacaggcgcgtaccacct

SEQ ID NO: 15578 - DNA, 58 bp, Homo sapiens
aggagtcgagtcccaaggcatgcttctgtgtgcttctatagaagggataaaccgccac

SEQ ID NO: 15579 - DNA, 70 bp, Homo sapiens
tgttttaaccttatggtaatactttgctttagtcgttcctcctgctaccagtagcgttttgacccaccct

SEQ ID NO: 15580 - DNA, 107 bp, Homo sapiens
atgcacgattggctccgccatccttggctcaacaacagggtttccaaccaggtctctctcagccaacttcagttcagcagattccaatccctatttatgcaccacca

SEQ ID NO: 15581 - DNA, 202 bp, Homo sapiens
tagtcctattttttaaatgttgaaatggaaactgagtgactaattaacatgcctgaaatcacaatggtgaatcatgaatctcgaatttgattctagattttttttgctcattctgatgtgttggttagtcttgttatagtacagttgtagcacatggaaatggatgggaccatgcatggaagccagagagtctagagcagga

SEQ ID NO: 15582 - DNA, 131 bp, Homo sapiens
ccacgggcttggaaatgccttgatctttactgaccgagttgtatattgagcctagccctagcccttttaaggggcactgtgtggaatggcccaggctccccagatcgaaacttctcactcttcaccatcca

SEQ ID NO: 15583 - DNA, 226 bp, Homo sapiens
  misc_feature 9: s=g or c
  misc_feature 13: n=a, g, c or t
tgagcgcastggnacccagcagccgctgtctccagtgccgcagcagcaggtagtgctcatagctctctttgtccagtgcttcggccttggtcccagcgccctccgccccatactgtcttggaacatgcagtggagtctcttgtttgaggaggaggtgccagccttgtgccagcaagcacatgccatgatgatgccacacttcttttatccatcttctgtaccccca

SEQ ID NO: 15584 - DNA, 62 bp, Homo sapiens
tctgccaccatgccagtgagcactggatatctgataacatggttaaaagtaagaccgagtgc

SEQ ID NO: 15585 - DNA, 73 bp, Homo sapiens
acgcgcgcgaacacacacacacacacacgcacacgccgcgcgcggtcagctagagtttggctactggaccctt

SEQ ID NO: 15586 - DNA, 50 bp, Homo sapiens
agatcaaaatgaattagataaatcaacttcacaaatgttaagcggaacat

SEQ ID NO: 15587 - DNA, 125 bp, Homo sapiens
tgccttactattgacattaagaagaagagaagtctttcacaagtcatgaatgaagaatttggaatcagcctcagaatgagatgccataattattataaacctgttttggttgttcagcctcccct

SEQ ID NO: 15588 - DNA, 60 bp, Homo sapiens
tttttaaccatcaagggaccttggagagtggccactacaccagctttatccggcagcact

SEQ ID NO: 15589 - DNA, 66 bp, Homo sapiens
catgattatcttaattcctgtgaagtggcactctacactctaattaaacttttatctgatgtacat

SEQ ID NO: 15590 - DNA, 74 bp, Homo sapiens
ataaacctgccaccaatagtaacaaagtgctggatgcaccttttgtgcttatctttgtgctaaatgtgcccaaa

SEQ ID NO: 15591 - DNA, 90 bp, Homo sapiens
cccagacagtcaccctaatcctagttcactctctgtatccctaaaaaggcctcactaagttgttattgattatcattttgaatggaagaa

SEQ ID NO: 15592 - DNA, 120 bp, Homo sapiens
gaggttgggaatttgagaccaacatggcgaaaccccgactctactaaaaataacagagtggctgggcatggtagtacacgcctgtgatcccagctgcttgggaggctgaggcaggagtct

SEQ ID NO: 15593 - DNA, 80 bp, Homo sapiens
agatctcatgagaactcactccctatcatgagaacagcatgggggaaactgcccccatgagaaaatcacctaccaccgaa

SEQ ID NO: 15594 - DNA, 66 bp, Homo sapiens
tagttttaatcattcctttgaaagtagtgatgtcataattgtactaatccacataagcaccacaga

SEQ ID NO: 15595 - DNA, 135 bp, Homo sapiens
actacagagtcagatgcagcgacaacttttgtctaaccctgaaatgatggtccagatcatggaaaatccctttgttcagagcatgctctcaaatcctgacctgatgagacagttaattatggccaatccacaata

SEQ ID NO: 15596 - DNA, 54 bp, Homo sapiens
  misc_feature 16: y=c or t
  misc_feature 24: r=a or g
  misc_feature 44: s=g or c
  misc_feature 45: r=a or g
  misc_feature 50: r=a or g
  misc_feature 53: r=a or g
cagcaaatctcccagyaaaaccarctgaagaagctcagaagcasrgacarcara

SEQ ID NO: 15597 - DNA, 337 bp, Homo sapiens
catttttcttgatattgtacattttgaaacatttcacctctggccagaccatgaggaaccaaccactctgcctgccacaccgctcggagcctggaaactgaggggtcaggccctttgcaggaagaaaagtggaaatgcactaagtcagggtgggtcaaagcagggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgc

SEQ ID NO: 15598 - DNA, 115 bp, Homo sapiens
attcctactcccagcaaccactgatctgctttctgtctctagaaattctctgtctcgggccattatttcgtagaaatgggctcatgaagttacaaagctttccaactaaccggca

SEQ ID NO: 15599 - DNA, 68 bp, Homo sapiens
gaggcggtgcgacagggatgcgggcacgcagctcgcgccccggcagccgcagaccagcccggagcgaa

SEQ ID NO: 15600 - DNA, 72 bp, Homo sapiens
tcaagagaaatgttaggaagtcttcaggacggggtgagttactgatctctctctgctatcagtccaccacag

SEQ ID NO: 15601 - DNA, 77 bp, Homo sapiens
gacagcatctgctacaaaactgtccccaaaagaaaagatgggatacagctggttatgctgcagttaaaaagcaacca

SEQ ID NO: 15602 - DNA, 81 bp, Homo sapiens
catataaaaggaatttggagggtgtcgcttaaaattttattccacctgtacatttgtcactttaaaattaaaattgagctg

SEQ ID NO: 15603 - DNA, 113 bp, Homo sapiens
gcaaccttataaatagtgttttccaaactgtgtcccaggactgcaaatctttaatgtgaaatgtctttttataatctcttcctttaaaaaaaaccaataaaataaaatgccgc

SEQ ID NO: 15604 - DNA, 72 bp, Homo sapiens
acctcatagagttagatagagttgatcccatccaaaatccagtcttgtagaatccgcatctgatgaccagcg

SEQ ID NO: 15605 - DNA, 103 bp, Homo sapiens
cttcacttcccagacggggtggcggctgggcagaggctgcaatctcagcactttgggaggccaaggcaggcggctgggagatggaggttgtagctagccgagg

SEQ ID NO: 15606 - DNA, 66 bp, Homo sapiens
agtttggggggcggggcctggccctctgcctcggggtgggctccgccccgtcccccgcaggccctt

SEQ ID NO: 15607 - DNA, 126 bp, Homo sapiens
ataaaaactgggccgggcatggttgctcatgcctgtaatcccagcactttgggaggccaaggtgggtggatcacctgtggtcgggagttcgaggccagcctgatcaacatgcgggaaccccgtctc

SEQ ID NO: 15608 - DNA, 95 bp, Homo sapiens
gatttgaccgtccatatatgcaggtttcacatcgcacaaataactatttttgatccctgtttggttgaaaaatattcataaataagtggacccta

SEQ ID NO: 15609 - DNA, 61 bp, Homo sapiens
taaattgctgaagccatgttaatttatttgtttaatgctgaaaattatgttcatgcaacac

SEQ ID NO: 15610 - DNA, 108 bp, Homo sapiens
gaagggtcctgtgggtatgaaggaaggaaaaggggctgtggttaagtgggctgggggcagagtggtttggggtcatggggggtcgccgagctcccctgaaacgccggc

SEQ ID NO: 15611 - DNA, 59 bp, Homo sapiens
ctataaatgtgattaagtcaatgaataaaaacattaatgcattggtgatatccagcaac

SEQ ID NO: 15612 - DNA, 311 bp, Homo sapiens
atttccccttttccttggagccatttggttttagattaaaatcttattgttcttggtttctcatggggcggttctgttctctactgaaggaactctgcctttgtaggtctcctgaatctgagtaagactaggtaagttgaatttctcctttttcctgccagaactgagttggtcagagcttttcacagactgttcgaagtcgcagagatgcacgagaccattatgctgctattaaaaaggcctgggatgatctcaagaaatatttggagcccaggtgtcctcggatggttttatctctgaaagagggaagc

SEQ ID NO: 15613 - DNA, 66 bp, Homo sapiens
cctggtggcatacttttacagaaatagaaaaaaattctaaaattcatttgaaatctcagtggaccc

SEQ ID NO: 15614 - DNA, 79 bp, Homo sapiens
tatttttttgacagtattcttctttgtatctcaaattgttttgctttttaaacattcttattttagttatctggagcaa

SEQ ID NO: 15615 - DNA, 103 bp, Homo sapiens
  misc_feature 28: k=g or t
ttctagttatgcaacaagggatcctttkgagagtcccaggcctattatccctttcttttcaaagggtaggggtatgataacagatcctaaaaacacctgaaaa

SEQ ID NO: 15616 - DNA, 118 bp, Homo sapiens
ttaaatgaattaatccacgagaagctcctagaatggtgcctggtactgtgtaagtcttggttggcagtcatgattatgttatggaacggaggcatccagcctcccccaccccctacaa

SEQ ID NO: 15617 - DNA, 56 bp, Homo sapiens
gaggaccgagaagagtgacagggctgtgcgctctggggcacctcatgcagacggga

SEQ ID NO: 15618 - DNA, 63 bp, Homo sapiens
gctgtaattatcggcctttgtaaatgttgttcctctgcttagaacaccctcactaccgtcccc

SEQ ID NO: 15619 - DNA, 77 bp, Homo sapiens
  misc_feature 10: s=g or c
agcggcggascaggcagccccgcggcggccgagcgcgctcgcgcatcgggccctctggccttctttacctagggcac

SEQ ID NO: 15620 - DNA, 357 bp, Homo sapiens
taaattgactcagggaaaatgacacctttatgacattgagcttttctatagaagaacaaaggacatcttcctatttattcaacattattctatatccctcagatatgttttaaagtttttctcacctaggcggggtagatgagtgataaaatcttctgtcttttgggctgatgttctgggacatctgggacatctggggtttcttctgcccctgtgtcaagaagcccaggagaagaataagcaagactgaagacctctgcctctccatttcctaccaggtgcctcttccctctaagcacccttcccatacggggaatcatcaaacatgattcttttttgcattcgctgttttctcta

SEQ ID NO: 15621 - DNA, 114 bp, Homo sapiens
cactgctatattcatcctgtttcttagaatggtgcctggcacatatcaagttcttgataattatttgtagaatgaatgattcaagatctctcttttgaatttccataccctacc

SEQ ID NO: 15622 - DNA, 66 bp, Homo sapiens
  misc_feature 29: n=a, g, c or t
tggtaacccatggcccccgccctgcgggnataacattctcaggagcttctcttgtcctagcccctt

SEQ ID NO: 15623 - DNA, 64 bp, Homo sapiens
tgactacaaagacacaggaaaccaagggcccagtctcccctccacgctgaaatacgcacccagc

SEQ ID NO: 15624 - DNA, 59 bp, Homo sapiens
atccctgcctccctctcccccctctgtttttctcccttccttccctctccgaccctcct

SEQ ID NO: 15625 - DNA, 93 bp, Homo sapiens
aagcaatcctcctgcctcagccactctagtggttggaactgcgggcacgtgccaccacacctggctagtttttgtatttttggtagagacggc

SEQ ID NO: 15626 - DNA, 83 bp, Homo sapiens
caatgccctgtctcagagatatttccttcaagccaatgatcagaaagatatgaaggactgggttgaagccctgaaccaagccg

SEQ ID NO: 15627 - DNA, 82 bp, Homo sapiens
  misc_feature 81: k=g or t
acatggcttggacccacatatctcagttggtgttgtctctggacctacctcaagttcccctcacatattaaaaccactcakc

SEQ ID NO: 15628 - DNA, 97 bp, Homo sapiens
agtccagacatcaattcaaaactgaagctgcagcaatgaagaagcagtcacatacagaaaaaagctaatcatgctctctaccaactaccatgaggca

SEQ ID NO: 15629 - DNA, 60 bp, Homo sapiens
ttttctcaatgccaaaatatcagaatcaaaatatttttgaaattgctaattggaggcatt

SEQ ID NO: 15630 - DNA, 75 bp, Homo sapiens
aaaaataacgagaggacttaataaatggcaaaagctgtaaattctccttgattcacagaattgcttgaagggcag

SEQ ID NO: 15631 - DNA, 151 bp, Homo sapiens
acaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggccatt

SEQ ID NO: 15632 - DNA, 106 bp, Homo sapiens
attcccggtagatgcagcggagtctgagctctgctgcatctgtcacagcagaacaaaattaaaaacacaacagtggaagagaaacgctgcagactatgggacgcga

SEQ ID NO: 15633 - DNA, 81 bp, Homo sapiens
ctacaggcatgcaccaccacctcttgctaatttttgtgttttttttggagacagcattttaccatgttgcccaggctggcc

SEQ ID NO: 15634 - DNA, 72 bp, Homo sapiens
attaaacaactcccctttttgttttctcctcagtggaatagaattttgactccatataaatcaagaaacacc

SEQ ID NO: 15635 - DNA, 88 bp, Homo sapiens
caccatatagtacaatgtaatgatagggaaattcagagttcaaagtattttaatgtcataaaccaattttgagctttaatggaagaag

SEQ ID NO: 15636 - DNA, 56 bp, Homo sapiens
  misc_feature 12: k=g or t
  misc_feature 13: r=a or g
  misc_feature 21: s=g or c
agaggggagcgkrccgcgcascaggcagcgcgtggggcgagcgcggggagagcggc

SEQ ID NO: 15637 - DNA, 61 bp, Homo sapiens
aattttttttaattagctgtgcgcaattgctcatgcatagtcccagctacccaggaggctg

SEQ ID NO: 15638 - DNA, 50 bp, Homo sapiens
agaaggggtgcgagcggcggcggcggcggaggctgccatggacgacgtag

SEQ ID NO: 15639 - DNA, 84 bp, Homo sapiens
ttaccttccctctaacactggccccaaccaggacggggctgttcattctagggcataggggtggtgtggagcagtggccactca

SEQ ID NO: 15640 - DNA, 163 bp, Homo sapiens
aagagcttgatttggacaagagaaagaaaaagtggtagaacctagtgagtgagtggttctgagctgactgtgttcttgggcttcaaatcctgtgaagataagaggagatgcaattcctggtgttctctaattgtcgtgtaactttaaagttcctagcacccga

SEQ ID NO: 15641 - DNA, 129 bp, Homo sapiens
catcaggataaaaaatctgtaatactaaaaatgttaaataatttcagttgccaaattttcagttgaaatgtcaatatataatttatttcttaatttgcatggctttttaggtcatttattatctgggga

SEQ ID NO: 15642 - DNA, 153 bp, Homo sapiens
tacatagatagatagatagatagatccaattttgagggccctagaagttgtgagccagaacgttggaaaagcctttttgaagagaaaaaatcaagtggttaaatcatattagatttgttatcactagaaaaaaatttttaaacagcaccccta

SEQ ID NO: 15643 - DNA, 217 bp, Homo sapiens
atgcttagtgatgttgaacatctgttcttgtgtttgttgaccattcatgtatttatttggagaaatacatattcaagatctttgcccatcttttaatctggttatttatttttttctgtttttaaatatttataatttattgagagccttctgtggaatggactgttctaagtgaatgcattaatttatagatctaaactcagccaaaagattcagc

SEQ ID NO: 15644 - DNA, 289 bp, Homo sapiens
aaaaaaaaaaaaaaaactaatgtgtttttatgtatagatacatattttagttacagtattgcatctctgacctgtgagccagaattttgaggctctcattatccatttgcctatgtgtttttgctggcatgtcatgatctgccactgtagagaaggaatagagttctagccaaatgtgtgtcctggtcaagttcctcaactcacaaaaaaggatgtcagtccccgcattatcccccacctgactataaaaatatgtgactccaccctagccagttgcatagctgtacat

SEQ ID NO: 15645 - DNA, 426 bp, Homo sapiens
  misc_feature 236: k=g or t
  misc_feature 375: m=a or c
  misc_feature 419: y=c or t
ttattttagacggagtctcgctcagccacctgggctggggtgcagtggtgcaatctcggctcactgcaactttgtctcctaggttcaagtgattctcccgtctcggcctcccgagtagctgggattacaggcacctgccatcatgcctggctaatttttgtacttcagtggagacggggtttcaccgtttgagcgaactgatcttgagctcccgacctcaagtgatcctctcgccktggcttccctaagtgctaagattacaggtgtgagccaccgcgcccagcccaatgcagcttttaaaaaatcaacttatctagtattaacttccagaagttaatttagtgagtcaacaaattagcctttttctggcttttmacatatatccttgtattgcttttaaatgatttttttaagttaayggcagcc

SEQ ID NO: 15646 - DNA, 412 bp, Homo sapiens
  misc_feature 404: h=a or c or t
  misc_feature 405: n=a, g, c or t
ctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagctaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaggttgagagctattgctgattagttaccacagttctgatgathntccctca

SEQ ID NO: 15647 - DNA, 243 bp, Homo sapiens
agtgtgaaaggagtcagggctagaggcagcagagggaacagcaaagaagagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggccccc

SEQ ID NO: 15648 - DNA, 127 bp, Homo sapiens
  misc_feature 121: v=a or c or g
aaaatttacacacagaaataaaatatattcaagtaaaaatatagaaatgaaagtatagttatgttgctcaaacacttgaatacttagagaaacttctttttttttaaacttgtattttagvttcacg

SEQ ID NO: 15649 - DNA, 157 bp, Homo sapiens
ttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctagcccccaga

SEQ ID NO: 15650 - DNA, 257 bp, Homo sapiens
  misc_feature 139: k=g or t
tgatgagtgctatggaggaacttaatgaaggggaatgagagtgccccagctggagctggagcagtggcaaggatttttatttaaatagtagggtccgggaaggcctccctgaaaaggggacatttgagcaacatgagckatgtatgtatctagggaaaagactctgaagctggcttgtgacagcaaggaggccagtatggctggggtggagtcagccagggggagagaggtaggagatgaggtaacagggtgggaac

SEQ ID NO: 15651 - DNA, 221 bp, Homo sapiens
  misc_feature 163: r=a or g
  misc_feature 164: k=g or t
gaaatcagcctggccgaggtgctgaaactccgtctctactaagaatgcgaaaattggccaggcatggtggcaggcgcctgtgatcccagctgctcgggaggccaaggcaggagaattgctcgaactcagggggtggaggttgcggtgagttgagattgtgccrktgcactccagcctgggcaacagagcgagactctgtctcaggaaaaaaaaaaaaaaaa

SEQ ID NO: 15652 - DNA, 324 bp, Homo sapiens
atcaaggtcggcgctgcgaccgaagtcgaaatgaaggaaaagaaggcccgcgtggaagacgccctgcacgctacccgtgctgcggtggaagaaggcatcgtggccggtggtggcgtggccctctgcgcgcacgccaagcggctggcgagatcaagggtgacaaccctgaccaagacgctggcgtgaagctgatcctgaaggccatcgaagcccctctgcgcgagatcgtttacaacgctggtggcgagccatcggtggtggtgaacgctgtgctgaacggcaagggcaactacggcttcaacgctgccaacgacactacggcgt

SEQ ID NO: 15653 - DNA, 106 bp, Homo sapiens
tcctgctctgtcccctcaggtgtcctgcaggcacagctcctcggggggcccaggccgatggcaggtcttaacgtgtccctctccttcttctttgccacctccgccc

SEQ ID NO: 15654 - DNA, 204 bp, Homo sapiens
tattaaaagaaaaaaatcactactgggcacggtggctcacacctgtaatcccagcactttgggaggctgaggtgggcggatcatgaggtcaggagatcgagaccaccctggctaacaccgtgaaaccccgtctctactaaaaatacaaaaaaattagccgggtgtggtggcaggcacctgtagtcccagctactcgggaggcag

SEQ ID NO: 15655 - DNA, 72 bp, Homo sapiens
aaatacagatcagctgctactgtgtatacacaaccagggagcaaatcaaccagcacatttaaagcagcacat

SEQ ID NO: 15656 - DNA, 169 bp, Homo sapiens
  misc_feature 7: m=a or c
  misc_feature 8: n=a, g, c or t
  misc_feature 10: r=a or g
gcggagmngrccctaccgtgtgcgcagaaagaggaggcgcttgccttcagcttgtgggaaatcccgaagatggccaaagacaactcaactgttcgttgcttccagggcctgctgatttttggaaatgtgattattggttgttgcggcattgccctgactgcggagtacc

SEQ ID NO: 15657 - DNA, 285 bp, Homo sapiens
taccttgcagggatattgtgaggtttgaataagataatacgtattagcacctagcatatgtgaaacatacagtggatactcaatatccgtgagttgtcttttcttccttccattcattcgggagatgcttagggaagcagatataccagattcaaaaggatttagaccctcgcttggtccttatgtccttttctgtaatggtattctcacctttgggaaatgagaattagtagggaaggaagtgtgcatatagccaggtcctgtctgtttttaaataatccacca

SEQ ID NO: 15658 - DNA, 238 bp, Homo sapiens
gtcaagtagattcttagctgggtttggtggcacacaccattaaatttgtggtttcaacaattcactaaggaccccaacgtccataaaaaatatggagtgtttcacgagtttttgtgtcatcttcttcagaagccatgataatctttgtattccaattttagtatatgggctgctgaagcaagccccgggttattcattcacatcataattttgagtacttagtcatactggtccatac

SEQ ID NO: 15659 - DNA, 83 bp, Homo sapiens
aagactatactttcagggatcatttctatagtgtgttactagagaagtttctctgaacgtgtagagcaccgaaaaccacgagg

SEQ ID NO: 15660 - DNA, 199 bp, Homo sapiens
tcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtggagc

SEQ ID NO: 15661 - DNA, 336 bp, Homo sapiens
  misc_feature 79: y=c or t
ctgtcattctgatctgcttttattggttgacattcttcaatatagaagacatctttcccatcaacaggggatgaactaytaaattcctcctaaaagggcagagttaagtttttctctttaattatcagtgctcatagtaagtagttgaacactgatgattcttttattttatttcattttcattttttgagagacagagtctcattctgttgcccaggctgaagtgcagtggcatgatcatagctcactgcagccttgacctccttgattcaagcgatgctcccacctcagccttccgagtaactggggctacaggcacatactaccacaccacaa

SEQ ID NO: 15662 - DNA, 207 bp, Homo sapiens
gttggccaggctggtctcaaactcctgactgacctcaagtgatcttcccgtctcagcctcccaaagtgctgggattacaggtgtgggccacaatgcctggccccttctgcatccttgttattaacatgtccctatcatttttttatgacatccttactttctgtagaagatgttctcagttcattttattatttccccaccccagtg

SEQ ID NO: 15663 - DNA, 160 bp, Homo sapiens
aagatttcaaagttcctccaagagtgaatgatttgcacgtgtgaggactaaaccttaaaatgtgacaatcccttctttattttacaaatcaggctttgaatcccatcttctctgccaatgaggatgttttttctcagacttctctacatacatgcccccc

SEQ ID NO: 15664 - DNA, 209 bp, Homo sapiens
agaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagcca

SEQ ID NO: 15665 - DNA, 154 bp, Homo sapiens
tgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcaccca

SEQ ID NO: 15666 - DNA, 229 bp, Homo sapiens
aaaaacaaaaaccacttctcctccagtgcccctcaattagacaataggcctgatttattcctcacttacttattcatgcagtgcccctgagaggagcattactgaatcaaaatggaattaactcaacaaatgtttattgaacacctactatacaccaggccctgtttcatgtacttgggatatagccatgaatgaaataagcaaagatcagggaactttctagccagga

SEQ ID NO: 15667 - DNA, 198 bp, Homo sapiens
agaaggaagtggcctggtggatacacacctgttctctgcaggctctttccttgtcatgtttctcccctggggtttgcagcctggcttttcatttttagtatccttctgaaagaagagagaaaaattttcagcaaagaaggcaagtaaaagatgaaaattaaattatgagaattaaaaagacaacattgagcagagaca

SEQ ID NO: 15668 - DNA, 546 bp, Homo sapiens
agttctagagccactgccagccagtggtgccagcatcagcaggcgatggggctaggaaatctgtgcagtcccaggaggctgtgggccaggcagaggggccccaggctgcctctgagattgagtgtgcattaggggataggtttggggagcagcccatgctggtgattttcttgaaacaaaaatgctggtgcccagcttggtacagaaagcctgggagacaggggtttcaacttcctgataacagtgctccaattcggagcccagatctggtgctgatggaacacttgccaatggcccggttcagtgctgaataggaagaagagctggccaacttgagttattacatctctgccactcaaggtgatgtcagatggagcctatatctgagtcttctccacatccatcacactcaccaatgaagaatgaacaatgtgtcagcagggagatcagctgattcaaacatcccaggtgcagatgggaaaattgagggccatggctgctcccttcctcacaccctattttagaccctacagtttccccaagtga

SEQ ID NO: 15669 - DNA, 402 bp, Homo sapiens
gaaagaacagaggagtaggtacaaggggaaatagttttgtctgacaaaaactgcatttgcaaggcctctgctaattagaacttttatttgttaaaggcctaaattatgattaatgagtgtcactttttaagctggtattagaaaaccaaaagcattacttagcttaatgtagaatcctgattttaagtttggaaaatcatatggaatttaaatttgcagaagtcagctaaattttgattgctcagcttcataatatggatatcgtcttataaggtagcacctactacctcatctttacttcagaaaggaggatgacagggagactatatgatatagacaaatacactatttgtctattcatttaattgttttctggagtggcatccacagttagccccataa

SEQ ID NO: 15670 - DNA, 132 bp, Homo sapiens
ctaataggtatttaggagtagtgggcagaaaatagagctttctaagctcttgccgtctggttagtttaactgaagaggagctcttaaaaaacatgcccaggtcttctgtattgctcccccaccccttcccta

SEQ ID NO: 15671 - DNA, 86 bp, Homo sapiens
tatacaaaattgataaatatgtaggttcttctcttaaaaagcttctattctgttgagagagattaaaaacaaaacaaaaaacaccc

SEQ ID NO: 15672 - DNA, 274 bp, Homo sapiens
ctacttacagatgtttcagtttaggcattatccattgacctcacacatgtgtctgcacacacttctcatttcttccgcccctccaatatagttatcataattttggttgtatacattttcagtgtttcctctattataactaggtaaatcataaactgtgtagtaaatgatagtttctttttcttttctgagcaattttcctttcctctggaatgaatacttgatttttttctttctttagttttctctgtacatatcactaatccagccctaa

SEQ ID NO: 15673 - DNA, 298 bp, Homo sapiens
atatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattctaatgtaactgtgaactaagagctagt

SEQ ID NO: 15674 - DNA, 232 bp, Homo sapiens
tacttaactacattatcattgtcttttcccactcaccccaagttggaggttctatggttttgtactttaagctggtggtataattgtcaagcatgtaaattctggcattcttcctggtactgctagagcattgttatttctatgcatgggggtaagaaggctcagagaggatcctggcggataccccagtgagaaatcgtcagtggcagccagtgtgtacatacgtggacat

SEQ ID NO: 15675 - DNA, 270 bp, Homo sapiens
cttcttttcttctgggtagatacccagtagtgggattgctggatcaaatggtagttctacttttagttctttaaggaatctccacactgttttccatagtggctgtactagtttatgttcccaccagcagtgttgaagtgttccctaatcaccatatccacaccaacatggccattctactgaatgtgaattagtatcttaatgcagtaaatttagcaagaactcaaaatcatatacagaaattcattgcctttttacctaccagcaacc

SEQ ID NO: 15676 - DNA, 458 bp, Homo sapiens
  misc_feature 394: m=a or c
cattctagaattgggcaacaccttattctataaaatagaacatagcaaactttaaggtcaaagagacgtagaatttgattgtgggaattttgtcaaaaatatcaaggttcaaaaaactttaccaaagtaggatcacaggtcaatgtgaaataatagtcacttatctcatctagagtgataattaaatggcttcaaaaggcaaatgcagaaagttatatagttgtagaaaaacctgagttctttattagagagttttcataagtgatcagatagaataaagacaacatgaagcacagggaatcatcttgataaaatgcagaatctttgtttttttagaccagttacctaataggtaaaggaaaacctttcattatttccaagaaaactaaatacmcatttttattatctaatgtctggctggttgcttatacatttactgtatatgtaatatgagacat

SEQ ID NO: 15677 - DNA, 526 bp, Homo sapiens
  misc_feature 111: r=a or g
  misc_feature 112: s=g or c
  misc_feature 139: k=g or t
  misc_feature 425: r=a or g
ttgtatatttagatccctcttttgcactctagctacaaatttttgtttacaaactggtaagccaaaatattaaagctacacttggttgctctgttctgactgtgttaagarsacgggtctaggtgcacctgattggttkctggtttagcaagcacaccttgacttttgtattatggtgaaagcaaatgcttgttaactgtatagtgccttttaaaaaaattcctgtaggaagatattaatgcttagaaaaatcagtagatttgattaataaatcatctataaaaaacctgaaatatttttcaactttcatttcctagagtgtagtaaaggcagtaactgttaaacgtgaaatcaaataaagtaatttgcacctggaagaaagcctttctaaaattatttctgtagtttctagccacatgattgaraaatacaataaatgtatattatgttattacttctcatttgcagtttttataaactttaaagcaacttcagagtgctaacttgggccttctttcttccctcc

SEQ ID NO: 15678 - DNA, 96 bp, Homo sapiens
  misc_feature 90: b=c or g or t
catagacagaaagtagaatggtgtcttacagaggttagggggctgggtggatagggatttattatttaatgggtatagagtttcagctgbggaaag

SEQ ID NO: 15679 - DNA, 155 bp, Homo sapiens
cagactttgataatcacatgtagcgtctgcatctgaaattgtttttacatctgtcccacctgcacccttcaccccaggctgttagtttcttgaggacaaggacttcatcattttcaaacattattggtcaaataaatgaagaaataggctgcaaa

SEQ ID NO: 15680 - DNA, 301 bp, Homo sapiens
taaggattattttgatgtttctcttatccaaatattcacccatagggatggctaaactcagaactttcagttagaaacaaagttctacagaaaattttctttaaattgttttataccttatagttggtttggagcttttgttttcttatgctgtaataatgggtcactggaagattagaagaggcagccccctgtcatgatgctggctgtgtacaagagattggaacaagggctatgtgcacagtcacgaaaggggagtttctttatcgtatattcgatgggaatgcaggtcagtggaaaa

SEQ ID NO: 15681 - DNA, 327 bp, Homo sapiens
tattaatcaccctgagagccctgcaccgtggcttatgttccccatttccagagaaggtaactgggacttggaaaggttacagaattacccaaaggcactgggttagcccgggggggaatgaggattcaaatctggttcagtgcttgttcttttagctacactttgctggccacaaataatacgtattacgtggacgaaatttcccatctgtaggatggtttcagcacatttttaaattggggtgggggagtagatacttttcagtgtcttttttcacttggtccaattttaagcatctttttaaaagccagttcatctaaggcccca

SEQ ID NO: 15682 - DNA, 245 bp, Homo sapiens
caaagatggtaaccaagaggccaaattgctgatgtgactggacttgcccaggtgacccaggacctttgccgatggccgcggcctctctttgggctgttggtgcccatttaaaatggggcccacagtgagctcaaaaccctcatcccttccctagggtggccgggaatctgccgtccacatggagccggggaggaggagagactctgatttgctggaaggacctcattcatttccatccaaccccg

SEQ ID NO: 15683 - DNA, 226 bp, Homo sapiens
tgcttcctgtgatgttgtaagatgatgcatgatagtttccaaagcacttttacacctaagaccttatttgcaggagttcttaactcaggggatgggcagaaggaggcccagggagaggaggtgactttttttgtggtcagaaagcaccaatttgtggcagaatcagaactagaacccacctctccacaatttctgctggttgctctttcctgacatgatgatccgc

SEQ ID NO: 15684 - DNA, 204 bp, Homo sapiens
agaacagccctcccatccccaacaaattatccagcccaaaacgtcaagagtgccaaggttgagaaacttgctttaaataaatataagaacaaagtcacattcctggacaaagctctcgcctttcacaggatcttatactttcttcacaaaactttacaatgttctgcaaattacaagtgcaagagaacctacaaatcccccact

SEQ ID NO: 15685 - DNA, 111 bp, Homo sapiens
catttcactaatggctaatgatgtattaagtgtcttttcttgtgcatattggtatttcggtggagaaatatctatgcaaattttttgcccaataatttttttttttttttt

SEQ ID NO: 15686 - DNA, 141 bp, Homo sapiens
  misc_feature 110: w=a or t
ttttttttttttttttctgagacagagcctcactccgtcactcacgctggagtggctgtggcatgatcttgcctcactgaaaccttcacctcccaggttcaagcgattcwcctgcctacagcctcctgagtagctgggaat

SEQ ID NO: 15687 - DNA, 353 bp, Homo sapiens
  misc_feature 306: h=a or c or t
gccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtatthtgggtttgttgtaaaccaatgaacatttgctagttgtatcaaatctt

SEQ ID NO: 15688 - DNA, 174 bp, Homo sapiens
  misc_feature 155: r=a or g
acccgggaggtggaggttgcagtgagccgagatcacgccaccgcactgcaacctggccactgcacgccagcctggcgacagagcgggacttcctctcaaaaacaaacaaacaaaaaacagggcactgatttctgaattatatgtctccctattcrgagtctttttttttttttt

SEQ ID NO: 15689 - DNA, 194 bp, Homo sapiens
  misc_feature 78: s=g or c
ttttttttttttttgagacggcgtctcgctctgttgcccaggctggagtgcagtgggtggatctcagctcactgcaastccgcctcccgggttcatgccattctcctgcctcagcccccgagtagctgggactacaggcgcccgccaccgcacccggctacggggtttcaccgtgttagccaggatggtctcaa

SEQ ID NO: 15690 - DNA, 254 bp, Homo sapiens
catagtctcttttttttttttttttttttttgagacggagtctcgctctgtcacccaggctgtagtgcagtggcatgatcttggctcactgcaacttctgcttcctgggttcaagccattctcctgcttcagcctcccgagtagcagggactaccagcatgtgccaccacacgcggctaatttttgtatttttagtagagacaggtttcaccatgttggccaggcttgtctcaaactcctgacctccagtgatt

SEQ ID NO: 15691 - DNA, 207 bp, Homo sapiens
  misc_feature 193: k=g or t
gttggccaggctggtctcaaactcctgactgacctcaagtgatcttcccgtctcagcctcccaaagtgctgggattacaggtgtgggccacaatgcctggccccttctgcatccttgttattaacatgtccctatcatttttttatgacatccttactttctgtagaagatgttctcagttcattttattatktccccaccccagtt

SEQ ID NO: 15692 - DNA, 139 bp, Homo sapiens
tcatagtggaaggcgacggggaagtagacacgtcttcatatggccagggcaggaggaaaagagacagtgggaggtgctacacacgtctaaacaccagatctcacgagcagtcactcactatcatgagagcagcaccaac

SEQ ID NO: 15693 - DNA, 368 bp, Homo sapiens
aggttcaggagctgctcttctatgagccacctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacgcg

SEQ ID NO: 15694 - DNA, 126 bp, Homo sapiens
tgtagtgctgtttccatctgtttcatatatgtgctgatctgagacctgcatagtggtctctccattagttccaatttggaagcctttggtacggaatagcgtcagatccatgcatatgcagcctag

SEQ ID NO: 15695 - DNA, 348 bp, Homo sapiens
  misc_feature 342: s=g or c
tatttattaaaaataataggccaggtgccatggctcatgcctgtaatcgcagcactttgggaggccaaggagggaggattgcttgagcccaggagttcaagagcatcctgggcaacatagcaagactctgtctttacaaaaaaattttttttaattactcaggcacggtggtacatgcctgtagtctcagctacttgggaggcttgggtggaaggatcacttgggcccgggaggccaacgctgcagtgagcacttaagcctgggcgacatagcaagaccctgtctccaaaaataatgataataatacctggcatcaatattaaggagcagccatggatacasgcagca

SEQ ID NO: 15696 - DNA, 99 bp, Homo sapiens
gtagggaggagggcgggtattgatgctttacagatctgcactgctggagcccaaggaaagaggcagagacaagggtcctttaggcagcctcgccgcaag

SEQ ID NO: 15697 - DNA, 177 bp, Homo sapiens
attatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccaat

SEQ ID NO: 15698 - DNA, 213 bp, Homo sapiens
  misc_feature 99: k=g or t
tataagaataactacttctaggccggaagtggtggctcacacctgtaatcctagcactttgggaggcataggtgggtggattgcttgaggtcaggagtkcaagactagccttgcaaacatggtgaaaccatgtctctgctagaatacaaaaattagccaggtgtggtgctcacgcctgtaatcccagctacttgggaggctgaggtgggagct

SEQ ID NO: 15699 - DNA, 81 bp, Homo sapiens
catgattgcatctgtgaagagacactgcactccagcctctaacctggcacaggaagaccctgtctcaaaaaaaaaaaaaaa

SEQ ID NO: 15700 - DNA, 243 bp, Homo sapiens
  misc_feature 132: r=a or g
  misc_feature 133: r=a or g
  misc_feature 152: k=g or t
  misc_feature 175: r=a or g
  misc_feature 238: k=g or t
aaaaaaaaaaaaaattgagaaagtatatgccaggtactggagaaatagcaattaagagattaagtttgccttcatgaaaaaaaggggaaataacaaatatataatttcaagtattttatataaatatacatrrtgatgattatacataattktaggtaataaaaattctacattrgtataaaggatgtatattagaaaatgggaaggttcagataaggtggttagagaaggcattgckgaggt

SEQ ID NO: 15701 - DNA, 78 bp, Homo sapiens
  misc_feature 68: m=a or c
aaacttgcaatcatggtggaaggggaagaggcaagtcttacgtggtggcaggtgagagaaagcgagcmagagcaggaa

SEQ ID NO: 15702 - DNA, 469 bp, Homo sapiens
  misc_feature 8: w=a or t
  misc_feature 15: r=a or g
  misc_feature 16: r=a or g
  misc_feature 79: w=a or t
  misc_feature 393: k=g or t
  misc_feature 462: m=a or c
ctgggttwttgggarragctgggtatcaaagttacatgaaaccacaaggtaatcatggcacatattcctggtatatgtwtcttctttgttttgaagattggcggcagtgaggaaatgaacgtaaacatgtatatattatgaggtagaatacaaatttttcataatatttaaagctctaagtggagacttgaaagaaattttgagcttgaggtaaaggtgccccaagatcccttgggtatatgttcactttcctcctggggcctacttgagaaacactgctgagttatgttttgctttctcaaggcttttctagtaaagaaaaagaagccaaatcttacttttgatgacattgaagggttgatcaggactatatattgcattgccttgtaactktgtttattcttacatttcttagtttatcccacctaggggagtagttaattcattttatcattatgtcamgagagcc

SEQ ID NO: 15703 - DNA, 546 bp, Homo sapiens
  misc_feature 67: k=g or t
  misc_feature 77: k=g or t
  misc_feature 78: k=g or t
tgataaattgtaggttacccagttgtgcagattctgggagtggtcttagcatatacctatgactctkaattttgagkktcggttttacttgactttcagtacctcccattgctgagccttttgaggattctcttatgtattcataagtgtgattctcatttttccagtgactcattttccttgtatttgctttgaaatttcttgtagttttctcatttcacattctctttgacctaatttttatgcagaagccaataatcaaaagaaatctttgtattcttacagggatacctttccgtaaagatgaataaaatgtgtgttttgatgtgccatttgacattttctgtcagatctgttgaaatctttctcaaatgtctccttctaccttaggcatttaatgatgcttccaaccagatatatcatcttctgaaaatctttcttcttactttggaaattttttcttctcttttgagactcttttacatcttatgttatttgtatttgaatgcttttcttacactctgccctcctctgtacaccagacac

SEQ ID NO: 15704 - DNA, 221 bp, Homo sapiens
  misc_feature 82: r=a or g
  misc_feature 163: r=a or g
  misc_feature 164: k=g or t
gaaatcagcctggccgaggtgctgaaactccgtctctactaagaatgcgaaaattggccaggcatggtggcaggcgcctgtratcccagctgctcgggaggccaaggcaggagaattgctcgaactcagggggtggaggttgcggtgagttgagattgtgccrktgcactccagcctgggcaacagagcgagactctgtctcaggaaaaaaaaaaaaaaaa

SEQ ID NO: 15705 - DNA, 166 bp, Homo sapiens
  misc_feature 78: k=g or t
  misc_feature 79: d=a or g or t
cagtcgtttcagcaccgtttcttctagagactgtttgttccctattgaatggacttggcacccttattgaaaatcagkdggtcctggatatatgggtttatttctgtactctcagttctattccattgatctatatgtctgtccttataacaatcctatactggtt

SEQ ID NO: 15706 - DNA, 406 bp, Homo sapiens
ttccaacgtatctttatgttaatgatttctgatttaattccattttggtcagagaacatactttcaatggacttgtagtcttctatttaaatatattaaggtttgttttgtggcccagaatgttgtctctattggtaaatgtttcttgtacacttaaaaaatgtatattttgctgttttttagttgttacaagcatgatgataaacctggtccatgtgctgacatgttgactataagtggacatttattttttttttaatttagatgtgctcacatactataaaactgacgcatcttaagtgttcaattcggtggtttttagtgtatttgtaaagttgtggagccatcaccactatttaattcctctaattttatcatctgaaaaagagtaccaattatcagtcac

SEQ ID NO: 15707 - DNA, 329 bp, Homo sapiens
agcagacaaagaaaaaagtcacaaagatgacagtgaattagacttttcagctctttgtcctaagattagcctcacggttgctgccaaagagttatctgtgtctgacacagacgtctcagaggtatcctggactgataatgggaccttcaacctttcagaaggatacactccacagacagacacttctgatgatcttgaccgacccagtgaggaagttttctctagagatctttcagattttccatctctagaaaatggcatgggaacaaatgatgaagatgaattaagccttggtttgcccactgagctcaagagaaagaaggaacccg

SEQ ID NO: 15708 - DNA, 139 bp, Homo sapiens
tagaaacttgcaggttagatgtacattccaggtgattcatgtgcgtactaatgtctgagaaccactgggttagggggttaggggaagaagatgtttacatcaaaatgctgatagaattatcaaatctaaaaaggggaat

SEQ ID NO: 15709 - DNA, 160 bp, Homo sapiens
ctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgaca

SEQ ID NO: 15710 - DNA, 73 bp, Homo sapiens
  misc_feature 7: s=g or c
  misc_feature 16: r=a or g
ggcagasgttgcagtragctgagatcataccagcctgggcaatggagcaagactcttctcaaaaaacaaaaaa

SEQ ID NO: 15711 - DNA, 396 bp, Homo sapiens
  misc_feature 15: n=a, g, c or t
  misc_feature 87: k=g or t
  misc_feature 100: h=a or c or t
  misc_feature 101: w=a or t
  misc_feature 181: w=a or t
  misc_feature 184: r=a or g
  misc_feature 185: m=a or c
  misc_feature 190: w=a or t
  misc_feature 207: k=g or t
  misc_feature 248: n=a, g, c or t
  misc_feature 256: w=a or t
  misc_feature 262: w=a or t
  misc_feature 299: w=a or t
  misc_feature 330: w=a or t
  misc_feature 375: m=a or c
cagattcagaagcgncaacagttagtcagaaagatacatgaagatgaattgaatgatatgaaggattatctttcccagtgtcaacakgaacaagaatcthwtatagattataaggtatgtaccactaacagtatttaaaataattgttagtaattattttgcttattagttagagcttatwgtrmttatwagtgcagattagtaaakcagtaataatgctgatcattgttgaattgagtacgggtatntagtgtgwcctagwcattgtcatgagtgtaccatatagagtatttctcttwttctcacaatatgtgaattaagcaattactwacttttataggtggaaaagaggtttagaaaagttaagtgactttmtcaaggtagcaactggcacca

SEQ ID NO: 15712 - DNA, 177 bp, Homo sapiens
gaaatcagcctggccgaggtgctgaaactccgtctctactaagaatgcgaaaattggccaggcatggtggcaggcgcctgtgatcccagctgctcgggaggccaaggcaggagaattgctcgaactcagggggtggaggttgcggtgagttgagattgtgccattgcactccagcct

SEQ ID NO: 15713 - DNA, 199 bp, Homo sapiens
taatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccag

SEQ ID NO: 15714 - DNA, 272 bp, Homo sapiens
tttagagggagctgtgagtacgcaagtagggtcagagcaacagaacgtgctgcctttgaagatagaggaaaacaacccataaggatggagtgcaatggtgcaatcttggctcaccacaacctccgcttcccgagttcaagagattctcctgtcttagcctcctgagtagctgggattacagttctgtttttgccttgggattttgaagatccattttcaggaggaaccaatggagctctcaaacctgccaggactatgagtgatggaaacgc

SEQ ID NO: 15715 - DNA, 336 bp, Homo sapiens
  misc_feature 10: w=a or t
  misc_feature 38: r=a or g
gagcatggawagggtcccgtcacagtgacctggcagarggactaaaatgtgagtctgcagctgtggcctaagcggggtattgttcagcagtgatcagttgttcagattgggaagatcgtatcatttccagttggtaccacaaaagaaggcgctatttataacagtgtggttggttgccactgacagttgtttctcacatattctaaggcatttcctgatgaagtcacgtgcagcataacttttgaaatgaaatggaaatatcaccatgaagggttgtgtttatggctaatggaattgggaaagggccactcttaaagatatacctggttgtatcct

SEQ ID NO: 15716 - DNA, 221 bp, Homo sapiens
ccgaagatattcttttaagtttggctgttcatatttagcaatttgaaatgccaaaattttgtaattatatcatgaagaagggaactaattttactttttcctttaaagaactggccagtttagtactatttattgagtagtttgatcgtttctgcactgatctgattttttaaaaatttcccgttatcttttatgtatctagttctatgttttgaggcctc

SEQ ID NO: 15717 - DNA, 289 bp, Homo sapiens
aaatctaaaagggcctatcttttacatttctagaactaataaaggggtttagtgtagtcagcaaatacaaaaggtcaatcatttacttttaaaaaatgtatgtatttaaggcatacaacatattttgatatacatagtcaaaagattactataatcaagctaattaacatatctgtctcctcacataccttttaagtgtatgtgcggtgggagtacctgatatctactcttagcaaattttcagaatacgatacagtattaactgtagtcatcatgctgtactatggat

SEQ ID NO: 15718 - DNA, 202 bp, Homo sapiens
cataacagatttgcaggtgggtttcttgtacaatctccccatgcctattagttttgcaagtgaaagaaattgaggccaagagaaacagactgttcgcaagtttttaaacaagagtgggtttgcctctactgatccacattccttgttggagtcaggtgggaatcccagtctccaggactctgtccactgcctccggaaccta

SEQ ID NO: 15719 - DNA, 128 bp, Homo sapiens
cccagggagaataatcacgggggggggggcactcaagatgatcagcactagcccagccttctcccaggctggggtaagggtttcctggggagtgctgaagtgcacttgaaccttgtcaatgactgtct

SEQ ID NO: 15720 - DNA, 104 bp, Homo sapiens
caaacaaaattgtttttagtttttgttgcattaaattaaactcttgtgcatcaaaaaacaccattaaatgaaaatataagctgcagactggggaaagacacagg

SEQ ID NO: 15721 - DNA, 52 bp, Homo sapiens
ctgtagaagtctttatgtctttgagtcttgcttgtgtgtgtaaatgtcctat

SEQ ID NO: 15722 - DNA, 267 bp, Homo sapiens
cttttctgttttgtttgtttagtagccagaactctgccaggccaaacaaacgatgtagttgatgggacagagtttgccagggttgtcggctgtgtgaaggtgtgagcgggaactccatgttctgaacaacagcagtcggctggggaagctccaatgtccaggctcagagaagcggactgggtaggcggggtacgaagctgatggaaaagtacccagctgcctcctcttcagttcttcagcctcaccgtgtgcgggagacgtgtcgtc

SEQ ID NO: 15723 - DNA, 407 bp, Homo sapiens
tccaatttcttcacatcttttccagtatttatttttcatcttttttattataggcattctagtggtgtgaagtggtacctcattgtggttttgatttgcctttccctttgatgttgaccatcctttcatgtggttactggccattgtctatgttcttagatgaaaaacctggtcgttatcctttgaccatgttttaattgattgcctttttgttgttgatttgtaagagttctttatatattctgaacaagaatgtatttttttacacttttttcataaactttgttctaaatcttgtattctttattgtttctgttttaaaattttgttttatcagctcttttctcaagaatttactatatatattagtatcatatttctgtattccaatcttgttttcatgattt

SEQ ID NO: 15724 - DNA, 436 bp, Homo sapiens
taatatttttagctttgagattttttattttagattgaaatatttctattttttatagaaaaacaaatgaaaactaaaggaaatttcccatctctttagaattaaccttaattccttttattgagtatttattactctgtatgaaggaaaaaacattttgaaatgcttttcataaatctgtctcttgcttatgtgtagtggatggggcatccacggctctatttgagggtcagtattttgaatcagatacatttggattctttataaacatgggtaggttcatttagctgtgcaccatttaaagtcatattgaattaaacattgttttttattttatttttatttttgagacagagtctcatttagtggcccaggctggagcagcgtgatcttggctcactgcagcctccgcccctgggttcaagcagtctcctgc

SEQ ID NO: 15725 - DNA, 177 bp, Homo sapiens
  misc_feature 95: r=a or g
  misc_feature 126: n=a, g, c or t
  misc_feature 127: k=g or t
  misc_feature 130: k=g or t
  misc_feature 169: k=g or t
cagtcgtttcagcaccgtttcttctagagactgtttgttccctattgaatggacttggcacccttattgaaaatcagttggtcctggatatatgrgtttatttctgtactctcagttctattccankgakctatatgtctgtccttataacaatcctatactggttttkttttttga

SEQ ID NO: 15726 - DNA, 54 bp, Homo sapiens
gtgcagtgagccgagatcgcgccactgcattccagcttgagcaacagagcgaga

SEQ ID NO: 15727 - DNA, 206 bp, Homo sapiens
tataaatagaggcaaggtcttgttatgttgcccaggctggtctcgaactcctaggctcgagggatcctcccaccttggcctctcaaagtgctggattacatgtgtgagccaccccacctggccccagctctcttaattgccagcactcctcttggaagtccctcatcttgattaccttatttaaggtcacctcctcacaggccact

SEQ ID NO: 15728 - DNA, 207 bp, Homo sapiens
  misc_feature 139: m=a or c
ctttaataaatgccttaacgggctgggtgcggtggctcacgcctgtaatcccaggccgaggcgggtggatcacagggtcgggaggtcgagaccatccaggctggcacggtgaaaccccgtctctactaaaaatgcacamaaaattggccgggcgtggtggcgtgcgcctgtagtcccagctactcgggaggctggggcgggagaatg

SEQ ID NO: 15729 - DNA, 155 bp, Homo sapiens
attttatagttctttggtaaagttaatttttccccttatatattttgctggcaagaacatttgaatgatgattacaaaatagttgtataatgacaggcatattagcggtcttcaaatatgtgagttggccatagccttttgatttagtagaccca

SEQ ID NO: 15730 - DNA, 139 bp, Homo sapiens
  misc_feature 78: k=g or t
aagttctagggtacatgtgcataacgtgcgggtttgttacatatgtatacatgcaccatgttggtgtgctgcacccaktaactcgtcgtttacattaggtatatctcctaatgctgtccctccccgctccccccaccga

SEQ ID NO: 15731 - DNA, 219 bp, Homo sapiens
tgcatgccaccacttaggaaagtataacttttttcaaaatctttgcttttcagatgaaatacctgtcacaaagagaacattaaaaataaaacaagagtcttctgaagaagcacagtaagtagatgcttcacctttccagaaagtgtgtctgcctaagtttaatgaccattgggaagatcagaaaatatttagacatattatgaaagttccggccataaa

SEQ ID NO: 15732 - DNA, 158 bp, Homo sapiens
  misc_feature 152: y=c or t
ctaaccaccacccccccgacacacggtaactatatgatacagtggatgtataatttacttggctgtagtaatcactttaccatgtaagtgtgtatcaaaacatcatagtatatatatcttaaatatgtacaataaagaagaaaaaaaacagycccacc

SEQ ID NO: 15733 - DNA, 570 bp, Homo sapiens
  misc_feature 46: k=g or t
  misc_feature 47: y=c or t
  misc_feature 65: d=a or g or t
gaaaaggcccagcgcggtcgcgtgtgtaactcaggacgcggctgckytgggcgcccgagcgcgtdctcaggactgcggcccggagttcactgcgaggactgggatcacccatcatcccgccctggtctacggaaaatgacaagtgtttactgatatagaaacggaataacggcgctgtgggctggggaaggccgagctgccttcaggtttctgggctccagctgcggggcactcacacctgccgctgtgaaaatgcagacccgcggggcaggaattccgagtccgggctggagcgcgatctggaatctgactcgcttgaaacagcaccgcggtggattcggagccgggtgagtagggaaaggcgcctcagcccctcccgcaggccgcccactgattccaggatccgaaaacgcttccagctgctccgtcaccccaggaaggcagcgcccgcctctgggcggttctggtggaaacggtccgccgcccgcaggaaaactcacaactaagggaccaggaaaaagcctctcagggtcccgcgccttcagtgaggatcctaatttacaccccgat

SEQ ID NO: 15734 - DNA, 100 bp, Homo sapiens
atctaggggctgctgggaagatggcggactcggtggctagccgatgaggaggccgcggggggaacccggcccccgggccccgagaccgactgagggagca

SEQ ID NO: 15735 - DNA, 149 bp, Homo sapiens
  misc_feature 95: r=a or g
  misc_feature 148: d=a or g or t
aaaaaaaaaaaaatttaaaacatgctccttatagggtatatcagtagaaagcagaaagacgaacattcctaagaagcccctaacacacacgtttrcagtcagttaatgatcaccctcctcctagactacaaaaaagaaattattatadt

SEQ ID NO: 15736 - DNA, 82 bp, Homo sapiens
ctctccgccagaccgccgccgcgccgccatcatggacaccagccgtgtgcagctacgaacgggaccggaggaagcagcgggc

SEQ ID NO: 15737 - DNA, 129 bp, Homo sapiens
aagaaattgtggtatatttataccatcgaatattattcagccataaaaaggactaaaatcctgtaatttgcagcaacatggataaacattgagggcattatgctaagtgaaataagtcagacagggaac

SEQ ID NO: 15738 - DNA, 494 bp, Homo sapiens
  misc_feature 25: r=a or g
  misc_feature 26: s=g or c
ctttggatgtttgcactctgggaarsaaaattaaaagtccagttcagtatagtttgaggttacattagtggacctggacactgattgatccgagcttcctatgggaaaagtagttgggagagccagaatcacgaagggactgggccatatgggagggactgaaggagacaggagatagggctcacctaccagaaggagccttggaggagagcggacttgttctccatggccagaaaggggaaagaagttgtagattttgtcataacttgaggtggagcgtttacagccatgcaggggtggacccgggccctgagaaggccacgaatttcctgtccctggtggtattaagaaatgggattagattaatatctggggttcctttcaatcctgatttggacagtactgttagatccagtgagaatctgagatacccgatgttagcctctgttcttgggtatctaggcctgcccaaggtatcctgggaacttcagata

SEQ ID NO: 15739 - DNA, 390 bp, Homo sapiens
atatattttttgagatggaattttgttctagttgcccaggctggagtgcaatggtgcgatctcaactcactgcaaccttcgcctcccggattcaagcaattttcctgcctcagcctcctgagtagctgggattacaggcacctgccaccatgcccagctaattttttgtatttttagtagagacggggtttcatcatgttggccaggctggtctcaaactcctgatctcagatgatctgtccgccttggcctcccaaagtgctgggattacaggcctgagccaccgcacccggccaaaattcaccattttgaagtgtacaattcagcggtttttagtacaattttcaaggttgtacaatcgccaccactaattccagaacatttttatca

SEQ ID NO: 15740 - DNA, 300 bp, Homo sapiens
taaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctcccaa

SEQ ID NO: 15741 - DNA, 410 bp, Homo sapiens
  misc_feature 154: s=g or c
  misc_feature 367: m=a or c
  misc_feature 394: s=g or c
  misc_feature 395: r=a or g
atatattttttgagatggaattttgttctagttgcccaggctggagtgcaatggtgcgatctcaactcactgcaaccttcgcctcccggattcaagcaattttcctgcctcagcctcctgagtagctgggattacaggcacctgccaccatgcscagctaattttttgtatttttagtagagacggggtttcatcatgttggccaggctggtctcaaactcctgatctcagatgatctgtccgccttggcctcccaaagtgctgggattacaggcctgagccaccgcacccggccaaaattcaccattttgaagtgtacaattcagcggtttttagtacaattttcaaggttgtacaatcgccaccmctaattccagaacatttttatcacccsragaagaaccaccgcg

SEQ ID NO: 15742 - DNA, 92 bp, Homo sapiens
ggtagatgtttgctacaatctcattttagtaaactagacaggtatttctgagaggtgcctatttagcttttgtctatacactttccccccat

SEQ ID NO: 15743 - DNA, 292 bp, Homo sapiens
  misc_feature 67: k=g or t
  misc_feature 69: r=a or g
  misc_feature 73: k=g or t
  misc_feature 74: k=g or t
  misc_feature 86: k=g or t
  misc_feature 132: k=g or t
  misc_feature 143: k=g or t
  misc_feature 159: r=a or g
  misc_feature 170: k=g or t
  misc_feature 180: w=a or t
  misc_feature 252: k=g or t
  misc_feature 255: k=g or t
agcacacatagaacattagccaagctagattatatctgggccataagataagtctcaatatatttckaragakkaaaatcattgcktaaggccagaaattcaagaccaacctgggcaacatattagatagakagaccccatckccataaaaagtaaaaracttagctgakcatggtagcwcgtgcctatagtcccagctacttgggagactgaagtgggaagattgagcctaaggagttggacgctgcagtkagkatgattgtgccactgcactccagcctggttaaagagt

SEQ ID NO: 15744 - DNA, 197 bp, Homo sapiens
ctgtttttatgcgaacttattaaggtcaaggatgcttactcagtaagagagactgtatctttaaaactatgaacttggccttgcatggtgcctcacacctataatgccagcattttggaaggatgaggcaggaggacgcttaagcccagatgttcaagaccaacttggttaacatagcaagattccatctccaaaca

SEQ ID NO: 15745 - DNA, 314 bp, Homo sapiens
  misc_feature 307: k=g or t
gtatgaaggaactgagaccacctaggagaaaaacatgtttatattcctcatcgaacacttattccagggcaggtatgttccttgagtatgcagtattgccctatagtgggtaaagtatttcttttctctccttatccaagtaaatggaatgaagatactcacttctactgcatcacccagatacttgtacacatagctattccacaaggcaaaagaaaataggtagcacaagtagcatgcagtgtgattactcagtaatagagttcattttcttcaaaatattccccctgtttaaaagctatttaakcacacac

SEQ ID NO: 15746 - DNA, 318 bp, Homo sapiens
aaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagttta

SEQ ID NO: 15747 - DNA, 229 bp, Homo sapiens
  misc_feature 222: y=c or t
acagatgatgttgccaaagtggcaatcaaattgctttgtcattttttactttttatgtatgtttgtatgtatgtatatatttgagagagagtcttgttctgtcgctcaggctggagtgcagtggcgtgatgtcggctcattgcagtctctgcttcccaggttcaagtgatcttcctgcctcagcctcaggagtaactgggactacaggcatgcaccaaacayccggcac

SEQ ID NO: 15748 - DNA, 96 bp, Homo sapiens
ataagggccttttcttaacctcatcttccccgcttggccctaccagttaaattccttcccctttccacctaatgggaaaactcattccccagatac

SEQ ID NO: 15749 - DNA, 71 bp, Homo sapiens
  misc_feature 35: r=a or g
  misc_feature 45: s=g or c
aaaaaaaggccggcggcgggtggacgcggcgcgcraggacccgasccaggcggggacaggacggcggtggc

SEQ ID NO: 15750 - DNA, 353 bp, Homo sapiens
gaagaaagacttctcgacgccgagacactgctggtggtactcgatgtaggtgagcaggtggcagctgttggagccgggcgcgatgttgttggcgtacttgatggccgtgctcgcgaccatgtcgtgcacagtgaggagtgtcttgttgctaacttagtccttgctgagccgcagtcgcgcctccccgtcgcgctccgtggtccgagtagctcagcctgcggacaggcgggtcagcggcggccggagacccccagatggacctagagagaggcgagcaggtggcgtgtcaggggcaaaaccagggagagatgggagcacaggcaggagcgtggcactgagagatggcagacgga

SEQ ID NO: 15751 - DNA, 342 bp, Homo sapiens
  misc_feature 14: w=a or t
  misc_feature 15: w=a or t
  misc_feature 235: y=c or t
  misc_feature 236: y=c or t
  misc_feature 237: y=c or t
  misc_feature 242: y=c or t
  misc_feature 322: y=c or t
tgttttcagctccwwtgggttaataccaaaaacagtgattgtgggatcacgtgctaagagtaggtttagtttttgtaggaaatcaccaaactgtcttacaaagtggctgtttcatttttcatttccaccagcaataaatgagagttcctcttgcattaaagcctcgccaacatttgatgttgtctatgttctggattttggccattctgataggtgtgtagtagaatctcgtttyyyttttycatttctctgatgacatatgatgtagaacatcttttcataacgcttatttgccatctatatatcttgttcggtgaggtgyctgttaaggtctttgcccca

SEQ ID NO: 15752 - DNA, 298 bp, Homo sapiens
atcaggatgatgctggcctcataaaatgagttagggaagattccctctttttctattgattggaatagtttcagaaggaatggtaccaactcctccttgtacctctggtagaatttggctgtgaatccatctggtcctggactctttttgcgtggtaaactattgattattgccacaatttcagagcctgttactggtgtattcagagattcaacttcttcctggttcagtcttgggagggtgtatgtgtccaggaatttatccatttcttctagattttctagtttatttgtgtaga

SEQ ID NO: 15753 - DNA, 208 bp, Homo sapiens
catgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccacca

SEQ ID NO: 15754 - DNA, 191 bp, Homo sapiens
  misc_feature 24: s=g or c
ccagcccttgtgtgtgtgcgttastcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcaa

SEQ ID NO: 15755 - DNA, 187 bp, Homo sapiens
tattttcaatatggaaataataattctcttgttgagtttttgtaaggaatcacgaggtagtatttgtaaagctcctagaacagtgttcagcatgctataagagcccagtgttagcagttgttaccaatattacatgctggtggcctcacaccacacttgtggtgtgagtatcaatcatcttacccga

SEQ ID NO: 15756 - DNA, 237 bp, Homo sapiens
tggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggagca

SEQ ID NO: 15757 - DNA, 135 bp, Homo sapiens
gtcccagttgctagggaggctgaggcagaattgcttgacccagggaggcagactttgcagtgagccaagattgtgtcattgcactccagcctgggcgagaagagcaaaactccgcctcaaaaaaaaaaaaaaaaa

SEQ ID NO: 15758 - DNA, 364 bp, Homo sapiens
ttaaataccacttgtttgccctacttatctttgtccctcctgagggtgcggagtgagccttattcattccagcattcctacaatcttgtacatccatacaattcttgatatgtagttgacatacactactgtaaggtacatgaatgagtaagtagataaaggaatgaacaaatggaccagtggtttgttggggccactctggccagtggtttggggacatgcttcctggagtcttatcccctcttgtcagattcaggtttaggacaacggtacagttgttccattgttcccagataacatatcctatcttaacgtctttgctggggcagcccttggacacaccctgagctcctgccctatcact

SEQ ID NO: 15759 - DNA, 299 bp, Homo sapiens
  misc_feature 230: m=a or c
  misc_feature 262: w=a or t
atgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcmaagtatggatgactcggtatctgctttgttawtcctcagaaatactgcactgagtatatgccctcatta

SEQ ID NO: 15760 - DNA, 179 bp, Homo sapiens
taatatgaaaaactcaagttcaagactaaattattctctatgtcttagaagaagagatataaatagcttctattttgaagatggataacctgagttaactgaatttaagtaactagatcaaagtaaaatttagttaactttgagcagctagatttgaactcttatcaacacagcatccc

SEQ ID NO: 15761 - DNA, 180 bp, Homo sapiens
caaatgcgagggccacattctaggtttttgagtaagaatcttcaggtgtgagctttggatacctatacatattcttttacatgattcctgagtatatcctagttaaaataagtaagaagaagaggaggaataaagaagtaatattaggcaacattgtgggagaacttatatgccaggtct

SEQ ID NO: 15762 - DNA, 269 bp, Homo sapiens
ctcctgatgtcgtgatccgcccacctcagcctcccaaagtgctgggattacaggcgtgagccaccgcgctggccggtggatagtactttgaacatcattagcattttctccaacagtatgatagatgttgtagaactaaatggcagtttatttaatgcttaaagaactatagtgcatttcagaatatgtagggattatgtgttcacagctaacataatatttattgtttctgagaaagtgaagattaagtcaaaggaggccgggctcct

SEQ ID NO: 15763 - DNA, 308 bp, Homo sapiens
ctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagcctgt

SEQ ID NO: 15764 - DNA, 120 bp, Homo sapiens
aaatgtagtttcaaaaacatactgtgtttgaatttaggatttttttggggaaagtatgatcttttggattgagctgtttgtcaagagtgaaaggttttaatctcattagtatcagctaac

SEQ ID NO: 15765 - DNA, 157 bp, Homo sapiens
  misc_feature 45: v=a or c or g
  misc_feature 47: n=a, g, c or t
  misc_feature 51: w=a or t
taataataatgctaatacctgatacttgctttgtgtaacttttcvtntttwagtcctcattgaatcctgttattgcaattttaaatttgaggaccttgaagcatagaagtgttaatttgttcacagttttgcgtctgggaaagatttgaaacaggca

SEQ ID NO: 15766 - DNA, 375 bp, Homo sapiens
  misc_feature 13: w=a or t
  misc_feature 17: r=a or g
  misc_feature 346: m=a or c
agtttctcttcgwtttrtttttcttttatttttcttgctcctctttctacacactgaagttgctgttgttttacatttaccttttatttatttgtagtttttgaggcaggttggagtgtaagaatgcaatctcggcttacagccgcctcgactttccaggactccctcaggtgatcttcctatctcagccttccaagtggctgagactacaggaatcacttaattctgtgatgtcgaagctgaagtgagccgtgatgatgccttgccctccagtctgagtgtttcagaaggtggagtttcgctcttattgcccaggctggagttcagtggcgtgacctcagctcamcgcaacctctgtcgcctgtgttcaagaga

SEQ ID NO: 15767 - DNA, 157 bp, Homo sapiens
acagcaggggccgaaattgaggaggccttaaatgctttgagcttttgccttcagtctaaagctgtagaatagggggttaagagcttaggctgaccatagggaagtttacaagctagagcgaatatctggactgctaatatctgacaacagtaggctc

SEQ ID NO: 15768 - DNA, 124 bp, Homo sapiens
  misc_feature 78: k=g or t
tctaaaaatatttaggggacagcctttaaatggattcagaagttctgctatgagcagtgtagttcctttttatgtgtkctgtatgtatgagtgcatattttcagattgtgatcatattgtgtat

SEQ ID NO: 15769 - DNA, 138 bp, Homo sapiens
ttgtatttttaatagagttggggtttctccatgttggtcaggctgtcttgaactcccgacctcaggtgatccgcctgcctcggcttcccaaagtgctgggattacaggcatgagccatcatgcctggcctacctggag

SEQ ID NO: 15770 - DNA, 339 bp, Homo sapiens
  misc_feature 163: y=c or t
  misc_feature 270: r=a or g
gaggaaaggaaggaaggcttttgtaggcgaaatagagaacaaaagagggagatatatgaattgaagctggaaagatggggaggggcctatgtatgctggcctggaggaatttcagtctctttagtgaaggccctgaaggatttaaacagaagaggcgactgtygtgtggcaaatggaatagagtgaaagtcaggttctgcattacaaggcaatctcagaagtccagattagagataataacaccttggattgtgtatggttttggcagtrgagataaggagaatgaataattcaagatctgttttggagggaaaacagacactgctttggttctttgga

SEQ ID NO: 15771 - DNA, 307 bp, Homo sapiens
  misc_feature 10: r=a or g
  misc_feature 297: n=a, g, c or t
ttagtctgtrggctcttgctgggctgtctgcataggaatcacctgagagcttattaaaaataggttttcaggctggttgcggtgcctcacgcctgtaatcccagcactttgggaggctgaggcaggcggattacttgaggtcaggcgttcaagaccagcctggccaacatggtgaaaccccgtctctgctaaagatacaagaattagccaggcatgatggcacacacctgtaatcccagctactcaggaggctgaggaaggagaattgctcgagcccgggaggtggaggttgcagtnagcggaggca

SEQ ID NO: 15772 - DNA, 192 bp, Homo sapiens
ctgctggacaatgttccctctagggttgtttcccggcttaggaggcggtggttgcggctgctgctcctacggatattgcgcaagactggggcgttggaaaccctgtaggtctggggaatgaaaaaggaagtgggactttgggaagtggttgctccttagtcttggcgggggttgggaatgggaaataagctg

SEQ ID NO: 15773 - DNA, 284 bp, Homo sapiens
tataatccagtctctcttctcacttctgttaagatggctgatatagtccatgaatcccactcatgatctctttatcaaatgattgttcagccacactttgaggattctcttcagtacaagttttctaatttttgcagtatggataggctgagaattttccaaatccccaagttctggttcctttttccttaacaatttcttctgcaattcaggtctccttttgcatttttgccgagaccagctgggtcgtggagaccctaacccagtggctctagaggaatata

SEQ ID NO: 15774 - DNA, 190 bp, Homo sapiens
atccacgtgcctcggcctcccaaagtgctgggattataagcatgaaccaccatgccgggccttatgacagtatttgttctttctcttcttaattccacaagtaatattatactggaaaaagtaattagattatataaaaatacttaaagtataaagtgaaaattattgtctcattctctacccacattgc

SEQ ID NO: 15775 - DNA, 230 bp, Homo sapiens
  misc_feature 42: r=a or g
  misc_feature 150: n=a, g, c or t
aaaaataaaaataaattcgttaggcatggtggcacgtgcctrtagtcctagttacttgggagtctgaggtgggaggatcgcttgagcttgggagttctaggctgcagtgaactatgatcatgccactgcactgcagcctgtataacagantgaggccctgtctataaaagaaacataaataggacagttgcagtggcttacacctgtaatctcaacactttgggaggtat

SEQ ID NO: 15776 - DNA, 151 bp, Homo sapiens
  misc_feature 125: r=a or g
agtcacgaggccgagcgggagccgctacgtacaccgcgcatgcccacgacgcagtcaggttccggcgaaagtgaccggaagtaaccgccgggccaagatggctgcagaggaaggggtcgcgagtrctgcttccgccggcggtagctggggt

SEQ ID NO: 15777 - DNA, 222 bp, Homo sapiens
  misc_feature 12: k=g or t
ttctatcaatgkcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaact

SEQ ID NO: 15778 - DNA, 329 bp, Homo sapiens
gcctctttgggttgaattttattggagacttctgcacttcctgtacctggatgttgtcatctttcctcaggttagagaaattttcaactattattttttaaaatatgctttctggctccctttctctttcttctccttcttgaatttctgttgtgtgaaggttaggtctcttgatggtgccttatccataagtcctgtaggctttcttcattcttttgcattcttttttttctcttctgaatggataatttcaaatgttctgtctttgagctcactcattctttcttccatttagtcaagcctgctgttgaagtgttctatttcatttt

SEQ ID NO: 15779 - DNA, 442 bp, Homo sapiens
  misc_feature 23: s=g or c
  misc_feature 24: k=g or t
  misc_feature 25: v=a or c or g
  misc_feature 26: h=a or c or t
aggagcagtttaggaagtgtaaskvhgaggcccttcttgtgtatctggagaaaatagaggtcagtgtgtggttttgtccctgaaagttttttgtcctagttcaggttttgtctcagtggaaggtttgggagatttgaggacgtggtgtaccctggaccacatagtttttggcaggaagactggggagcgccggggtataggcatttgggaggtacctggtgggagtctgtgatccccctgtctgtggtccgcgtgcctttggtgtgagtacagtgactaaggcacgcggacctcagacaggtgataacatcccatgcaggagctctagctctcaggtcctcccctccctgtttcattctcatctcacatgcccctcttccccacctaggtttcctccagcctggtggtgccctgtccttgcaaaagcagatggaacatgcta

SEQ ID NO: 15780 - DNA, 234 bp, Homo sapiens
  misc_feature 169: k=g or t
tccagaattataaaagtgtttttccatggcatttttatagtagagttttttaaaaaatacttttacatttaaatcttttgatccatctagaatttgttttggtaaggtattggtctgacttttttccccctgagatggttatatagttgtccaacatcatttatttaakaatacaataactgtttttgatatggcacttttatcagatgctaaatttctatatatattggggtc

SEQ ID NO: 15781 - DNA, 133 bp, Homo sapiens
  misc_feature 13: w=a or t
  misc_feature 23: s=g or c
  misc_feature 30: y=c or t
  misc_feature 31: s=g or c
  misc_feature 66: s=g or c
  misc_feature 83: s=g or c
  misc_feature 84: m=a or c
  misc_feature 97: s=g or c
  misc_feature 105: s=g or c
aaaaattggattwtgttggccgsgtgcagysgctcaggcctgtaatcccagcactttgggaggccsagcgcgggcagagcacsmggtcaggagatcsagaccagsctggctaacacgatgaaaccctgtctct

SEQ ID NO: 15782 - DNA, 195 bp, Homo sapiens
  misc_feature 13: y=c or t
  misc_feature 88: m=a or c
  misc_feature 89: m=a or c
  misc_feature 103: r=a or g
  misc_feature 104: r=a or g
  misc_feature 134: s=g or c
  misc_feature 135: r=a or g
aataaaaatatgyaaatgagtggttaatctttagttattttaagatgattttagggttttctagtttatgctttttttctgtttttcmmgtaacctgcagagrrttttgggaaacaggattttctacgtaggtsrcattttcacactgaatttagctttattaatacatgattgatactgataccaagccatgga

SEQ ID NO: 15783 - DNA, 369 bp, Homo sapiens
  misc_feature 14: w=a or t
  misc_feature 20: y=c or t
  misc_feature 21: y=c or t
  misc_feature 112: s=g or c
  misc_feature 113: m=a or c
  misc_feature 114: r=a or g
  misc_feature 115: w=a or t
  misc_feature 287: w=a or t
  misc_feature 338: y=c or t
caccacacctcgcwgttttyyttatttttaattgacacggggtttcaccatgttggccaggctggtcttgagctcctgacctcaaaatgatctgcccacctcagcctcccasmrwgctgggattacagacatgagccactgtgcccagtctataccctgtcttaaagaagaacaaaaaatggtttagggaaattggtaaaaggccaaacaactaattggtggggaacaagattctaatcaaaagctatcaaatcccagggtctaaactcatcactgcataccactcwacaaatatttattgaagtgaaaattatgtttacataattacaaattatgtytacatagcctctccagttagatactctcacc

SEQ ID NO: 15784 - DNA, 121 bp, Homo sapiens
  misc_feature 13: m=a or c
  misc_feature 83: d=a or g or t
  misc_feature 87: m=a or c
  misc_feature 88: m=a or c
aaacagacctgamaatgatgttccagaacctcccatgcctattgcagaccaagtcagcaatgatgaccgcccgaagaggttgdttgmmgatgaggagaagaaagaggtaaacatccaagcc

SEQ ID NO: 15785 - DNA, 265 bp, Homo sapiens
  misc_feature 25: s=g or c
  misc_feature 26: s=g or c
  misc_feature 139: s=g or c
  misc_feature 152: r=a or g
aaatcttgctgctgctcactctttssgtccacactgcctttatgagctgtaacactcactgggaatgtctgcagcttcactcctgaagccagcgagaccacgaacccaccaggaggaacaaacaactccagacgcgcascttaagagctgtracactcaccgcgaaggtctgcagcttcactcctgagccagccagaccacgaacccaccagaaggaagaaactccaaacacatccgaacatcagaaggagcaaactcgtgacac

SEQ ID NO: 15786 - DNA, 276 bp, Homo sapiens
  misc_feature 103: s=g or c
  misc_feature 104: m=a or c
ctgaaataaaaaacaaaaagctattccaatttcatttgagtttccattcagcagcctcatagattcctaactcatcacctcaagcaggtcacttcccctctcsmaagttgttcgccagaaccagccaaagaatgcaggaaatggtactctctttttctgagtgaatcttggcaaaatgacttcaatttagccagcagtgcaggaagcgattgtaaatataaatttgttttatatgctcctcccaaaggagacttgcagtttgcctccctagtaaac

SEQ ID NO: 15787 - DNA, 244 bp, Homo sapiens
  misc_feature 12: y=c or t
tttttaaacagytttatcacctatatagatatccttaactagcattgtttactcttacctgtttttgaactttatttaaataaagtcattctgtattctatgagttacttttgttaaacattgtttctgagattcactcatgttaaagcacgtgcctatagtttagcaatttagaaactttattcccaggacccctctacactttttaagaaccattgagggggccaggtacggtggcccacgg

SEQ ID NO: 15788 - DNA, 93 bp, Homo sapiens
  misc_feature 13: w=a or t
gctttttatacawaaaagtgtcattcattaagcagatgaatgaggctgaagcttgggagagattagggtttgatttagaaatctggagtcgac

SEQ ID NO: 15789 - DNA, 129 bp, Homo sapiens
  misc_feature 12: s=g or c
  misc_feature 45: s=g or c
  misc_feature 47: s=g or c
  misc_feature 111: s=g or c
  misc_feature 115: s=g or c
gtttctaacccsccccatcctctcccctgtcccctactctattcsasgccctggctctgggcctaacaaggaactctatcccaccccttttgggccagctgtcgttccgcscctstcagcgccccgccg

SEQ ID NO: 15790 - DNA, 202 bp, Homo sapiens
  misc_feature 14: w=a or t
  misc_feature 87: s=g or c
  misc_feature 88: y=c or t
  misc_feature 94: n=a, g, c or t
  misc_feature 95: h=a or c or t
  misc_feature 100: y=c or t
  misc_feature 101: y=c or t
tgtagaaatacagwtgatgtttaatagtgatcttgtatcctatacccttgcaaactccacttcttagttccagttactttattgtasytttttnhttgtyytttactgtgtgtgatgtttgtgaatagaacctgttttaattcttcctttccaatctggatgccttttctttttcttacattattccactgcttaggacgtc

SEQ ID NO: 15791 - DNA, 209 bp, Homo sapiens
  misc_feature 12: h=a or c or t
  misc_feature 13: m=a or c
tatatgtgttthmaaaacatgcccacagggaacgagcagtcttcatgttccattgactccagagacgttcccattaaatgcatcaccaaccctagagtttaggtcctgcacattgttagctctgctgtgcgaaaacatgaattaaagcttaaaagatcatagaagtgaaaccatgtactagaaactaccacaggtgcgttggcagggtt

SEQ ID NO: 15792 - DNA, 399 bp, Homo sapiens
  misc_feature 28: s=g or c
cgcctgtaatctcagcactttgaggagsgccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcc

SEQ ID NO: 15793 - DNA, 214 bp, Homo sapiens
  misc_feature 86: s=g or c
  misc_feature 105: s=g or c
  misc_feature 106: y=c or t
  misc_feature 133: y=c or t
  misc_feature 134: s=g or c
  misc_feature 140: s=g or c
  misc_feature 141: m=a or c
  misc_feature 166: n=a, g, c or t
ttaaaaattagcactggtggcacacacctgtggtccctgctacttgggggcctgaggcgggaggatcgtttgagcttgggaggttsaggctgcggtgagctatasycacaccactgcactccagcctgggctysagagcsmgaccccttctctaaaaaagagagtnaagaaaagatcaaaacagaagatggaacaagaaagtgaaggctaccaa

SEQ ID NO: 15794 - DNA, 345 bp, Homo sapiens
acatttttttagtattatctactaaggtgtatacacaccctgagacatttgaaaaatgtgcagaatctgccacagttcatggtcgtacaggacagttctgtactttgcaaaattgctaatgtcccatgccatttgtgctcaccaaacattgtggcagctataacatgttcccaacatgtttacacaagttcctccaggagatgatactccctattgagaatcgctagatttgacagagagaaatggcataggcatttcagccaggctgaaaaagataggcaaagactgaatttgctctactcagagttataaagcgagtgtggtttagctgttgtccgaagcacg

SEQ ID NO: 15795 - DNA, 400 bp, Homo sapiens
  misc_feature 12: k=g or t
  misc_feature 45: k=g or t
  misc_feature 108: k=g or t
  misc_feature 126: y=c or t
  misc_feature 132: k=g or t
  misc_feature 133: r=a or g
  misc_feature 152: k=g or t
  misc_feature 184: k=g or t
  misc_feature 255: w=a or t
  misc_feature 256: k=g or t
  misc_feature 290: k=g or t
  misc_feature 333: w=a or t
  misc_feature 334: w=a or t
  misc_feature 366: k=g or t
  misc_feature 372: k=g or t
cataatttccckactatactattaaatattaacttaattgcttgkatctaattatattgtttgtacacattaaccaccttctctttatccctccccatcctttcattkccagtctctggtaaccaycattckrctctcttcctccatgagakccaccttttccgctcctacatatgagtgagaktatgcaatattttatttctgtacctggcttatttaatttaacctaatgacctccagtcccacccggcggawkcacactaaacagcaaatccaatgccagacggcakctttctgcattcagaaacctttttagatccagtgtttcataawwacaggcaatgggaagaatgttggtttaatttktaatakctttgatgtaccgcatgagatcaaacaa

SEQ ID NO: 15796 - DNA, 262 bp, Homo sapiens
  misc_feature 60: b=c or g or t
  misc_feature 89: b=c or g or t
  misc_feature 90: y=c or t
  misc_feature 128: r=a or g
agaacttatggtctaggtaaacaaacttgaaatttttctgtttggataactttgccagtbacacagaaaatatacatttttacctttcbyccctgccctcaattctagtgttttctgaattgaaagcrgtaagtttcctctggatggtcatgaaaactaggatatagtccactatcatctactgtgtggtagaaatatgccctctctatatagattttgtggtgtgacttttttatggagagactccaagcttcaaccacgt

SEQ ID NO: 15797 - DNA, 125 bp, Homo sapiens
  misc_feature 43: w=a or t
ttgtgatgtgggaaatataaattgtgccaagttctttggagtwtatgcaaataatacatggcacacattgttatgttgctcttcattccctgtgaaggccttttgtcatcaactttatatccatt

SEQ ID NO: 15798 - DNA, 275 bp, Homo sapiens
cagtaaagatatgtaacttgctttagttatgcctgactgaggaaaattcagagatgagtgttttgggccagatcttcagaaggcagcctcccatttaacaggcacttatttatcatgctaacactatgtggtttgccataccaacattgaggatcatcttgctcaagctcccacagtacctagcccaatgctgggcacatgcattcatggacgtgcactgactgatgaacctatcaatagcatcagaaagccaacaacccaatgtgatcctacat

SEQ ID NO: 15799 - DNA, 141 bp, Homo sapiens
ctggctaatttttgtatttttagtagagaccgggtttcgccacgttggccagcctggtcttgaactcctgacctcaaatgatccacctgcctcggcctcccaaagtgctgggattgtaggcatgagccaccgcacccgact

SEQ ID NO: 15800 - DNA, 322 bp, Homo sapiens
tgtgtgttaaagagctgatactgattttcatatgacaatgttaggcaaaggcctccctgcatttgaagagcaggttttcatttatatgtatttttgggataaaaaaataaaatttgtaaatatagccccatttcaaagagtaatgctttcctagcgtagaggaccttgtgttcataggtctgtttgctgctaatggagccttctgtcagtacttttgagataaaagtaggtagctgttttagagtgttgtggggcaggttatatcgttggcctccaagtcagtggaatagcagatggtgacatggaggtgggttgtggggga

SEQ ID NO: 15801 - DNA, 194 bp, Homo sapiens
  misc_feature 53: s=g or c
  misc_feature 55: v=a or c or g
gagcaattcctgtccctcttaagggcttacaactctaagggggtccgcgtgasavggtcttgatggattgaggaagcagagggtacgtgactgggggctgcatgcacagacaacgagagcgaaaccacagagaaaagaaacatcccgtgcatcacggcctgatgatggattcctgtttcctgcaaaatggggat

SEQ ID NO: 15802 - DNA, 275 bp, Homo sapiens
  misc_feature 205: s=g or c
tacaaaaattagccaggcttgactgggcgcggtggctcacgcctgtaatcctagcactttgggaggccggggtgggtgaatcaccagagtttgggagttcaagaccagcctgaccaacatggagaaacctcatctctactaaaaatacaaaattagccaggcttgatggtacatgcctgtaatcccagctagttgggaggctgasgcaggagaatcacttgaacctgggaggtggaggttgtggtgagccgagatcatgccattgcacttcagcc

SEQ ID NO: 15803 - DNA, 365 bp, Homo sapiens
  misc_feature 29: s=g or c
  misc_feature 30: s=g or c
  misc_feature 45: r=a or g
  misc_feature 182: k=g or t
  misc_feature 340: m=a or c
ataccgcccagcactggccggcaggaggsscggctcaggccacarggaactcaggggtctgctgtggcccaggagtggccacagtaacagctcaggaggacagagggtccaggtggagttctacgtcaacgagaacaccttcaaggagcggctcaagctgttcttcatcaaaaaccaaagakcgagcctgaggatccggctgttcaacttctccctgaagctgctcacgtgcctgctctacattgtgcgcgtcctgctcgatgacccggccctgggcatcggatgctggggctgcccaaagcagaactactccttcaatgactcgtcctccgagatcaamtgggctcctattctgtgggtggaga

SEQ ID NO: 15804 - DNA, 407 bp, Homo sapiens
  misc_feature 3: r=a or g
taracatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaccagtcatgccttccca

SEQ ID NO: 15805 - DNA, 113 bp, Homo sapiens
gtctggatttccaggaaagcggagacctcgaggtgcaggactgtcggggcgaggtggccgaggcaggtcaaagctgaaaagtggaatcggagctgttgtattacctggggaaa

SEQ ID NO: 15806 - DNA, 65 bp, Homo sapiens
agtctgtgcggctacagcggggtggagacggccggctctgtcacggcttcatgagagcgggaaat

SEQ ID NO: 15807 - DNA, 162 bp, Homo sapiens
  misc_feature 49: v=a or c or g
  misc_feature 50: b=c or g or t
  misc_feature 51: n=a, g, c or t
  misc_feature 52: k=g or t
acaggcgctgcgtgccctggctctgctcgccactggccggcgcgctccvbnkcgcacggagcacactcgcgctccgggactgaaacctgagcagccgtagcagccaaatttgggagcatatccttgtcactgcagccagaaagcccttcgatccccatctga

SEQ ID NO: 15808 - DNA, 143 bp, Homo sapiens
acagagtacttggacttccattttcttctggatatttgggttcttaacatgtattttctaatcagaaaaatcagaataaaaggagagaatggtactggggcatatgttgcagagagatcaagttaagataaggactgtcaagt

SEQ ID NO: 15809 - DNA, 81 bp, Homo sapiens
cccccgaccccaccacagtccccagagtgtgatattccccttcctgtggccatgtgatctcattgttcaattcccagccaa

SEQ ID NO: 15810 - DNA, 182 bp, Homo sapiens
  misc_feature 106: s=g or c
  misc_feature 107: s=g or c
  misc_feature 125: k=g or t
  misc_feature 175: k=g or t
gagtgctcagtggagagcggggagtgtgtgtccaccttgccgacgtcgctagccgtggggctgtcctgggaaggcggacggcgagcgcccggtgtccgcactcggssgcctgccgtgcccgtctkcgcccgtggtcatcctcactcgggacgcagggaccgtttttaaatcacakgggactt

SEQ ID NO: 15811 - DNA, 90 bp, Homo sapiens
atctacctaaagttctatgaacctcaagatagagatgatctctatttttacattgccacatacctaggtttggcgctcacccttcattgt

SEQ ID NO: 15812 - DNA, 217 bp, Homo sapiens
  misc_feature 12: s=g or c
  misc_feature 13: v=a or c or g
  misc_feature 23: r=a or g
  misc_feature 114: k=g or t
  misc_feature 115: r=a or g
  misc_feature 138: w=a or t
  misc_feature 139: r=a or g
  misc_feature 160: r=a or g
  misc_feature 161: s=g or c
  misc_feature 186: k=g or t
  misc_feature 188: v=a or c or g
cggggtgggggsvgggcaaggargggcaggcacacaccatgtctgacctgaacccgattctggggagcatcttcccgctccggccccacgacctccacagggttacattgtaakrtatatgccccagctaacctgtcwratggtggcatcttcctgcagrsatttcaaacatgtaacttttatatkavaaaaaataaacacagatgaaagctgccgt

SEQ ID NO: 15813 - DNA, 158 bp, Homo sapiens
  misc_feature 147: s=g or c
ctgtctcaaaaaaaaaaaaaaaaaatggtggatagaaagcacctctggcctctgggaggaagctgtcccacctagctgggagggacctcacctaggattcaggagacctgggctgcctaccacatgagccttagacaatctgctcasccagccacact

SEQ ID NO: 15814 - DNA, 314 bp, Homo sapiens
tttaggattttagactttagggattttgatctttggggatttcaatatttgggattatggtatttgagatggtctcttttaggattatgatccaaacccatctcaggaatgtgtgaaatttacagtagtccatccccatcccgggctgtagaaatgtaggacccacaagccttcgttacagagccacttactgccccatggagttcccaggtagatgacagtagcggggaggatacatggcacatgttatatggctcttgggtgtgccttctctcagcaggcactgcctttgaagattatcatttggggggtac

SEQ ID NO: 15815 - DNA, 99 bp, Homo sapiens
acttggtgactctaggtgactggtcgacagatgttcattgtactatcaatgtggctttgctgtgggtttgaaattttgcaaactaagagttgggtggca

SEQ ID NO: 15816 - DNA, 403 bp, Homo sapiens
  misc_feature 389: r=a or g
aattttgttccattttcctgcttccttctcctcttcctccttcttctaagatggcagagagaaactttcttacaggtcccagcaacactgccgtatagcttagaagactggagatatttattctcaatgtcctcagtttactttccaactggagcattatttgaaagacggtctgccagcattcaactgaacagacacaaatgcaggtatgaatagtgaggggagagagtggtttgaaggctggggttgctgtcaggtctgatgaaccctccagcactcgccatcatcggctacaatgttgaggagactccatcacaacctcagatcaagagtgtttctttgttcctccaagccttccaaagcactttatggaccttgtatttggacarcacctccatgaagc

SEQ ID NO: 15817 - DNA, 409 bp, Homo sapiens
  misc_feature 316: k=g or t
  misc_feature 330: y=c or t
  misc_feature 332: m=a or c
caagtcccaagactgcctgggcctactggcccccctagcatctgctgcagaggtcccctctacagctcccgtgtctgggaagaagcacagaccaccaggacccctgttctcctcctcagatccccttcctgccacctcttcccactcacgggactcagcccaggtcacctcgctgattcccgcgcccttcacagctgcaagcagcgatgccggcatgagaagaacaaggcctggcacctcggctcctgcagctgcagcagcagcccctcccccctccacattgaaccccacgtcggggtcactactcaatgcagtkgatggaggcccctyamatttcttggcctcagcacagctgcagcacgtgtccagaggtcagaagtgagatataaccagagatcccagacccccc

SEQ ID NO: 15818 - DNA, 144 bp, Homo sapiens
cacatcaaccagtctaaggttgctcccaccagactaggaggactggagagtagggttggggtcaaagggtagcctcctgcaggtcgcctcctcctgtggctttcccggacgtcgcgctgggacttcctgccgacaccgcactca

SEQ ID NO: 15819 - DNA, 144 bp, Homo sapiens
  misc_feature 59: k=g or t
  misc_feature 61: k=g or t
  misc_feature 69: k=g or t
  misc_feature 72: k=g or t
  misc_feature 73: r=a or g
  misc_feature 74: k=g or t
  misc_feature 100: k=g or t
  misc_feature 101: k=g or t
acaaagtttgtgcctgcggtgcacctcggtcgggctcgccgggctcgagggctggcggkckccggggckackrkgcccgggggggagagagccggcagckkgcggcggtgggtggcggtggcgatgcgccgcgcccggccgcgc

SEQ ID NO: 15820 - DNA, 180 bp, Homo sapiens
atgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagcgccac

SEQ ID NO: 15821 - DNA, 396 bp, Homo sapiens
  misc_feature 364: r=a or g
  misc_feature 366: r=a or g
  misc_feature 386: w=a or t
tataaaaatagcaacagtatctttgctaatcttactaatggatattgattaaaaaaaaaaaacctcagtactgcatcactgtgttgggatcgtaccaggacaatagggtcattccatatgataaaactaaaggactaaatttgttttataatgatgtcttagagggactgaaaagtttaaggaggcgatcaaactaaaatgtcttaatggctgtgtgacacacgtaaggaaaggaaagggggtcacgcacatcatgtactggaatgatctgcattaaacattgacttgtcttcagaaataagactgaagggttttgttgttccttagagttttcgtgttacatcacctaaagagatttcttttraraactttctagactctttgcwaaatgtatat

SEQ ID NO: 15822 - DNA, 256 bp, Homo sapiens
cccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcaggctggaaaaacacagtgtcccagcccaagcaggcaggcagcaggagttctcttgtactgtgcctttttgttctatatgggcctctt

SEQ ID NO: 15823 - DNA, 122 bp, Homo sapiens
gttttttgagacaggatctcactctgttgccagggctgtagtgcagtggtgtgatcatagctcactgcaacctccacctcccaggctcaagcctcccgaatagctgggactacaggcacact

SEQ ID NO: 15824 - DNA, 246 bp, Homo sapiens
  misc_feature 209: d=a or g or t
gagcaaaggggaagttgctgcgctctgctcggtgtcgtggcctcgcagatgattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgtdattgtgagatgtaagctggatgacagggtggcgacag

SEQ ID NO: 15825 - DNA, 75 bp, Homo sapiens
  misc_feature 29: s=g or c
  misc_feature 67: y=c or t
tcccaaagtgctgggattacaggcgtgascagggcaacagagtgagaatctgtttcttttttttttycttttttt

SEQ ID NO: 15826 - DNA, 360 bp, Homo sapiens
  misc_feature 331: k=g or t
aatgcaataatcagtatcagttattgaaatcaccccagattgttaagaaattttctactcttacaagcatctcatggtgaaacatgctgagagaaacatttgttctagctctgtttcttaatggttgctgtactagatgctgaggacataattttaaacaaaacatgatccttggctttatggcacctataatctggtagggaaaatatgtcagcagataaatttataatactgtataattatataccatttgagcagtttggtcaaagctctccgtgaactcagtcttgggaaaggttgacccataagtaatgaggtgcctatgtgagtkcactatttcacttgttttaattatgaata

SEQ ID NO: 15827 - DNA, 236 bp, Homo sapiens
ccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagcat

SEQ ID NO: 15828 - DNA, 278 bp, Homo sapiens
  misc_feature 213: k=g or t
  misc_feature 235: k=g or t
  misc_feature 246: k=g or t
ttttgataggaacagtgttgaatatgtaggccagtgtggacagtattgcattttataatattaagtcttccagttcacgaacatggaatctttttctatttatttaggtctttaattgttttcaaagatgttgtgtagttttcagtgtgtaatcatgcttcttttgtggaatttattcctaaaactttttgatgctattgtaggtggaattgktttcttgatttactttttgggktgtccactgckactgtatagaaatacagtagattttttttaaa

SEQ ID NO: 15829 - DNA, 84 bp, Homo sapiens
caaaggctatggtagaagtgagtaatgagagctgggctcgagccctggtctgagttcagtgtggatgtttaaaggcgaccatat

SEQ ID NO: 15830 - DNA, 384 bp, Homo sapiens
  misc_feature 114: y=c or t
  misc_feature 120: w=a or t
  misc_feature 125: s=g or c
  misc_feature 127: w=a or t
  misc_feature 178: k=g or t
  misc_feature 192: w=a or t
  misc_feature 253: m=a or c
  misc_feature 266: k=g or t
  misc_feature 267: s=g or c
  misc_feature 296: w=a or t
  misc_feature 297: k=g or t
  misc_feature 321: d=a or g or t
  misc_feature 326: r=a or g
  misc_feature 339: r=a or g
  misc_feature 340: r=a or g
  misc_feature 352: m=a or c
  misc_feature 358: k=g or t
  misc_feature 363: y=c or t
  misc_feature 366: k=g or t
tattgtttgattatgtaaaagtaatagtaaaatgcttacaggaaaacctgcagagtagttagagaatatgtatgcctgcaatatgggaacaaattagaggagactttttttttycatgtwatgascwagcacatacacccccttgtagtataatttcaaggaactgtgtacgccattkatggcatgattagwttgcaaagcaatgaactcaagaaggaattgaaataaggagggacatgatggggaaggagtmcaaaacaatctcksaacatgattgacccatttgggatggagawkcacctttgctctcagccacctgtdactargtcaggagtgtarrttggatctctamattaakgtccyctkgctgtctacagtagctgc

SEQ ID NO: 15831 - DNA, 317 bp, Homo sapiens
  misc_feature 256: y=c or t
  misc_feature 263: k=g or t
  misc_feature 281: m=a or c
  misc_feature 292: k=g or t
  misc_feature 297: k=g or t
  misc_feature 300: y=c or t
  misc_feature 303: k=g or t
  misc_feature 306: y=c or t
ctttaaatatttgttttccaattgtttgttgccagtacatagaaatataatagggttttttctgtatattgattttgtatcatatgaccttattgaaccaatttattatgtatatatattttttggtagctttcttaggatctgttatgtatacaatcatgttgtctatgtcaagacagtcttacttcttcctttacagtttatatgcttcttatttccttttcttgcttcattgcgctgactgggacttccagtycaatgtkaaaaagaagtagtgagamctgacatcttkgcctkgtyctkgayctcgagagaaa

SEQ ID NO: 15832 - DNA, 400 bp, Homo sapiens
  misc_feature 199: w=a or t
  misc_feature 374: d=a or g or t
acaaactctgcaatatgttaaaacctttaatgaaaacaagggagatgttggactctaatgtcactcttaataatgaaataaccaacatttgttgagctttttactacataccacaggtgttcttctaagctttttactttcattagctcaatagtctttgccttatcatataataggcactactgcatggatatatgtwgtcatttactgaggaagcagttatcaagagcccagacaataagctgagaaatctgagttgactttaaagtcctcctgtgttcaacaagggtgccaagaccattcgatggaggagggacagtcttttcaaaaatggtacttggaaagctggatacccacatacaaaagatgttgtdggcctccttaccttataccagataca

SEQ ID NO: 15833 - DNA, 205 bp, Homo sapiens
caacttaagtctttaatccattttgatttgatttttgtatatgatgagagatatgggtctagtttcattcttctgcatatggatatccaattttcccagcaccacttatttattttgtttgcaacaaagaaagagtttaattgtcacagggccaaccaagtgaggaagacagtagataattctcaaatctgcctccctgagaatt

SEQ ID NO: 15834 - DNA, 267 bp, Homo sapiens
  misc_feature 97: s=g or c
  misc_feature 98: v=a or c or g
  misc_feature 106: s=g or c
  misc_feature 107: b=c or g or t
  misc_feature 215: n=a, g, c or t
  misc_feature 216: m=a or c
taaagaattagtgttaatattttaggtgtgatgatgtcattgtggttatattctaaaaagtctatctttttagagcagcgattctcaacctggggasvgtttgtcsbctaggggatatttgggaatgtgtggaaacatttttggttgttacagctagggggtgttaactggcactgagagtagagggaggccaggaatgctgcaaaacatcctgnmagtccccaggccagccccgacaacaaagaattatccagctcacagggccaa

SEQ ID NO: 15835 - DNA, 311 bp, Homo sapiens
  misc_feature 30: k=g or t
  misc_feature 31: w=a or t
  misc_feature 278: w=a or t
  misc_feature 279: k=g or t
gtattttttctgttgcttttctgtgtttakwtacacaaatacttaaaattgtgttacagttgcctacagtattcattacagtaatgtgtagcagagtataccatctaggtttgtataagtacactctataatgtttgcacaacagtgaaattgcctaacaatgtatttctcatgaggtatccccattgttaagccatgcatgactgtattttaatctttacttaagtgacttagaaaaagaaacaagtggttcaggaggatcatgtgagtttcatgawktagatgatgacataagtcttgaagacagcttt

SEQ ID NO: 15836 - DNA, 182 bp, Homo sapiens
ccttctgcacacccttcctcagcccaagcccacagccccctgagtggaggaacgctccattctgtggattagaacagacataagtcacacccagtgtgtatcagtgtgtatgatgccccctgtctcccagataggacctgggcctgggagggacaggaagggagccctcaggtgccccccca

SEQ ID NO: 15837 - DNA, 244 bp, Homo sapiens
ccatacagtgtaagctttagctttgatcagctgctattattataaagcttaccatcttgtgtgcacacatatggcacgtaataggcatgtgagtgaataaatgcggaaaaaaataacagctagttttgagagataatgggtaatgcaatgggtgttagatgcactggtcagggaaggcctctctggaagttagaaacttgagacaggacctggattttgagtaggagttggtctcctggtgatc

SEQ ID NO: 15838 - DNA, 171 bp, Homo sapiens
catatgcctgttgagagcaagacctgcttcttccagcaatgaagatgttttatgcatcccacaaagctacttggttctacttcccgcccctaacccaacccacacttcccaacccatggaaagaatatatgaccctttatcctgtaaagctaactcaaatcaaacacaagc

SEQ ID NO: 15839 - DNA, 362 bp, Homo sapiens
tttttgaaacttgtttctaaaatccaggtcccagactactatgacatcatcaaaaagcccattgccttaaatataattcgtgaaaaagtgaataagtgtgaatataaattagcgatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaa

SEQ ID NO: 15840 - DNA, 122 bp, Homo sapiens
ggagagcgggaaggctaaaacgcggtactaaactgcagccaactttggttgtgtgtggaaaaggctttagccatggacaggagtggctttggagagatatcatcccctgtaatccgggaggt

SEQ ID NO: 15841 - DNA, 159 bp, Homo sapiens
cgggcgtggtggtgggtgcctgtagtcccagctattcagggaggctgaggcaggggagtcacttgagcctggaaggccgaggttgcagtgagctgagatcgcgctattgcactccagcctggatgacagagcgagacttcgtctcaaaaaaaaaaaaaa

SEQ ID NO: 15842 - DNA, 91 bp, Homo sapiens
tcttaaaaataaaattttgaagttgtttttaatgatgttctttttattaattcataactccttccatgcaaaggcttcaatgtccacgctc

SEQ ID NO: 15843 - DNA, 274 bp, Homo sapiens
acataaggggccaaagcctggggtgaagctgtacgtcggcagccccagccccagaaaaggaacctactctccatgcacgtctctctggagcaacctgaagacaggatcttggcctcaggacagttttgcaggctgggaagtccaagataaagccaccagcatctgacaatggccttcttgcaacatcctccaacagagaggaacaacatgtcctcacatggcagaagagcacagaggaaaaagaagaccaaactcactcttttataagagccgt

SEQ ID NO: 15844 - DNA, 250 bp, Homo sapiens
atgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggct

SEQ ID NO: 15845 - DNA, 318 bp, Homo sapiens
tatctaaatatatcattattggcatttgaattattgttagcagcaattaggtagatagggagagtatgatcagaattttatggctgaaacaaacttgaaatatttaaatcttaatatatttttctaatatttgaatatttatcaaaaacacttatgcttgtattgtggcataattttttctcaaggtgtaaatattaagtggttaattaaatgtagaacattctttggtgaccaaatatgaacaggtgccctgttttcttgtgctgaccataacttatgcacaactcatcaaaataatgactctaatttttccttagt

SEQ ID NO: 15846 - DNA, 394 bp, Homo sapiens
  misc_feature 201: b=c or g or t
  misc_feature 206: w=a or t
  misc_feature 345: r=a or g
ctcagtttcttcactgtaaattggactgtggtaaagaattaatgataaaatatagtagatatattttattctttgagagttttacttgtaaaacatttcttatataaaagttaaattattactgttaggtcaggcgttgtggctcatgcctgtattcccagcgctttgggagcccaagtgggcggatcacctgagatcagbgagtwctagactagcctggccagcgtggcgaaaccttgtctctactaaaaatacaaagattggccggacatggtggcgcacacctgtggtcccagctactcgggaggctgagacatgggactcgcttgagcccgggaggcggargctgcagtgagttgaggtcttgccactgtactccagcctgggtcacaca

SEQ ID NO: 15847 - DNA, 407 bp, Homo sapiens
aaacatgtttacacaaaagcctgtatacaagtatttatggaggttttatccacaattgtcaaaacctgaataccaaaaatttttccacttataaatggataaacaaattttggtacatccacacaatggataaatctcaaacaaatatggaaagtaaaaactcagattcaaaaggctacatactgtatgattccctttatatgactttcctaaaaaggcaaaactgtagggataaaaaataaagcagtggttgcgagaatcttgcagaagaggaaagtgtttatgacaaagaggcacaatggaactttttggggagctagaaatgttctttatctcgattgtgatggttacatcaccgaatgtatttgtaaaaacacataaaagtatacactaaaaaagatgaattt

SEQ ID NO: 15848 - DNA, 177 bp, Homo sapiens
tctacaaaaactataaaaagtagccaactgggaccaactgtaaaaattacttctggctacttgggaggctgaaatgggaggatcacctgagcccaggagatcgaggctgcagtgagctgtaatcatgccactgcactccatcctgggcagcagagcaagactctgtctcggcctccc

SEQ ID NO: 15849 - DNA, 208 bp, Homo sapiens
actgacgggagaacattggcgtgaaggctgctggcgactgggccagcattcattgtgaagaccggagggacacaccctgctgctcatgtctgcagggctctgagaggaggaagcctggggcaggacctgcgccagtggctgctgggcacagcatggagcaccccagcaagatggaattcttccagaagctgggctatgaccgggagga

SEQ ID NO: 15850 - DNA, 244 bp, Homo sapiens
ccaattttcaagaacagtaacaaaatatgagccactcaaaggcagaggacactgtgacacatccactggaaaatggatgagcactagggagccagatgtttttatttagcaaatcatttgctataaatacgttcaaagcatcaaagaaagccatgtctaatgaagcaaaggaaagcatggcgataattatttatcaaagagactatcaattcagacaaaaattattttaaaaatcaagcgggca

SEQ ID NO: 15851 - DNA, 375 bp, Homo sapiens
agaaggcactactcctatctactggaaaaaggatttttattatttggttagctttgtgttttaaaaaaatgatgagtatgatatcattcatctgttataaaattcaggtaacttttactggtgaacttgttagttctcactttagctttagcttagccatgcctttatgatacaattgaatttataaatagcattcttatgttaacataatgtctgtggtttcaatccccgtttattctgacttgattataacgtgatctgaaatatttccataatgctgtgataccattttgtagtaatttcattccacgtagaaggatgagcacttaaactctgggactttgttatgatttacataattgtattataaaatgt

SEQ ID NO: 15852 - DNA, 342 bp, Homo sapiens
  misc_feature 146: k=g or t
  misc_feature 190: w=a or t
  misc_feature 242: y=c or t
  misc_feature 264: k=g or t
  misc_feature 297: y=c or t
  misc_feature 299: w=a or t
  misc_feature 305: y=c or t
  misc_feature 332: y=c or t
tgttttcagctcctttgggttaataccaaaaacagtgattgtgggatcacgtgctaagagtaggtttagtttttgtaggaaatcaccaaactgtcttacaaagtggctgtttcatttttcatttccaccagcaataaatgagagtkcctcttgcattaaagcctcgccaacatttgatgttgtctatgtwctggattttggccattctgataggtgtgtagtagaatctcgttttttttttycatttctctgatgacatatgakgtagaacatcttttcataacgcttatttgccaycwatataycttgttcggtgaggtgtctgtaaaggyctttgcccca

SEQ ID NO: 15853 - DNA, 309 bp, Homo sapiens
atcagacgggaagcctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagcaaggctaatggtggaaacccacaacgaaatctatgacaagttcaagcagagtacacacagcatatatatgttcttcaacacatcagagctccgagaagcggtacctgaacccgtgttgctctcccgggcaga

SEQ ID NO: 15854 - DNA, 152 bp, Homo sapiens
  misc_feature 115: n=a, g, c or t
agaatgaagtaatatttttgttgggatgcaaaagaattatctcagtgaaaggggatgaggcaggaaataattctaagcaaaggagagacaccatgcacaaagtctgaagtaaganagaacatggcaaatttaaggaattgaaaggtggctaa

SEQ ID NO: 15855 - DNA, 252 bp, Homo sapiens
ttaatggaaaggacaaaacaataattttcatttgggaacctctcagctctctgctgattatcttcctgctcttatttatttttaggaaccccaacctctaaaaagtttttaagcattgctatacatcagtcaaacagaacaatgttgtaagcttcttgtacttgtatttcgtactaggtagaaagttacaatcaccatactgatttaaaatgcgtgggaaatgagaagtatcactcaaatgaaagcccagac

SEQ ID NO: 15856 - DNA, 451 bp, Homo sapiens
  misc_feature 207: k=g or t
  misc_feature 208: k=g or t
acagagacgtatttcatttcaggcagaggaaacaagtgtaaaggcctgaatttaggaaaaggcatggccttgttaatcccagcacattgggaggccgaggtgggaggatcactcctggggagcccaggagttcaagaccagcctgggcaacatagtgagatgttttatcaaaaaattaaaaagttttcccagctattgggaaaaaakkaaaagtagttccagctactcaggaggctgagataggaggatcgcttgagccttagaggctgaggttgtagggagttgagatactgccactgaactccagcctgagcgacagtgagaccctgtctcaaccgctccctcctccccccacaccaccacccaaaataaacagaaatgaggggagtatggctagaacactgagagtgaggggaggatgtgagatggaactggcgacataggcaggagt

SEQ ID NO: 15857 - DNA, 244 bp, Homo sapiens
aatatcaacattctatcctacagctctatgtacttttcctttctatactttaaaattggtcaggcatggtgccttacgcctgtaatcccagcactttgggaggccgaggtgggtgggtcacttaaggtcgggagttgtaagaccagcctggccaacatggtgaaagaaaccccgtctctactaagaatacaaaaattagctgggcattgttacacgtgcctgtagtcccagctactcgggaggg

SEQ ID NO: 15858 - DNA, 254 bp, Homo sapiens
  misc_feature 91: v=a or c or g
  misc_feature 92: m=a or c
tgaggttaggagttctagaccaccctggccaacatggtgaaaccccgtctctactaaaaatacaaaaattagctgggtttggtggtgcgtvmctgtaatcccagcactttgggaggccaaggtgggcggattacctgaggtcgggagttccagaccggcctggccaacatggtgaaaccccgtctctactaagaacgcaaaaattaggcgggcatggtggtgggtgcctgtggtcccagctactcaggagagca

SEQ ID NO: 15859 - DNA, 170 bp, Homo sapiens
acttttctcagccgtcacgtgacgccgcccggggcttgggggaaggggcggggcgcgaaccgcagttgctggcggtgcccttccgaggacgctttccaagcgagcaattaaacttgctgcccgaaatctaaaggcgcaggggcggtggcagcggcggcgggaggcggaaa

SEQ ID NO: 15860 - DNA, 192 bp, Homo sapiens
aaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccagctactcaggaggcga

SEQ ID NO: 15861 - DNA, 387 bp, Homo sapiens
aagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaattggaatttccgaaaatctgtactccaccatgagctttattgttggggatattaacaaatgtgatttgtataatgaaatgcatttcatttggaagaatt

SEQ ID NO: 15862 - DNA, 91 bp, Homo sapiens
  misc_feature 4: k=g or t
tctkccctcccttcctccataccaacctccctccctctctggagctcctgctctctccctctccctcctctcccgtgttccctcccttcct

SEQ ID NO: 15863 - DNA, 200 bp, Homo sapiens
  misc_feature 94: k=g or t
  misc_feature 95: r=a or g
gggactgttctatggaagactgacttgaaatgtgataaatctctgccattgttactttcacttgcccaaactgttctccttaagatgcaaatakraatgttgccgtatatttttttctccaaatttagcttaaagggataaatatttctttgacagtgccacttaagtttaattaagggactaatgcacacattccctca

SEQ ID NO: 15864 - DNA, 242 bp, Homo sapiens
ccttttgtatcactccttccctgcctttcctacctatcactctcgtgctgaaagttggaggaaaaatcaggaaaggtagtgtcccaaaagcctgcaaggagagtgatccaaggaaaagagagcaatcacttgtttcaagtgctgctgttctgtcaagaactgtctgtagcaataccaagtgcaattttagtggaggagtgaggccaaagcctgattggagtgccttctaaagtgagtggaaa

SEQ ID NO: 15865 - DNA, 122 bp, Homo sapiens
attatggctctctttactggaaatcgtagcttaaaagtgaaatatgaattttttttctgcataggcaaaatttcccaattaggtttttgaaatttgtgtttagaatgaatgattcctagagt

SEQ ID NO: 15866 - DNA, 113 bp, Homo sapiens
ttagcttagggaaatttcacagttcattgtggagtgttaaacttagaacatgtgtaacttttcacataaagagaatgcatctttgacagttatcttatttgtaaggcagccca

SEQ ID NO: 15867 - DNA, 253 bp, Homo sapiens
atctttttttttagtagagatggggtttcaccatgttggccaggatggtctcaatcgcgtgaacttgtgatctgcccaccttggccttccaaagtgctgggattacaggcgtgagccactgcacccggccagctttttatttttttaatggatggtgaagggggtgtggtacgttactcttaggaagagtccgagaaagaagcaccctagatgtggggagggagtgcttctgaatgctgagaaggagaagcgt

SEQ ID NO: 15868 - DNA, 149 bp, Homo sapiens
gaggaactgagcagggagataagaacagtcaacagctaataaacactagtcagagaaagaaaagcattacagacaaatacagaagtggtttaaaaactaaaaggaaaaagttcacccaaaaagtcacctgagaactacacaggcagccc

SEQ ID NO: 15869 - DNA, 216 bp, Homo sapiens
gattgttatgctggctaagtacattattatagattgtagttagctttcattttcatggtttcatttttgactaaatatttgagtttaaattaggatttatgcatttaattagtagctgttatgtgggaggcactgttgtaggcttttgatatactggtgaaataaagatttgtgccttgtgactcttttattaagagtgggatgcggagaggggtc

SEQ ID NO: 15870 - DNA, 137 bp, Homo sapiens
agaggtgcaatcgaggctcactgcagcctccacctcctggattcaagcgagtctcctgcctcagcgtttcaagtagctgggactacaggcgtgtgccactgcacccggctaatttttgtatttttagtggagacgat

SEQ ID NO: 15871 - DNA, 328 bp, Homo sapiens
  misc_feature 37: m=a or c
  misc_feature 197: w=a or t
ggaggttttatttcccaccccactctccaaatttgtmagccaccttaaaattaagcagatgttttaattggagtcttcagtgtgttggatcagccagtttattttccaagttcttcatctgtaaaatgatggggttggaccagataatttggaaggtttctttcagcctccagcactgtaatataccattataagtwttctaagaagatggcaaattcccgagaacctttttaactgattcagtttagttccaaaacgtttgcagtgatatatacctgtgcatagaagactggactattgatctgactttttggacttgttggaagat

SEQ ID NO: 15872 - DNA, 187 bp, Homo sapiens
  misc_feature 166: r=a or g
tgtatcagaatttcattccttttgaaagctcaataatattccattgtatgtataccaccatgttatgctcatccattcatctgtcggtggacatttgggatgtgtctgccttttggcttttgtgaataatgctaccatgaacattggtgtacaaacatctcttcargtccctgctttcaattctttg

SEQ ID NO: 15873 - DNA, 151 bp, Homo sapiens
  misc_feature 5: w=a or t
  misc_feature 9: r=a or g
  misc_feature 58: r=a or g
  misc_feature 66: r=a or g
  misc_feature 70: r=a or g
  misc_feature 129: w=a or t
atgtwagtraataggttttatatcaggcagtggatctatacagcaatgaatgaatgartgaatgartgartgaatgaatgaatggttgtatcagccaacagattaatgtgttatgaagaacagattgtwccaagaagttaatcagtgatcc

SEQ ID NO: 15874 - DNA, 116 bp, Homo sapiens
ctcccagggtgctgggattacaggtgtgagccaccgtgcccggccgtattttttgtatttttagtagagacagggtttcactatcttggctaggctggtcttgaactcctgaccac

SEQ ID NO: 15875 - DNA, 227 bp, Homo sapiens
tagaagaaaacataggtgtaaatttttatgccttgaaagcacaagcaacaggaatagatacattgtatttcatcaaaaattgtgcatcaaaggataccatcaagacagtgaaaagacacctcacagagtgggaaatgcgttttgaaaatctgtaaagggcttgaatctacaatatgttaaaaacttttataactcaataattgataacccaattaaaaacgggcctt

SEQ ID NO: 15876 - DNA, 127 bp, Homo sapiens
  misc_feature 69: b=c or g or t
cattttaagtatacagttcgagttttgacaaaaatatgcattcagtgtaaccaccagtacaaacaagtbagagaagtttttattatcccacagaaagttcccttgtacagagatctccccacccctc

SEQ ID NO: 15877 - DNA, 123 bp, Homo sapiens
cctagtagctgggattacaggtgcacgccaccaagcccggctaatttttgtattttttgtagagacggggtttcactaggctggtctcgaactcctgacctcaggtgatccacccgcgtcggc

SEQ ID NO: 15878 - DNA, 323 bp, Homo sapiens
  misc_feature 238: s=g or c
  misc_feature 239: r=a or g
gcaattttaataataagatcagagttggccaggcgtggtgtctcacgcctgtgatcccagccgtttgggaggccgaggcgggcagatcacaaggtcaggagttcgagaccagcctggccatggtgaggccccgtcttaactaaaaatacaaaaggattagccaggcgtggtggcaggcgcctgtaatcccagctgcttgggaggctgaggcacggagaattgtttgaacctgggaggsrgtgcttgcagtgagcccagattgcgcctctgcactccagccagggtaacagtgcaagactccatctaaaaaaaaaaaaaaaaaa

SEQ ID NO: 15879 - DNA, 100 bp, Homo sapiens
  misc_feature 27: s=g or c
agaatggcatgaacccgggaggcggasttgcaatgagccgagatcgcgccactgcactccagtctgggcgacagagccagactcatctcaaaaaaaaaaa

SEQ ID NO: 15880 - DNA, 397 bp, Homo sapiens
  misc_feature 9: r=a or g
tcgtaagtrcaagtagaaccgtatgccattatgaggagaatttttagaactaaggataccaggacacctggcctgacttaaagcctagcaataggacacagggtttgaaattgaaactattcccccaaatccaagacatacacatatccatagataaattggcaatgatggctgtaaaccaaaagtgatttgggtaactcaagtttatttgagggaacccctccagacattatgttggcaggaactatggccacccatggtgccatacataaccccggtacaagctgtcagggaaccaaataaaattgatatgccctcatgtggctcagacagtgagtcttgtcagcagttgttctgcccaggaaacttctctgttggtagtgtcatcattctatac

SEQ ID NO: 15881 - DNA, 225 bp, Homo sapiens
  misc_feature 109: r=a or g
ggaaacaaaaggcaaaatgaaggagagtacatcagatataacaaaagggaccacttaatagtgagtcttccaaccagagcttgtgtagcgtcagatccttgagtgataraggagtagaggtaagaagctatgttcatggcaggacttttcatacttgtacttttgggccaggtttggtggctcagggctataatcccagcgctttgggaggctgaggcgggtcac

SEQ ID NO: 15882 - DNA, 87 bp, Homo sapiens
cccagggcgtggtgctgaaagtgctcacaaacttcaagagcagtgagattgagcaggctgtgcagtcactggacagaaacggcgtga

SEQ ID NO: 15883 - DNA, 159 bp, Homo sapiens
  misc_feature 8: r=a or g
  misc_feature 90: k=g or t
cgggcgtrgtggtgggtgcctgtagtcccagctattcagggaggctgaggcaggggagtcacttgagcctggaaggccgaggttgcagtkagctgagatcgcgctattgcactccagcctggatgacagagcgagacttcgtctcaaaaaaaaaaaaaa

SEQ ID NO: 15884 - DNA, 107 bp, Homo sapiens
  misc_feature 95: r=a or g
aaattggagcaagaagaagaaccatgggtgatggaggaagaagtattaaggagacactggcaaggagaaatatggggagttgatgagcatcagaraaaccaggacaa

SEQ ID NO: 15885 - DNA, 172 bp, Homo sapiens
  misc_feature 120: k=g or t
  misc_feature 156: s=g or c
  misc_feature 157: r=a or g
actgaagtctaactagataggtttgttgtaagcttaggatgtttacagttcttcatgttaagttgagcgtgatgggaagggaaagaatgctgatctttaaatttttgtccttagttaagktctgtatttagtgaattaattgcatcctaaaaagtsraacttgaaaagcact

SEQ ID NO: 15886 - DNA, 384 bp, Homo sapiens
  misc_feature 142: r=a or g
  misc_feature 293: k=g or t
gaactcctgggctcaagagatcctcctgtcttggcctcgcaaagtgctaagtaggattacaggcgttaccaccacacccggctgtaaaaatgtacttattctccagcctcttttgtataaaccatagtaagggatgggagtratgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagtkgaaaaacaactctaagacactttaaagtaccttcttggcctgggttacatggttcccagcctaggtttcagacttttgcttaaggccagaa

SEQ ID NO: 15887 - DNA, 387 bp, Homo sapiens
  misc_feature 197: b=c or g or t
  misc_feature 250: s=g or c
  misc_feature 307: y=c or t
  misc_feature 329: r=a or g
  misc_feature 368: r=a or g
  misc_feature 387: w=a or t
gtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagtbccgagtgagggacataggcgagctcgtgcctctcctgcccaacccttgcagcsccatcagcgaggggcgctggcagacggaggaccatgatgggaacaagatcctcctayaggcacaaagggtgcataagargtttcctaaacctggcagagtacatcatgcctccgagargaaacgtcattccactctw

SEQ ID NO: 15888 - DNA, 246 bp, Homo sapiens
  misc_feature 117: y=c or t
  misc_feature 233: s=g or c
taaggctcctctctaccccacctccattgcagtcttttcttggctttttgccaatgagttcttcagagaggcagtagatggcagtagaggcttttgaatgaggactttcaggttgcyttggctcacctaatttcatcctcccatcctgacactgctgggaatgctgctctggaaagattctctgctgcctgcagagctgacagctgctgcctgaatctactcatctgtgagcsacaaaggggcgtc

SEQ ID NO: 15889 - DNA, 288 bp, Homo sapiens
  misc_feature 58: k=g or t
  misc_feature 59: k=g or t
  misc_feature 117: w=a or t
  misc_feature 119: s=g or c
  misc_feature 122: m=a or c
  misc_feature 124: r=a or g
  misc_feature 131: s=g or c
  misc_feature 174: r=a or g
  misc_feature 237: r=a or g
  misc_feature 253: n=a, g, c or t
ttttgccaactctttgaaatgttctacacgattggccatctcttctctacctattaakkaattccccctcataggtgtatttaatctagctaaagaataattcaaaatggagattawtsccmargactcasaaccacattagttcatggttgtcagcaaatctgacctgtgaarggggactcggttaccagtgaaaaatgcttattctatctgtattaatggaggtcattgtgccartgagacctacccagangtggagaggtgatctttcagaatctgttaccccgt

SEQ ID NO: 15890 - DNA, 238 bp, Homo sapiens
  misc_feature 43: d=a or g or t
  misc_feature 44: w=a or t
  misc_feature 118: k=g or t
  misc_feature 223: k=g or t
  misc_feature 228: r=a or g
  misc_feature 229: s=g or c
atattaggtatgtttggaaagaatttttgtatttattcctgtdwcagttttgactttcaacttctctccccgtgcatggaagtcctggtaaaggatctaacatctttattcccttctktcctcttccagctgagcagagttggataattgaattagtcattctgacattctttggaccatatcatcttagtggtttggggtcagtgctcatctgatatatctktcttrscaccttctg

SEQ ID NO: 15891 - DNA, 258 bp, Homo sapiens
tttatgtaatctatttaaaaatttttctcagaatataaataatagttgcagtagtagaactaaaggtagtgtcagaaacagtagggtggtgcctaccatgttatgttagtgaccctgtgtctttggtttagggatctagtggaacatgaccagctatccccttttgcctgagataccctcagcttttgatcatcactactgagtttttacatgttttagtgaaactatgaattactcaaatgttgtgatttaaaatgt

SEQ ID NO: 15892 - DNA, 410 bp, Homo sapiens
  misc_feature 15: v=a or c or g
  misc_feature 16: n=a, g, c or t
  misc_feature 45: n=a, g, c or t
  misc_feature 60: r=a or g
ggtaaccgcgtcgcvntcgccgaagatggcggggcgaagtctgtntctcacgagaagcarcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggtt

SEQ ID NO: 15893 - DNA, 123 bp, Homo sapiens; identical to SEQ ID NO: 15877

SEQ ID NO: 15894 - DNA, 199 bp, Homo sapiens
  misc_feature 12: r=a or g
  misc_feature 78: r=a or g
tttgtttgtgarcacataagcgcacaccctttccccaccttcacttcctgtttccttgcaaatgcaaagacaagagtraaggacttgcctagaggaaacacagaaatactgatttacaggtgaaaaatatgtaaatttgaaaaggtgttgaaaaggacctaagtttttgtagccacctgactaataaacacagagatac

SEQ ID NO: 15895 - DNA, 312 bp, Homo sapiens
gaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttcccc

SEQ ID NO: 15896 - DNA, 236 bp, Homo sapiens
tcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggtac

SEQ ID NO: 15897 - DNA, 177 bp, Homo sapiens
  misc_feature 121: k=g or t
  misc_feature 122: k=g or t
  misc_feature 175: k=g or t
tttggttccattcttgcagaaatttgcagaacctagaaataaaaagccatctgtaagaattttcagcaataacacctttttgatataaacaattttagaactcatttatatagcttaaackkaatctttctcttatatcaaggtgctgaagttagaattgaagcaaatcagagakca

SEQ ID NO: 15898 - DNA, 132 bp, Homo sapiens
tgttcatgttggagaagaactgtgtgattgggcgccgatgtgtgtagaaagactgctgcaaaattcttgacaacacagtattacctccagaaactgtggttccaccattcactgtcttctcaggctgcccgg

SEQ ID NO: 15899 - DNA, 186 bp, Homo sapiens
aagtatgtggaagcagctggtgccctgcctcatgaactttagagatgaggatctgctgctggtcagtgaggcacgtgtgtgctcactagcgatttcctgagttcagtagagcaaattgggcacctttcacggtgggggaatttgttaacttctttcttggagttaggaagcaataaagaagtgcaa

SEQ ID NO: 15900 - DNA, 148 bp, Homo sapiens
aagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggtaac

SEQ ID NO: 15901 - DNA, 225 bp, Homo sapiens
ttataccctaggagcaataggccataccatgtagcttaggtgtatagtaggctataccatctaggtttgtgtaaatacactctatgatgttaacataacaataaaattgcttaacaaatgatttctcagaatgtgtacctgcaagtgacacatgactgtattctgtttcaagagagtcttggagtcaccatccaagctgcccagttgacagactagaagccacgt

SEQ ID NO: 15902 - DNA, 460 bp, Homo sapiens
  misc_feature 309: r=a or g
aagagcgcggcctcagagggtcgggcggacgcgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtrtggagagccgtgatatgttccagttgcacatttcctgcaagactccaaagtggtgaggtgagaacaacggagcctcactcaggtcccctggccctagtcttgtccagttctctgtgctgcagggtttctctggtgcaagagaggaaagatc

SEQ ID NO: 15903 - DNA, 205 bp, Homo sapiens
  misc_feature 172: r=a or g
tcgtgtataagctcttcttctaaaatgaaaattactgtgagaattttacctgaagaaaattgagtttactgcaactatctttgggtcaggtgtgtacctgtgtagtatatattacatacttagtgtttatactatgcatggtgtaaaaccaggccactttgtgctatgagtraggactccccaaaagggcatggcagacaggcta

SEQ ID NO: 15904 - DNA, 178 bp, Homo sapiens
  misc_feature 15: b=c or g or t
  misc_feature 58: s=g or c
cagacaaggaagtcbtggcgagcctggagcagaagctgaaggaaattgacgaggagtsccggggcgaggagagcaggcgcgtggacctggagctcagcatcatggaggtgaaggacaacctgaagaaggctgaggcagggcctgtgacgttaggcaccaccgtggacaccacccacct

SEQ ID NO: 15905 - DNA, 137 bp, Homo sapiens
  misc_feature 11: r=a or g
  misc_feature 12: v=a or c or g
gagaaattttrvagctgggggagacatcacatgtcggcaggttccgtgatgccccctgagcggtaaagccagcaagtttttattagcaattttcaaaggggagggagtgtaggaatagggtgtgggtcacagagatc

SEQ ID NO: 15906 - DNA, 287 bp, Homo sapiens
  misc_feature 14: w=a or t
  misc_feature 61: s=g or c
  misc_feature 246: s=g or c
  misc_feature 263: k=g or t
catccgggggtgcwtgctgcagaggattgaccaaggtgagtcccgccctgccatggctcasaggagcctggcgtcccttggctgtatgtaccgagccccaccagggccacatcgactctcacttcctgtgaatacttgccatttgaccttaagtcaggacttggcctgaggaggtccagggtagaggagctcagaggggcagggatggatactctctgaaggaagggccgttggactggggctgtsagggatgtataggagtkctcaggatgagaagaaggaggcaa

SEQ ID NO: 15907 - DNA, 372 bp, Homo sapiens
  misc_feature 115: r=a or g
agatcgctccgcccccatccgcagttctaactttggcctgggactctgcccctctacctcagcacagaatcgccccgggtcctactacagaatcaatccttgaacactgcctccrcgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcagga

SEQ ID NO: 15908 - DNA, 384 bp, Homo sapiens
  misc_feature 25: s=g or c
  misc_feature 59: k=g or t
  misc_feature 123: r=a or g
  misc_feature 136: n=a, g, c or t
  misc_feature 274: k=g or t
  misc_feature 308: k=g or t
  misc_feature 322: r=a or g
  misc_feature 327: k=g or t
  misc_feature 328: k=g or t
  misc_feature 335: k=g or t
atgcctgtagtcccagcactttggsaggccgaggtaggcggatcacaaggttaggagtktgagaccaacctggccagcgcggtgaaacctgtctctactaaaggtacacaaaaaatgagctgrggcgtggtggcangcgcctgtggtcctcagcctccctaggggctgggatcacaggcatacggcaccattttcggctaagttttgtatttttggtggagatggggttttgccgtgttgcccaggctggtctcagacgacatcaggtgatctkcctgcctgtgactcccaaagttctgggattacakgcgtgatcccagtrttgtkktgttttkagtacattgcaattaatgtttacattcaaactttaaaattccttggatc

SEQ ID NO: 15909 - DNA, 127 bp, Homo sapiens
  misc_feature 75: k=g or t
  misc_feature 88: k=g or t
  misc_feature 89: k=g or t
aatgactaggatctcttgttctttaattttagggtcttgttccaggactcaaatcagtaacttggtgattacaakgtgctgaatgtgkkggtaaccatatcgcaatacacctcaaggaaaaggaacc

SEQ ID NO: 15910 - DNA, 158 bp, Homo sapiens
  misc_feature 51: n=a, g, c or t
tttgaagatggattgaagagaacgtccaccttaaggctttaaaagacagtnaagctgggtgcggtggtgcactcctgtaaccctgggactttgggaagctgaggcaggaagattgagcctaggagttcgagaccgacctgggcagcatagcgagacac

SEQ ID NO: 15911 - DNA, 159 bp, Homo sapiens
gcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttga

SEQ ID NO: 15912 - DNA, 162 bp, Homo sapiens
ctattttattatcttattttagtatggtacatttatttcaactaaggaatcaacattggtacaggtataccccagagatattgtgggtcagttccagaccactgagataaagccagtattgcaataaagtgagttgcatgaattttttggtttccccacgcc

SEQ ID NO: 15913 - DNA, 92 bp, Homo sapiens
  misc_feature 45: r=a or g
atcagaacctaggaaagaatgaatgatactttcagataagaccarttggcagcctagaatttgttttatttttccttctttggtatctatct

SEQ ID NO: 15914 - DNA, 130 bp, Homo sapiens
cctgattctcctggagtctccagcccgcccagtggccgcagtcacccaggtccagaggcggcggtatcacaggctctccgacatgtctatgctggctgaacgtcggcggaagcagaagtgggctgtggat

SEQ ID NO: 15915 - DNA, 336 bp, Homo sapiens
  misc_feature 47: h=a or c or t
  misc_feature 288: y=c or t
  misc_feature 315: k=g or t
agtagcggctttttgagacagggtctcactctgctgcccaggctgghgtgcaatggtaccatcatagctcactgcagccttgacctcccgggctcaagtgactctcctgcagcagccacctgagcagctgggaccacaagtgcacaccatcatgcctagctaatttttctattttaagtagagacggggtttcaccatgttggccaggctggtcttgaactcctgacctcaagtgatccacccgcttcagcctcccaaagtgctgggatttcaggcgtgggccactgyacccgacctatttttgttattattatkattattattatttttggagac

SEQ ID NO: 15916 - DNA, 144 bp, Homo sapiens
attaatgggttatcacaggaatgggactggtggctttataagaagaggaaaagagaactgagctagcatgcccagcccacagagagcctccactagagtgatgctaagtggaaatgtgaggtgcagctgccacagagggccccc

SEQ ID NO: 15917 - DNA, 191 bp, Homo sapiens
cagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacgcaa

SEQ ID NO: 15918 - DNA, 89 bp, Homo sapiens
aattaaatttgaatcatatacatttttctaaactgtggatgtgtaggttttatttagtgaacactagttataatttctaaatgtggcta

SEQ ID NO: 15919 - DNA, 110 bp, Homo sapiens
accccaccataataggatctttgtaagagcacacagccaagagctatgtgagagctgtgcgctcttaacaaagagatgtgtgccagttggcattcatgtcttaaccccta

SEQ ID NO: 15920 - DNA, 135 bp, Homo sapiens
tattttctgtgtcttttgagattatcatggagtttttttgtttttaactctgtttatgtagtgaatcacatttatcaatttgtgtgtattggatcatccttgcatcccaagaataaacccacttgattgtgctga

SEQ ID NO: 15921 - DNA, 127 bp, Homo sapiens
acatgatgcccctccctgctcccagccgcttcggtcatgtgaccgcctggggagtcaggggcggaagtcggggtctgacccgctccaggtccgggactgcggatagaagaggaccgccgccttgagg

SEQ ID NO: 15922 - DNA, 98 bp, Homo sapiens
  misc_feature 13: k=g or t
gagatacagagckaccatgtgactttacctgattgccctcagtttggggttgcttattgggaaagagagagacaaagagttacttgttacgggagaat

SEQ ID NO: 15923 - DNA, 212 bp, Homo sapiens
  misc_feature 84: b=c or g or t
  misc_feature 85: m=a or c
ttaggagttcgggaccagcctggccaacatggtgaaatcccccctctactgaaaatacaaaggttagctgggtgtggtggtggbmacttgtgatcccagctactagggaggctgaggcaggagaatcacttgaacccgggaggcggaggttgcagtgggctgagatcacaccactgcactcaagcctgcatgacagagtgagactctgtctc

SEQ ID NO: 15924 - DNA, 227 bp, Homo sapiens
  misc_feature 12: y=c or t
  misc_feature 13: y=c or t
aatgacattcayytaatgcttatagtgtgtcaggtagtttatgtaaagaatgaaaagaactagatacgtctacttctcagagttgttttatactatcttatggataagaaaatttaagttaaaggagattaagtaactgcccaacatcaggtaattactcagcattaaagccaaaacataaaaaatatttattgagcacctattgtgttctgaagatacagcggcca

SEQ ID NO: 15925 - DNA, 201 bp, Homo sapiens
  misc_feature 8: s=g or c
  misc_feature 12: m=a or c
  misc_feature 24: s=g or c
  misc_feature 25: y=c or t
  misc_feature 77: s=g or c
  misc_feature 78: s=g or c
  misc_feature 147: s=g or c
  misc_feature 148: r=a or g
aacccggsggamgatggcggcacsytctgagtgggccctctgcgggctccgcggctggggttcctggcgggaccggssgtctctcggcagtgagctcgggcccgcggctccgcctgctgctgctggagagtgtttctggtttgctgsracctcgaacggggtctgccgttgctccggtgcatcccccaaaccgctcggcaa

SEQ ID NO: 15926 - DNA, 105 bp, Homo sapiens
  misc_feature 65: s=g or c
  misc_feature 70: s=g or c
aggtctaagccctcgagctgtgggttcgcgtcctgggttgcgtgcattcgtggaaagcggcgtastgccsgtgtgtgtgatggttccgtggctgcaaggaagtaa

SEQ ID NO: 15927 - DNA, 217 bp, Homo sapiens
  misc_feature 98: k=g or t
  misc_feature 131: w=a or t
  misc_feature 135: w=a or t
  misc_feature 137: s=g or c
  misc_feature 169: m=a or c
tggctcggcctcccaaagtgctgggattgccggcatgagccaccacgcccagctggttcattattttaaaaacgtttttaattaaacttttttttttkgggatggagtctcactctgtcccccaggctggwatgwastggtgcgatctcggctcactgcagcctccacmactcgggttcgggtggttctccagcctcagcctcgcgagtagctggga

SEQ ID NO: 15928 - DNA, 236 bp, Homo sapiens
  misc_feature 7: s=g or c
  misc_feature 56: r=a or g
  misc_feature 178: s=g or c
  misc_feature 179: s=g or c
tgccttsgcctcccaaagtgctgagattacaagtgtgagccactgcgcccacccaraaacttctttgttgagatgaggtctcactctgttgtccaggctggtcttaaactcctgggcttaagtgcctgggaggcctctgtcggcctcccaaagtgttgggattataggcatgaaccassattcctagccaactagtgctttttgtatcctgtacaagaaatctcgctttgctacca

SEQ ID NO: 15929 - DNA, 120 bp, Homo sapiens
agtagagatagggtttcaccatgttggccaggctggtcttgaactcctgacctcaaatgatccacctgtctcggcctcccaaagtgctgggattacaggtgtgagccatagcgcccatca

SEQ ID NO: 15930 - DNA, 157 bp, Homo sapiens
aactttctgacccaacagtcacccagcgccggacgcgccgcgccctggcggctctagggaccccccccgcgcctgcacttagccccgcgcccgagtccacagacaaacgaatttaaaggagcaaccgaggaggcacctgcgaaagaaagcccacacc

SEQ ID NO: 15931 - DNA, 245 bp, Homo sapiens
tgttttcttaagatccagaagtttttgctttagcttaaggatgtgtgcaattttccatgtggcttcataattcatccatgactttgaattttaaaatggagagaagttggcttcccaggaaatggtgcccctggccctgggcatcggcccacctggctgtctccaaggctctccttcccagtggctggtgcgggctccgggagctcagctgagtcccattggggtggcaacggaaagggagcaga

SEQ ID NO: 15932 - DNA, 216 bp, Homo sapiens
  misc_feature 119: y=c or t
  misc_feature 120: w=a or t
  misc_feature 124: w=a or t
  misc_feature 134: k=g or t
  misc_feature 137: k=g or t
  misc_feature 142: s=g or c
  misc_feature 149: w=a or t
  misc_feature 159: w=a or t
  misc_feature 162: k=g or t
  misc_feature 164: w=a or t
  misc_feature 195: w=a or t
  misc_feature 198: k=g or t
  misc_feature 201: k=g or t
tgttgaaaagtaattgaaaaaggtgataggtaaatttttaggcaaagataatttatttcaataaatctttcaaaagccttaccttgaaatgctgttagtaaatttctgtgatttttttywtttwaatttgtttkgckgagascatagcwatttgttttwatkgwaaaacaataataataataaaaagcaaactcwatkggkgtgttgtgtgtggct

SEQ ID NO: 15933 - DNA, 186 bp, Homo sapiens
  misc_feature 21: s=g or c
  misc_feature 86: s=g or c
  misc_feature 116: k=g or t
  misc_feature 119: k=g or t
  misc_feature 128: s=g or c
  misc_feature 130: r=a or g
  misc_feature 133: k=g or t
  misc_feature 137: k=g or t
  misc_feature 139: m=a or c
  misc_feature 154: y=c or t
ttggtggccctcacttccttsattactacaaataatattttattaaacattcttattcttatatctttatttttattggttgattsattgactgattgacaggctagacaacacaktaktacctgcascragktaaktmactgcaacctcaaaytccagggcaccagcaatcttccgccttagcct

SEQ ID NO: 15934 - DNA, 285 bp, Homo sapiens
  misc_feature 12: s=g or c
  misc_feature 135: s=g or c
tggcaagcagcsgtactcctaccagtacacggtggccaacaaggaatacgtcgcctacagccacacgggccgcatcatccctgcaatctggttccgctacgacctcagccccatcacggtcaagtacacagagasacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacaccca

SEQ ID NO: 15935 - DNA, 248 bp, Homo sapiens
gccttggcctcccaaagtgctggcattacacgtgtgagccaccacgcctggctgttttggctttttgagactgcaattccgtgtgaatttgacgatcgacttctttatctgtgaaaaagacagttggaatcatggtagggattgtgatgaatctgcatataatgccttgagtagttagcatttcattgatgttaagtctttctacccatgaacacagatgtctttccatttatttagggttttttttt

SEQ ID NO: 15936 - DNA, 317 bp, Homo sapiens
  misc_feature 13: m=a or c
  misc_feature 169: r=a or g
gcaattttaatamtaagatcagagttggccaggcgtggtgtctcacgcctgtgatcccagccgtttgggaggccgaggcgggcagatcacaaggtcaggagttcgagaccagcctggccatggtgaggccccgtcttaactaaaaatacaaaaggattagccaggcgtrgtggcaggcgcctgtaatcccagctgcttgggaggctgaggcacggagaattgtttgaacctgggaggcagtgcttgcagtgagcccagattgcgcctctgcactccagccagggtaacagtgcaagactccatctaaaaaaaaaaaa

SEQ ID NO: 15937 - DNA, 212 bp, Homo sapiens
  misc_feature 11: s=g or c
  misc_feature 13: s=g or c
  misc_feature 25: m=a or c
  misc_feature 34: r=a or g
  misc_feature 142: k=g or t
  misc_feature 147: m=a or c
  misc_feature 157: v=a or c or g
  misc_feature 158: s=g or c
ttaggagttcsgsaccagcctggcmaacatggtraaatcccccctctactgaaaatacaaaggttagctgggtgtggtggtgggcacttgtgatcccagctactagggaggctgacgcaggagaatcacttgaacccgggakgcggmggttgcagtvsgctgagatcacaccactgcactcaagcctgcatgacagagtgagactctgtctc

SEQ ID NO: 15938 - DNA, 192 bp, Homo sapiens
ataccaaccctataaggcagggaggtgctgttatcaatctctatttccagataggaaattgaggcacacagagaactgacttgctcaagattacacagctagagcagagaatgatcccaggcagcccagctccagaatctgctgtttgatccctatgcagtaaacctgttagaagcatgtcatccagcccga

SEQ ID NO: 15939 - DNA, 206 bp, Homo sapiens
  misc_feature 141: s=g or c
tatctgatgacttggattcatctttagccaaccttgtgggcaatcttggcatcggaaatggaaccactaagaatgatgtaaattggagtcaaccaggtgaaaagaagttaactgggggatctaactggcaaccaaaggttscaccaacaaccgcttggaatgctgcaacaatgaatggcatgcattttccacaatacgcacccaca

SEQ ID NO: 15940 - DNA, 241 bp, Homo sapiens
  misc_feature 228: n=a, g, c or t
  misc_feature 229: d=a or g or t
  misc_feature 230: n=a, g, c or t
  misc_feature 232: r=a or g
cggaaattgagggagtttaactctgaatgagtaaataaaaataaagcaattatgtcattagcttaaaattttatcatcattaaaaataaaaagtttgaaaacaaatacttaatgtaacaatttatcaccgcgcaatttggactcacgacaatgtgtggtgtttgtcagacatgcactgttgcaatgcagcttgactgtcttgcagacagcctcaatgctgtttttaandntrgcagaaagc

SEQ ID NO: 15941 - DNA, 379 bp, Homo sapiens
cacggcgggataggagaacaaggtgacatgttaaacccttctgcaagaccatttgcttctcccaaactccatttcctcatctgtaaccaggaagggtagtggctgggagggcaaggccctggggtcagttggctggggctgaaaacccatctagttctgagaacttggccaagctcctcactttctccatctgttgaaaagagataataatggtgtctacctttgcagggctgctgtgaggtttcagtgagataacggcaagagactcgcccaggaaaccgatcattataacccctggctctgtctccccagggcttcctaccggtcaagtacagcccttctgggtttgacacctggccccatcacttcctagttctgt

SEQ ID NO: 15942 - DNA, 100 bp, Homo sapiens
tagtattactttaagaactttaagggaacttcaaaaactcactgaaattctagtgagatactttcttttttattcttggtattttccatatcgggtgcaa

SEQ ID NO: 15943 - DNA, 151 bp, Homo sapiens
tcttacaattttatgaaagaataatttcatttaagcatgagcatgataacaaatagtaatgctaagtggcacttattcaaaacacatacacccaaattcaatgtaaatggtacactatggtttttgccttagaagggaaaaagcaccccac

SEQ ID NO: 15944 - DNA, 128 bp, Homo sapiens
  misc_feature 117: v=a or c or g
tttgtgtttttagtagagatgaggtttcgccatgttggctaggctggtctcaaactcttgacctcgggtgatccactcacctcggcctcccaaagcgctgggattgcaggcgtgacvaccacgctgga

SEQ ID NO: 15945 - DNA, 139 bp, Homo sapiens
  misc_feature 49: s=g or c
gggaggtcaaggctgcagtgagccacgatcgtgccactgcactgcagcstaggcacaaagtgagaccctgcctcaaaaaaaaataaaattaaattgaattgaaattttatgacacaccaggctttagctaatacccgct

SEQ ID NO: 15946 - DNA, 454 bp, Homo sapiens
  misc_feature 400: w=a or t
tgtatttttggtgaagatggggttttgcaatgttggccaggctggtcttgaactcctgacctcgggtgatctgcccgcctcggcctcccagagtgctgggattacaggtgtgagccacagcacctggccaaaaaagttaacttttaagtaaaagtgcttctgagacaagtcctgagttccccttcctctggtgcaatagacacttgactttgagatccagttggctctcatggagtaatgattgactcacaatattgaagattcctcccctgtgtttctctatcttaaggagaagtttttcagcactgatactgtaattatttcagccaatacttttgatcacttccatttgcctgcaaagccagaaacttctctcaagaagattatagctgagtatgtwaaacaaaatatatgtacaactgtaataccaacaagcacagtggtaagttataac

SEQ ID NO: 15947 - DNA, 228 bp, Homo sapiens
tagaagaaaacataggtgtaaatttttatgccttgaaagcacaagcaacaggaatagatacattgtatttcatcaaaaattgtgcatcaaaggataccatcaagacagtgaaaaagacacctcacagagtgggaaatgcgttttgaaaatctgtaaagggcttgaatctacaatatgttaaaaacttttataactcaataattgataacccaattaaaaacgggcctt

SEQ ID NO: 15948 - DNA, 261 bp, Homo sapiens
cagatgcccatttgaaactgaagttagggaggtaattcagtaaccatcaaaactaaagttagggaggtagttcattcactaagtatttataacctgcttcatgtagaacacagccttagagatcagggatctaataggtcagatacgtagagacctgactttcaaaaggcttacagtccagctggaaaatcagataaatatgcagacaatttaaaatatctccaagcacatcctccagcaactgttgaggttcccacacat

SEQ ID NO: 15949 - DNA, 317 bp, Homo sapiens
ctttaaatatttgttttccaattgtttgttgccagtacatagaaatataatagggttttttctgtatattgattttgtatcatatgaccttattgaaccaatttattatgtatatatattttttggtagctttcttaggatctgttatgtatacaatcatgttgtctatgtcaagacagtcttacttcttcctttacagtttatatgcttcttatttccttttcttgcttcattgcgctgactgggacttccagttcaatgttaaaaagaagtagtgagaactgacatctttgccttgttcttgatctcgagagaaa

SEQ ID NO: 15950 - DNA, 222 bp, Homo sapiens
  misc_feature 213: k=g or t
tgtgtgccaccatgcttagctaatttttaaatttttttgtagagacagggtctcactacattgcacaggctgatctcgaactcctggcctcaagcaatcctcctgcctcggtctcccaaattgctgggattataggcatgagctaccaagcctggctggaaatttgctttttacaagattgaacagggaaagagtaaaggcagagtggcagtkaaggaggca

SEQ ID NO: 15951 - DNA, 56 bp, Homo sapiens
aacacccaagagccctaggagtatttttaaaagaactccttctaagtgctatattc

SEQ ID NO: 15952 - DNA, 182 bp, Homo sapiens
  misc_feature 148: k=g or t
agacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttktttagggattttgatgtcatttcttttttttttt

SEQ ID NO: 15953 - DNA, 120 bp, Homo sapiens
  misc_feature 87: s=g or c
  misc_feature 88: s=g or c
ttttatctggacttcagttaccttctgttaaggtttgagaacttgtgtcaaagttctcggtagtgttcctttggcctggagcaagtssaagggaagcttaaaccagaagaacctatcctt

SEQ ID NO: 15954 - DNA, 216 bp, Homo sapiens
ttagttgcaatctacttaaccactaatgacattaatcatctttttatatactcatttgccattcctgtagcttctttggtgaaaggtctgttcagttctttataccattatttttaacaggtttattgaggtttaatttacataccataaaaatctacctactaaaagtatacaattaaatggtttttcatatatttttggagttgtacggtcgca

SEQ ID NO: 15955 - DNA, 130 bp, Homo sapiens
tttggatggagacagaactaattctaggtccactggtggcaaatgtggttgtggattcaaacacttttgggatggtaaggagtatgacaatctaccagaagctttccctattactttagaatgaggtgga

SEQ ID NO: 15956 - DNA, 122 bp, Homo sapiens
  misc_feature 113: m=a or c
tccagaagaagatgcactaagtagcaaagaacactcagaaagcagtgttaagaaaaatttacctcagaatttactgaatatatttaatcagatagctgaatttgaaaaagaamaaggaaatt

SEQ ID NO: 15957 - DNA, 172 bp, Homo sapiens
  misc_feature 12: m=a or c
  misc_feature 104: r=a or g
  misc_feature 106: r=a or g
  misc_feature 107: k=g or t
agagaacagggmtctttttatcagagaaaggtgcagatgtgagattgaagtaaaagaaaacttgtggttctgcatttgtattggaaatatcattatgaactcgrgrkctatattatctttaaaaaatacatgctggctgggcacagtggctcacacctataatcccagcacc

SEQ ID NO: 15958 - DNA, 115 bp, Homo sapiens
cttcggggaggaggggctgtctgggctcggggcgcggcggcagtcggctctatgttcgcggtcttaacctctcctctggccgagtccttgcaagaagtgaattacccgaccctct

SEQ ID NO: 15959 - DNA, 367 bp, Homo sapiens
  misc_feature 25: s=g or c
tggcaaagtcatttacttagcgtasaattactcatttttgacccactaatcccagacttttcttgtctgggcacggtggctcacgcctgtaatcccagcactttgggaggctgaggtgggcggatcacaaggtcgggaatttgagaccggcctgaccaacatggtgaaatcctgtctctactaaaaatacaaaaattagacaggcatggtggcacgcgcctgtagtcccagctagtcgggaggctgaggcgggagagtcgcttgaactggggaggcgaagattgcagtgagccgagattgcaccactgcactccagcctgggcgacggagctgtctcaaaaaacaaacaaacaaacaaaacccccaa

SEQ ID NO: 15960 - DNA, 158 bp, Homo sapiens
  misc_feature 47: m=a or c
  misc_feature 49: m=a or c
  misc_feature 156: r=a or g
  misc_feature 157: m=a or c
ttctcatttcatttgatgtacacagccaaagtgggaattaaaaaaamamaattaccaactagttcagagagctaaattgagtctatcattatggcaaagtctgacccaaaattttaatttgtaattttagcatgtgtctcatgcactttgggggarma

SEQ ID NO: 15961 - DNA, 371 bp, Homo sapiens
ccataggctctcttcgagccggataaccaagaggggccggtagtgtggctcagtccaagtcagaaggcccaagaaccaaggaggctagtgctgtcactttcggtttgaggctaaagaccctagagccctagggcccactggtacaagtcctagagtccaaagaccaaggaacctggagtcctcgtgtccaagggcaggagcagaagggtgtcctggctctgcaagagagataatttgcccttcctcctcctttttgttctgttcaggctctggatgagtgggcggtgcctgctcttgttgagggtggatctgcccactcagtccacccacttacatgccagtctcctctgaaaacactctcaaggacacgc

SEQ ID NO: 15962 - DNA, 113 bp, Homo sapiens
ttaaatttttattcccatgaacttcaccatccaaatattctcttttttaaaaaaactttttctttcaacatcacactggaagtccttacacattttctcttaaggagcgcacc

SEQ ID NO: 15963 - DNA, 240 bp, Homo sapiens
tattaccagcatcccagaagccctccttcatgttcaggtggtgtttaaatatgtttgaaaaatatgtgaacacctttgaggtgaaagagtattcagtgaatatgatggtcatgatgatgtcaccttggatttaaggcattttcttaagatgtgtaaagtatgttcctttaaatctctctttaagatagaggtacaggtatcgacttatttcataaagaaactaagtctcaaaaaaaaaaa

SEQ ID NO: 15964 - DNA, 150 bp, Homo sapiens
tgtggtggcgcacctgtagtcccagctatttgagaggctaaagtgggagatcacctgatcccggaaaatcagggctgcagtgagccgagtatgtgccacttcactgcagcctgggcgacgggaatgagaccctgtctcaaaaaaaaaaaa

SEQ ID NO: 15965 - DNA, 160 bp, Homo sapiens
tgaggtgtgattaatctccaggaaaaatgttaccaggattccctttgtaaccatgacaaaatgctgagaagtggtggacacttagttgctgaaaagcactgaacgttcgctttcatctgacaaagtctttctgaataatacagggaggttcgggagggct

SEQ ID NO: 15966 - DNA, 222 bp, Homo sapiens
aactaaagagcttctgcacagcaaaagaaactatgatcagagtgaacaggcaacctacagaatgggaaaaaatttttgcaatctatccatctgacaaagggctaatatccagaatctacaaagaacttaaacaaatttacaagaaaaaacaaacaaccccatcaaaaagtgagtgaaggatatgaacagacacttctcaaaacaagacatttatgcagccaa

SEQ ID NO: 15967 - DNA, 58 bp, Homo sapiens
tctctgttgtatgttggattatgtaggaaatgtttgtgtacaattcaaaaaaaaaaaa

SEQ ID NO: 15968 - DNA, 463 bp, Homo sapiens
  misc_feature 404: y=c or t
  misc_feature 418: d=a or g or t
  misc_feature 421: n=a, g, c or t
aatacattagcagtgtcaaaagatgattttacagaacagacgtgatcgtggtggggatattttacaggagatctgctagcagagtcttgggatctcttcaccacctacaaacacattcaaacctcaggtaacaccagggttctgaggtggctcagtgatgtcttcagctctgataaacacattgaccaagcattgcactgtgtttttcctctagtatttctgttttctagcttttcctcaagaccactcttttggttcagagcaaaggacctataggaaagtgggcctcaagagaccccataacttctctgtcttgctttctggctcaacagccacctattctttctctgtttcctccatgcttggttcttctagcttgctattttacaaaaccatccatcttytccaagtctagggdtcnaaggactgagggtcacatggagctagagctgtcagttggcca

SEQ ID NO: 15969 - DNA, 432 bp, Homo sapiens
  misc_feature 16: s=g or c
  misc_feature 90: s=g or c
  misc_feature 329: r=a or g
  misc_feature 330: n=a, g, c or t
  misc_feature 331: k=g or t
  misc_feature 333: k=g or t
acgcaagatggcggastggaggaggtgactctggacgggaagcctcttcaggcgctgcgggtgaccgacctgaaggccgcactggagcascgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaaggagaaarnkckcaatttctgaagagaaaggtgactctgatgatgagaaaccaaggaaaggagaaagacgatcatctagggtcagacaggcagagcagctaaactgtctga

SEQ ID NO: 15970 - DNA, 266 bp, Homo sapiens
ctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggccg

SEQ ID NO: 15971 - DNA, 183 bp, Homo sapiens
  misc_feature 25: s=g or c
  misc_feature 42: s=g or c
taccgtgccttccgtgtggcggcasatcgggacactgcggascttctcaggcagtgacagcagcaggactagcaagtcccagggcggtaattatacccaccccttcccagagcttctgcctgccagcacttccttcgctccatcgtctggcgccttccttcctctactgtcctcatgagcccc

SEQ ID NO: 15972 - DNA, 291 bp, Homo sapiens
gtaaattaagctggcattttccgttgctatgtggggactctgcttttggaaaacacttctgtggcattgtatggaatcgttaacgggcttgctggtttccctgccttgacctcctttcattttccactgggaccactttctcttgagcataggttctcacattttctgctcgaggtgtcagctctgtggccactcttctgccaaagggcaccagggagttcctcaaaggaccttttgaactgtttgttcaatgaatgaagagttcagtcggacagtgacgaggacagcagc

SEQ ID NO: 15973 - DNA, 120 bp, Homo sapiens
tctgctttgcaagtttttgagtgactattatgtgccaggcattgttctgagtgctgggaatgaggcagtgaataaaacaaagtctttgctttcaatatgtttagttttagtggggtgagc

SEQ ID NO: 15974 - DNA, 383 bp, Homo sapiens
  misc_feature 302: d=a or g or t
cccttcccccttccgagttctatgcctaccaagaagctgcacgcgtgcctaccccaggaggagaggaactgggggtgggggagcgggggctggaataaagggaagggcagtagggagaatcagttctccctggaggagatggcacactttgcttggagaagaaaaactacaaactacccaggagttgcccccaaaaaagaaatacaaggagttcaagaaagctaggaaaatgtaaatcaaaatagatttaatatggagagacagacaacattcttgtctagtcaacctattgactagcatadgttaaagccccagtggggagagtgtggtcttgctggggactggacctgtccatggggtggaatggaaagtccagtggcaga

SEQ ID NO: 15975 - DNA, 127 bp, Homo sapiens
ctctgcatgctttatggccttggctctgggccaaggtgtgtgatctcctgcattcatggtgtgtggtgtgaggagggggatgggtccctgccccgtctgcacgtggccctcatgattcccgcgctag

SEQ ID NO: 15976 - DNA, 222 bp, Homo sapiens
attgaaaggcctcttggttgtttccagttttggcagttaggaataaagccgctctaaacattctcgtgtaggttcttatgtgcacataagttttcaccttgtttgtataaatgtcaaggaacccaattgctatgtcatatggtcacaatacgtttagttttgagaaattgccagatggtcctccatagtgcccatacctttttgtatttctttttttttttt

SEQ ID NO: 15977 - DNA, 405 bp, Homo sapiens
  misc_feature 7: v=a or c or g
ctaaatvaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggatta

SEQ ID NO: 15978 - DNA, 198 bp, Homo sapiens
  misc_feature 12: b=c or g or t
tctttacatttbaattaactaatcaacaatcttatttaatttgtatgttataattaagataaagaaataatggttattattcaaagtatacattcatattcaaaattgttaaatccatgtatatcatactaacacacataatgtgtatgacgtaatttgtataagagcgtggcccttatacaactgtgaaacaccgac

SEQ ID NO: 15979 - DNA, 397 bp, Homo sapiens
  misc_feature 13: y=c or t
  misc_feature 314: r=a or g
  misc_feature 321: v=a or c or g
  misc_feature 322: r=a or g
  misc_feature 334: v=a or c or g
taaagacatagayaaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatacacctaacagcaaccttcaaaatacataaagtgaagactgatagaactaaaaggtgagtagaaaaatccacaattgtagttggagacttctatatccctctcagtaactgatagaacaagtaggcagttaaatcagtarggatctvratgatttgagcvacactcgaccaacatgacctaagagacatttatagaacacatcactcgacaacagcagaacac

SEQ ID NO: 15980 - DNA, 152 bp, Homo sapiens
  misc_feature 13: y=c or t
  misc_feature 58: k=g or t
aaaaaattggatyatgttggccgggtgcagtggctcaggcctgtaatcccagcacttkgggaggccgaggcgggcagagcacgaggtcaggagatcgagaccatcctggctaacacgatgaaaccctgtctctactgaaaaaaaaaaaaaat

SEQ ID NO: 15981 - DNA, 412 bp, Homo sapiens
  misc_feature 13: w=a or t
  misc_feature 14: w=a or t
cagtcattgttcwwtttctttagtgtttactgcagctggctctcaggcagccttcgcttccgcaaaatgaggcctcattctcttttcctactctgtctttaaatgtagttaagtcattagccgccttgtttatcgctcagcactctttcatgtctcattgctgggaggattactcccaaatctggttttccagttctgcctctcatgagtccctcgattcggcttcttcagtaaaacatttttaactggtttttctgctctcagggcaactcaagacagctagcaaaacaaaaagcaagctaattattccccttcatctcctcttctcctttcttcttattttttgagacagagtctcactctgtcacccaggccggagtgcagcggtgcgatctcagctcactgcaacctc

SEQ ID NO: 15982 - DNA, 101 bp, Homo sapiens
  misc_feature 15: v=a or c or g
  misc_feature 16: m=a or c
aagaatcacttgaavmagggagtcggaggttgcagtgggccgagatggcgccactgcactctagcctggtgacagagaagactgtccccacaaaaaaaaaa

SEQ ID NO: 15983 - DNA, 275 bp, Homo sapiens
tacaaaaattagccaggcttgactgggcgcggtggctcacgcctgtaatcctagcactttgggaggccggggtgggtgaatcaccagagtttgggagttcaagaccagcctgaccaacatggagaaacctcatctctactaaaaatacaaaattagccaggcttgatggtacatgcctgtaatcccagctagttgggaggctgaggcaggagaatcacttgaacctgggaggtggaggttgtggtgagccgagatcatgccattgcacttcagcc

SEQ ID NO: 15984 - DNA, 115 bp, Homo sapiens
  misc_feature 9: m=a or c
  misc_feature 12: s=g or c
  misc_feature 13: r=a or g
aatatatamaasrtcctcctatagctctgatagggccatttattaagacctgctataccatttcttgctttagggattacatatgactttttagaactgtggagatgggcagatt

SEQ ID NO: 15985 - DNA, 229 bp, Homo sapiens
acttttggagcagcatttttctgtcttgcatcttgctgtttggaaaggttataaatctcagctgagattaattgggataatccttgctaccatccagactggcagtatgtttcatatagccctgagtgtagcaggagccaccatagaaagccatttcagggtcatgcagagtcttttcagttcatgagatgtagttttcaaaggcagtgaatgttcaataacaccacaa

SEQ ID NO: 15986 - DNA, 130 bp, Homo sapiens
  misc_feature 50: k=g or t
  misc_feature 51: v=a or c or g
  misc_feature 52: k=g or t
agtgttttgacagggcaaacagcagagaaagaactggccgagcgagggckvkggggagccggggcgccagagctagagacagcgggcgggcaaggagctggcagaggcgctgggcaagagggccggccct

SEQ ID NO: 15987 - DNA, 96 bp, Homo sapiens
tggatgaacgagattcccacaggccctacattaacaaggttaagctcaacccctttcccccagcacctcagaatgtgccctccctctccccactct

SEQ ID NO: 15988 - DNA, 174 bp, Homo sapiens
gacttgcgtggccataaaggggattattttggcacctcgcagagccacttctgtttcacccttccctgagtaaaaacccacttgaccagagtcaaggccatcacagccttccctgccagagaccagctctggcatcgtgtagagattctgagtactcctttgaaaaacggcacc

SEQ ID NO: 15989 - DNA, 314 bp, Homo sapiens
aagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaa

SEQ ID NO: 15990 - DNA, 399 bp, Homo sapiens
  misc_feature 25: s=g or c
  misc_feature 93: y=c or t
  misc_feature 94: y=c or t
  misc_feature 125: s=g or c
  misc_feature 126: y=c or t
agagtgcagagccgagatcgcgaastttgaaaagcgcgggcaacatccgggcacctgggccgtcgagctgaggcgcgccttccgagcctgctyyttagggcggatggcagccatgctgaagtgcsygatgagcggcagtcaggtgaaaggtggagcggcctttgttgtcttcccatttagcagagagaaaagcagacgttaataggtcgtccctaccattgtctaatttttcctctttgcctttttgcgcaatgactgaggacgcacgccctggccacagccccacccactcaagtccctgttaacttctgaggggaggatgaggacccatctcgtgtgacttagaggcagatgtaatatgggtggtatccgggaaatagagttgtaccaccgggccat

SEQ ID NO: 15991 - DNA, 212 bp, Homo sapiens
  misc_feature 82: k=g or t
  misc_feature 83: s=g or c
  misc_feature 84: r=a or g
ttaggagttcgggaccagcctggccaacatggtgaaatcccccctctactgaaaatacaaaggttagctgggtgtggtggtksrcacttgtgatcccagctactagggaggctgaggcaggagaatcacttgaacccgggaggcggaggttgcagtgggctgagatcacaccactgcactcaagcctgcatgacagagtgagactctgtctc

SEQ ID NO: 15992 - DNA, 413 bp, Homo sapiens
  misc_feature 141: w=a or t
  misc_feature 142: r=a or g
  misc_feature 235: r=a or g
  misc_feature 296: r=a or g
  misc_feature 297: s=g or c
cagtcagctagacacactcaggaggactactgaggctctgcgaccttcaggagctgagcctgcctctctcctttagatgacagaccttcatctgggaacgtgctgagccagcaccctcagatgatttccctccaaactggwractaggtcatcctctgtctggtagagacattcacatcttggcttttattctatgctctctgtacttttgaccaaaaattgaccaaagtaagaraatgcaagttctaaaaatagactaaggatgcctttgcagaacaccaaagcatcccaaggarstggtagggaagtggcgcctgtctcctggagtggaagaggcctgctccctggctctgggtctgctgggggcacagtaaatcagtcttggcacccacatccagggcagagaggtctgt

SEQ ID NO: 15993 - DNA, 251 bp, Homo sapiens
cctctgaaaattttggtaagacggccaggtgcggtggctcatgcctgtaatcccagctcttggggatgccaaggctggtggattatgaggtcaggagttcgagaccagcctggctaagatgacgaagccccgtctctactaaaaatacaaaaattagccgggcgtgatggtgggcacctgtagtcccagttaattgggaggctgaggcaggagaatcacttgaacccgggaggcagaggttgcggtgagcc

SEQ ID NO: 15994 - DNA, 217 bp, Homo sapiens
aaacaatatctgtttatttctcatagctctggaggctcacaagtccaagatcaaggtactggctgatatggggtttggtgagggtactctttctgattcatagatggcaccttctggcagtgtctttgcatggtggagagctagctctcgggtctctttgataagagcattaatctcaatcatgagggctctgccctcacgacttgatcgccaccca

SEQ ID NO: 15995 - DNA, 257 bp, Homo sapiens
agaatgataccactacaacaaacacacacttaagcacatagcccacagacactgaaaagcaattatacaatcaggtctacatagcagccagctaacaccacaatgacaggatcaaaatcacatatatcagtactaactttgaatataaatgggctaaacgcctcacttaaaagacacagaatgacaaactgaataaaaagataagacccaaccatctgttgtgttcaagagacacatctcacacataatgacaaccc

SEQ ID NO: 15996 - DNA, 77 bp, Homo sapiens
taacagttggaatcacataacacaaaatatgcaagttgcttagttgctttagttacaaaattttacgataagcccca

SEQ ID NO: 15997 - DNA, 129 bp, Homo sapiens
  misc_feature 118: k=g or t
tttgtgtttttagtagagatgaggtttcgccatgttggctaggctggtctcaaactcttgacctcgggtgatccactcacctcggcctcccaaagcgctgggattgcaggcgtgagckaccacgctgga

SEQ ID NO: 15998 - DNA, 246 bp, Homo sapiens
agatggggcagaggcacccaggagagcactattttggtttccagctgggaacgtgcactaagttttccttaatacccacagcacccaaaaggctttgctgtaatacactttaatgcatgaaacactcataaattatccttcgaactgttacaacttccaacctggaacaacttggaaaaaccagcctagcaagcaggctcttttttaatctctcaaatcacaacagaagaaaaagttcaagcacga

SEQ ID NO: 15999 - DNA, 442 bp, Homo sapiens
  misc_feature 32: k=g or t
ctggatttttgttatacaggttgagtatcctktacctgaaatgcctggttctagaagtgttttggattgtggaatttttttggatttttgaatacttgcatatgcataatgtgttttttcagaggtgggacctaagtctaaacataaaattcatttttatttcatacataccttgtacacataatagcacataatttatacagtactttttaatgattttgtgcacaaagtgtcgactgcattttgactcctcacatgaagtcagatgtgaagttttccactgtggcgtcttgtcagtgatcaaaaaaattttggactagagatgctcatcctgtatcccaaatatatgaacatttattctgattctttatatcagggattcttaaggtactcagccttttaactggtctttctgtgatcactcttgcctttttccaaacta

SEQ ID NO: 16000 - DNA, 259 bp, Homo sapiens
  misc_feature 14: r=a or g
  misc_feature 20: r=a or g
  misc_feature 169: s=g or c
atttccaggcctartgcctrcctcgtggctgactcttgaagcccaaaacttcctcaaatcagccttttgcccaacttctgtctactgttggactctacaggccagcctctgcctcacagtggaccctccagactcagatggtgtctcactgtggcatcctcaggcgaastcctgcctttcggcagcctctccaggcccagctcctcctgcctcccagtggcctctttcggcccagcccagctcatgcctcccagcggcc

SEQ ID NO: 16001 - DNA, 158 bp, Homo sapiens
tttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagacac

SEQ ID NO: 16002 - DNA, 190 bp, Homo sapiens
gatgggtccctctcttcccagatcactgcgaaacctgctcgacggtgagatggagcactcagccgcgctccggcaagaggtggacaccttgaaaaggaaggtggctgaacaggaggagcggcagggcatgaaggtccaggcgctggccaggtaggagagggtgagggatggagaggtaagcacgtgagat

SEQ ID NO: 16003 - DNA, 173 bp, Homo sapiens
gtgcggagggatgcggcgcttcggcgagcacccgttgtgtgggaactccgtctcaagtcgcccccattgtacggatgaaggaatcgaagccacgagccagaatttcctcactcgcaactcgagaataaattgcgcctccctgagtgtggaggattaaataagtagtctaaggc

SEQ ID NO: 16004 - DNA, 115 bp, Homo sapiens
ttaacattttgtatttcttcttttgttaattgctagctgatatcctttgctacatttcttattctaatttaattttaagaaccatcctggccaggcgctgtggctcacgcctcat

SEQ ID NO: 16005 - DNA, 116 bp, Homo sapiens
gaggctgaggcagagaattgcttgaacccggggaggtggaggttgcagtgagccgagatcgcgccactgcactccagcctggctacagaggaagaccccatctcaaaaaaaaaaaa

SEQ ID NO: 16006 - DNA, 114 bp, Homo sapiens
  misc_feature 4: r=a or g
  misc_feature 12: m=a or c
  misc_feature 17: m=a or c
  misc_feature 18: r=a or g
tttrcgcgcgamccggmrgcgggacaggcttgctgcttcctcctcctcggcctcacctagagacggggtttcactgtgtcagccaggatggacttgatctctcgacctcgtgat

SEQ ID NO: 16007 - DNA, 120 bp, Homo sapiens
  misc_feature 91: m=a or c
  misc_feature 92: s=g or c
acgggaggctgaggcaggagatacgcttgaacccgggaggatggaggttatggtgaactgagattgcgccattacactccagccagggcamsaagagcgaaactctgtctcaaaaaaaaa

SEQ ID NO: 16008 - DNA, 94 bp, Homo sapiens
agaacgaccaaagccaaacacatttataatcagatgtctccagtggactactgttatagagagaacatttcatgtagatactccagaggactga

SEQ ID NO: 16009 - DNA, 187 bp, Homo sapiens
  misc_feature 30: s=g or c
caaaaaattagccgggcatggcggcggacsctgtaatcccagctactcaagaagctgaggctggagaatcgcttgaacctaggaggcgggggttgcagtgagctgagattgcaccactgcattccagtctgggcgcagagcgagactccatctcaaaacaaataaataaaatttaaaaggaggcgac

SEQ ID NO: 16010 - DNA, 68 bp, Homo sapiens
  misc_feature 13: m=a or c
agagccttcggcmggacctgaaaaagcgagagggagagcgagcaaaaggcgcgatccagagagcctta

SEQ ID NO: 16011 - DNA, 58 bp, Homo sapiens
aaaacaaacaaaaactattatttataagaaaaaagctgttttgagttaaatggggtga

SEQ ID NO: 16012 - DNA, 204 bp, Homo sapiens
  misc_feature 7: m=a or c
  misc_feature 115: w=a or t
  misc_feature 116: w=a or t
  misc_feature 124: s=g or c
agttgamgaaactgaggctggagaggaaggactgctctccagaacgggtcatctgctgtgtccacacattaagaaacgctggtggagttttaaatgcctctccggggaaggaggwwagcctgasaatgaatctgacctcagacccaaatccattcaacggagttctggtaatttggaagaaggaagagcaacctggaaactaac

SEQ ID NO: 16013 - DNA, 107 bp, Homo sapiens
  misc_feature 59: m=a or c
  misc_feature 60: w=a or t
aagaagagtgcttgagcccgggaggttgaggctgcagtgagtcatgatagtgccactgmwctccagcctaggcaacagagcaggacctctaataaaaaaaaaaaaaa

SEQ ID NO: 16014 - DNA, 296 bp, Homo sapiens
caataagtgggtgaaggatatgaacagacacttctcaaaagaagacatttatgcggtcaacaaacatgaaaaaaaagctcatcatcactagtcattagagaaatgcaaatcaaaagcacaatgagataccatctcacaccagttagaatggcaatcattaaaaagtcagaaaacaacagatactggagagaatgtggagaaataggaatgcttttacactgttggtgggagtgtaaattagttcagccattgtggaagacagtgtgatgattccttaaggatctagaaccaaaaat

SEQ ID NO: 16015 - DNA, 102 bp, Homo sapiens
  misc_feature 50: w=a or t
acacacacacacacacacacacacacggcttctgttaagctgcaggctcwaatcctggcacttcccaggcttcgcctcaaggaatatgtttatccggctact

SEQ ID NO: 16016 - DNA, 81 bp, Homo sapiens
  misc_feature 7: n=a, g, c or t
  misc_feature 8: n=a, g, c or t
  misc_feature 48: r=a or g
gtatttnntttaagtagagacagggtttcatcgtgtttgccaggatgrtctcaaactcctgacctcgtgatctgcccgcca

SEQ ID NO: 16017 - DNA, 72 bp, Homo sapiens
  misc_feature 8: b=c or g or t
  misc_feature 9: b=c or g or t
  misc_feature 36: s=g or c
  misc_feature 56: n=a, g, c or t
actggacbbggcttgggcgtgagatggcggcggcasggatgagcagcgccaagcgnagcctgcggggagagt

SEQ ID NO: 16018 - DNA, 165 bp, Homo sapiens
  misc_feature 8: n=a, g, c or t
  misc_feature 9: b=c or g or t
  misc_feature 10: n=a, g, c or t
  misc_feature 19: r=a or g
ccacacgnbntctccccarggccttcgcacttgctttcttcctcgtttaccgtactcccagctacccacagggcttcttctcccacttccatgagtgctctgcacatgtattgagcaggacttcgcagccactcactatgaaatagtagtccctccctctcccgt

SEQ ID NO: 16019 - DNA, 129 bp, Homo sapiens
gttagccgggcttggtggtgcatgcctgtaataccagctactcgggaggctgaggcaggagaactgcttgaacctgggaggcagaggttgcggtgagccgaggtcgcgccattgcactccagcctggga

SEQ ID NO: 16020 - DNA, 106 bp, Homo sapiens
caagtagcagttttttgttttgttttgtcttgttttgagacggagtcttgctctgttcccaggctggagtgtagtggcgcgatctcactgcaaccttcgactccct

SEQ ID NO: 16021 - DNA, 67 bp, Homo sapiens
gatcacgccactgcactccagactgggtgacagagtgagactctgtctaaaaaaaaaaaaaaaaaaa

SEQ ID NO: 16022 - DNA, 250 bp, Homo sapiens
  misc_feature 215: s=g or c
  misc_feature 216: y=c or t
  misc_feature 222: w=a or t
  misc_feature 224: m=a or c
ctttggcaggccgaggcgggtggatcacgaggtcaggagatcgagaccatcctggctaacatcgtgaaaccccgtctttactaaaaatacaaaaaattagccaggcgtggtggcgggccctttcgggtcctaacacgtgcgctcgtgctccacctccatcatcacctcaacccaaaaagcataattaaactttacttcctcctttcttcttccasycatctwamcctactcctaatcacataacctatac

SEQ ID NO: 16023 - DNA, 163 bp, Homo sapiens
taatcctagcactttgggaggccaaggcgggcggaccacttgaggtcaggagttcgaaaccagcctggccaacatggtgaaaccctgtccctactaaaaatataaaaaaaattagctgggcgtggtggcggttgcctgtaatcccagctactgggaagactct

SEQ ID NO: 16024 - DNA, 110 bp, Homo sapiens
ctaagattttcactaagaatgctttcatcagagaatgaacatagcaaagctgattacttaactcaaaataaacttccatcaacacaccaggaacaatacatacacctcag

SEQ ID NO: 16025 - DNA, 180 bp, Homo sapiens
ggacaggcgacaggacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccaac

SEQ ID NO: 16026 - DNA, 172 bp, Homo sapiens
acaaaaaattagccgtgcgtggtggcaggcgcctgtaatcccagctactcgggaggctgaggcaggagaaaggcgtgaacccgggaggcggagcttgcagtgagccaagatcgcgccactgcactccagcctgggcgacagagcgatcctccgtctcaaaaaaaaaaaaaaa

SEQ ID NO: 16027 - DNA, 184 bp, Homo sapiens
caaaagtttgagaccagcccgactaatatggtgaaaccccatctctactaaaaatagaaagattagccgggtgtggtggcaggtgcctgtaattcctgctactcgggaggctgaggcaggagaatcattgaaacctctgcctcctgggtttcagtgattctcctgcctcagcctcccgagtagc

SEQ ID NO: 16028 - DNA, 186 bp, Homo sapiens
  misc_feature 40: r=a or g
  misc_feature 41: r=a or g
  misc_feature 179: r=a or g
actacaggctgcgcctctgcccctgcgaggggcacccctrrggtctctgggaaacggaatggagggtcttatggaagagaaggtttggaaccaccgctggagggaaggggagaagaaagcaagcaggagtggcgcgaacaggaagggactagggatagaagccgggcttggacacagtraggcatc

SEQ ID NO: 16029 - DNA, 140 bp, Homo sapiens
  misc_feature 20: s=g or c
  misc_feature 21: r=a or g
  misc_feature 96: r=a or g
  misc_feature 137: r=a or g
ggttggccaggcatggtggsrcatgcttgtggttccagctactcaggaggctgaggtgggaggatcatttgagccagggaggttgaggctgcagtrggccatgattgtagtactgcatttcgacctgggtgacagarcga

SEQ ID NO: 16030 - DNA, 81 bp, Homo sapiens
tcatgtaaaatgtaaataataaggtctgttaaaaaatgatatggccacaatactatcatcccatattaagccctgtcacct

SEQ ID NO: 16031 - DNA, 151 bp, Homo sapiens
  misc_feature 17: s=g or c
  misc_feature 78: n=a, g, c or t
gccgggcgcggtggcgsatacctgtagtcccagctactcgggaggctgaggctggaggatcgcttgagtccaggagtnctgggctgtagtgcgctatgccgatcgggtgtccgcactaagttcggcatcaatatggtgacctcccgggaaa

SEQ ID NO: 16032 - DNA, 165 bp, Homo sapiens
ccggctgatttttgtatttttagtagagatgttttgacatgttggccatgctggtctcgaactcccggcctcaagtgatcacccaccggccttccaaagtgctgggattacaggcctgagccaccctgcctggcctggattactgatagctaatacagtgtacgc

SEQ ID NO: 16033 - DNA, 90 bp, Homo sapiens
  misc_feature 66: r=a or g
ctcgaaactcctgacctcagtgatccacccaccccggcctccaaaagtgctgggattgcagatgtragccaccacgctcggccttttttt

SEQ ID NO: 16034 - DNA, 130 bp, Homo sapiens
  misc_feature 91: k=g or t
tgagaagtttcatttttgggttttgtgaatattacgaacagcttttcctagtttgctagggaatttgcgtggccaggtatttgctgcattkaaagttcttagatattatcatcagaagaacagtcttttt

SEQ ID NO: 16035 - DNA, 175 bp, Homo sapiens
aaatttttgaaacagtgtcctttgttttgagatggagtattgctcttgttgcccaggctggagcgcaatggcatgatctcggctcaccgcaacctccacctcccaggttcaagtgattctcctgcctcagcctcccaagtggctgagattgcaggcgtgtgccaccaggccctga

SEQ ID NO: 16036 - DNA, 77 bp, Homo sapiens
  misc_feature 33: m=a or c
ggatgtgagggcgatctggctgcgacatctgtmaccccattgatcgccagggttgattcggctgatctggccggccg

SEQ ID NO: 16037 - DNA, 90 bp, Homo sapiens
aaaatataaaaattagctgggtatggtagcacatgcctgtaatcccagctactcaggctgaggcatgagaatcacttgaacccaggagat

SEQ ID NO: 16038 - DNA, 167 bp, Homo sapiens
ccaataatgaataaagactgagaaactcgggccgggcgcagtggctcacacctataatcctagcactttgggaagccaaggtgggcggatcacttgaggtcaggattcaaggccagcctggccaacatggtgaaaccctgtctcgactaaaaatacaaaaaaaaaaa

SEQ ID NO: 16039 - DNA, 239 bp, Homo sapiens
  misc_feature 32: m=a or c
  misc_feature 33: w=a or t
aaggaaaactgtccttaggggataacagacamwgagatccagagagtggtgatctggagaaattagccgggcatagtggtgcacacctgtggtcccagctacttgggaagctgaggcaggaggattgcttgagcctaggaggttgaagctacagtgagccgtgattgcaccactgcactccagcctgggagacagagcaagatgctgtctcaatacacacacacacacacatcaggtgc

SEQ ID NO: 16040 - DNA, 268 bp, Homo sapiens
atatgtaaccaaaaataaagtgtttcaatagtttattcctctttcatataatggtctagagagagtgtcattggggcaaagggcaaagatacagaggatctgtttcccttctatcttgtttttctgtaatcacctagagcagtgctactcaaatgtggtccagaccagtgcaggtcttgggacttcttgccacttgtcagcatgctccctctccctcctttaaaggtgagacatgtacagaaattgagagtgtttatctggcccccat

SEQ ID NO: 16041 - DNA, 165 bp, Homo sapiens
caaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacaacgagactccatctcaaaaaaaaa

SEQ ID NO: 16042 - DNA, 92 bp, Homo sapiens
ctaatttttatatttttagtagagatggggtttcaccatgttggctaggctggtcccagactcctgatttcatgatccacctgcctcggcct

SEQ ID NO: 16043 - DNA, 159 bp, Homo sapiens
  misc_feature 122: b=c or g or t
  misc_feature 123: n=a, g, c or t
aaagtcaggtgtggtggtgcacacctgtgatcccagctacttgggaggctgagatgggaggatcccttgagccttggaggttgaggctgcggtgagccatgatcatgccactgcactccagbntgggcgacagagtgaggcccatgtcaaaaaaaaaaa

SEQ ID NO: 16044 - DNA, 205 bp, Homo sapiens
ttcagctgggcgtggtggctcacacctataatcccagcactttcggagggaggttgaggcaggaggattgcttgaggccaggaatttgagacaagcctgggcaacatggtgaaactctgtctctaccaaaaatataaaaattggctgggtgcagtggctcatgcctgtagtcccagcactttgggaggccgaggcaggtggtcgt

SEQ ID NO: 16045 - DNA, 109 bp, Homo sapiens
ggatgtgagggcgatctggctgcgacatctgtcaccccattgatcgccagggttgattcggctgatctggctggctaggcgggtgtccccttcctccctcaccgctccc

SEQ ID NO: 16046 - DNA, 188 bp, Homo sapiens
tctcttgcccacttgctttttttcctttttgaggtggagtctcactctgccgtcacagggctggagtgcattggcgtgatctcggctcactgcactgcaccctccgcctcctggatttaaacaattctcgtgcctcagcctcccgagagtggctgggactataggtactcaccaccacgcctggaaat

SEQ ID NO: 16047 - DNA, 150 bp, Homo sapiens
attttgaagttttagagtgttggaaaaatttctaattacagaacgcagcataggcacagaagaaaatgtgtaagaacctggagtcaaggactagaaaaattgaataatcacatcccatcccttcccaaagctgaaagttgctcgcggcca

SEQ ID NO: 16048 - DNA, 57 bp, Homo sapiens
tttttcaaaatgagaatttgatgagcacgtgcacgcacgcacagacacacacacaca

SEQ ID NO: 16049 - DNA, 78 bp, Homo sapiens
  misc_feature 61: n=a, g, c or t
cctgacctcaagtgatccacctgcctcggcctcccaaagtgctgggattacaggcgtgacnacggcacccaggctact

SEQ ID NO: 16050 - DNA, 134 bp, Homo sapiens
tcacacacacacacacacacacacacacacacacatcttccagacccatcccctgcctgccagctccacgagccagagagagacagagcgcggacgccgcaggaggcagtgcctggaccccagctgcccaggag

SEQ ID NO: 16051 - DNA, 119 bp, Homo sapiens
ttggagcagacatagaggtaagaactgtaggttttaatagaccatgataaaggcttcagactttcctcttctcaaccgttttgagcaaaggtgtgacattctttttttttttttttttt

SEQ ID NO: 16052 - DNA, 276 bp, Homo sapiens
  misc_feature 258: n=a, g, c or t
  misc_feature 259: n=a, g, c or t
  misc_feature 260: d=a or g or t
ccctgtctctactaaaaatacaaaattagctgagcgtggtggcacatgcctgtaatcccagctacttggaaggctgaggcagaagaatggcttgagcccaggaggcggagattgcaggtgtgtgccaccacacccagctaacttctgtgtttttagtggcgacagggtttcaccatgttggccaggctggtgtggaactcctgacctcaggtgatccacccaccttggcctcctaaagtgttggtattacaggcgtgnndactgcaccccgcctca

SEQ ID NO: 16053 - DNA, 201 bp, Homo sapiens
tttaaaataaaaaccaacagacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggaggattcgaggccaatgatgggagaccaccgggat

SEQ ID NO: 16054 - DNA, 201 bp, Homo sapiens
caggtactggaggcttgcagagagaatatacaagctgttaggggagacttaaaaccatcccgggccgggcgcagtggctcacgcctgtcatcccagcactttgggaggccgaggcgggtggatcacctgaggtcaggagttccagaccaatgtggccaccttggtggaaccccatctctactaaaaatacaaaagagccgg

SEQ ID NO: 16055 - DNA, 132 bp, Homo sapiens
  misc_feature 24: k=g or t
ttagtttttgtagagagagggttkcaccatgttgcccaggctagtctcaaactcctgggctcaagcaattctcccacctcagcctcccaaaatgctgggattacaggcatgcaccaccacacccggcccgca

SEQ ID NO: 16056 - DNA, 103 bp, Homo sapiens
ggatgtgagggcgatctggctgcgacatctgtcaccccattgatcgccagggttgattcggctgatctggctggctaggcgggtgtccccttcctccctcacc

SEQ ID NO: 16057 - DNA, 194 bp, Homo sapiens
agaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgcccc

SEQ ID NO: 16058 - DNA, 162 bp, Homo sapiens
  misc_feature 25: s=g or c
  misc_feature 32: d=a or g or t
acaacaaatcataaacccggcggasagcagcdgccgcgcgcgcctcccctcccaatgagttcctatttcgtgaactccaccttccccgtcactctggccagcgggcaggagtccttcctgggccagctaccgctctattcgtcgggctatgcggacccacct

SEQ ID NO: 16059 - DNA, 143 bp, Homo sapiens
cactaaaaatacaaaattagccaggtgtggtggcatatgcctgtaatcccagctactcaggaggctgaggcaggagaatagcttgaacctgggaggcggagattgcggtgagccaagattgtgccactgcactccaccctggg

SEQ ID NO: 16060 - DNA, 100 bp, Homo sapiens
  misc_feature 7: s=g or c
agcctcsctagtctcctcatcctgcttcacaggctccgcggcctccggcctcctcggcccccgtcccccggcctcctcggcccccgccccgccacccacc

SEQ ID NO: 16061 - DNA, 313 bp, Homo sapiens
aatagccagccgggcgcagtgtggctcacgcctgtaatcccagcactttgggaggctgaggcaggcggatcacaaggtcaggagatcgagaccatcctggctaacatggtgaaaccctgtctctactaaaaattcaaaaacactagccgggcatggtggtgggcacctgtagtcccagttacttgggaggctgaggcaggagaatggcgtgaacccgggaggcggagcttgtagtgagccgagatcccgccattgcactccagcctgggcgacagagcgagactccgtctaaaaaaaaaaaaaaaaaaaaaaa

SEQ ID NO: 16062 - DNA, 138 bp, Homo sapiens
  misc_feature 127: y=c or t
ttttttttgagacagagtctctgtctcccaggctggagtgcagtggcatgatctcggctcactgcaagctccgcctcccgtgttcacgccattctcctgcctcagcctcccgagtagctgggactayaggcgcccacc

SEQ ID NO: 16063 - DNA, 145 bp, Homo sapiens
  misc_feature 11: b=c or g or t
  misc_feature 16: y=c or t
ttttttgagabggagyttgctctgttgcccaggctggagtgcagtggcgcaatctcggctcactgcaagctccacctcccaggttcacgtcattctcctgcctcagcctcccgagtagctgggactataggcgcccaccaccaca

SEQ ID NO: 16064 - DNA, 92 bp, Homo sapiens
gaaaatggcgcccagctcgaaatcggagcggaacagcggggctgggagcggcggcggcggccccgggggagccggagggaagcgggcagcat

SEQ ID NO: 16065 - DNA, 102 bp, Homo sapiens
aaataaaataaagttttcctttttgagacgaagtttccctcttgttacccaggctggagtgcaatggtgcgatcttggctcactgcaacctccccctccccc

SEQ ID NO: 16066 - DNA, 158 bp, Homo sapiens
tgggaggccggggcgggtggatcgcgaggtcaggagatcgagaccttcctggctagcacggtgaaaccctgtctctactgaaagtacggaaaaattggccgggcgtggtggcgggcgcctgtagtcccagctattcgggaggctgaggcgggagaact

SEQ ID NO: 16067 - DNA, 180 bp, Homo sapiens
ccagcactttgggaggccgaggcgggcggatcacgaggtcaggagatcaagaccatcctggctaatgcggtgaagacccctctctactaaaaatacaaaaaattggctgggcgtgatggtgggtgcctgtggtcccagctactcgggaggctgaggcaggagaatggcgtgaaccccgga

SEQ ID NO: 16068 - DNA, 88 bp, Homo sapiens
agcctcccgagtagctgggattgcgggcgcctgccaccacgcccggctaatttttgtgattttttttttagtggagacgaggtgggca

SEQ ID NO: 16069 - DNA, 50 bp, Homo sapiens
caaaaaattagctgggtgtggtggcgggcacctgtagtcccagctactca

SEQ ID NO: 16070 - DNA, 101 bp, Homo sapiens
  misc_feature 33: k=g or t
aaataaaataaagttttcctttttgagacgaakttccctcttgttacccaggctggagtgcaatggtgcgatcttggctcactgcaacctccccctccccc

SEQ ID NO: 16071 - DNA, 136 bp, Homo sapiens
  misc_feature 32: r=a or g
agtcgaatggcaacattgtggcgatgctgagrcgcagagtttaggagacgggttcatcagtcaggccggctccgggctttctgcagcagcaccaggggcgggggcggggatcttgacctgggcgagcgaccgggat

SEQ ID NO: 16072 - DNA, 307 bp, Homo sapiens
atctcacaactcctcaacgctgctgttggggcatgaaagtggctacaggcaatgcattcacgaatgtgcatgtctgtgtgccaataaaactttatttctaaaaactgaaacttggggccgggtatggtggctcactcctgtaatcccagctacttaggagactgaggcaggagaattgcttgagcccaggctggatggagtgcagtggtgcgatctgggctcactgcaacctctgcctcctaggctcaagcgattcgcccacctcagtctctgaagtagctgggaccacacacacgcgtgcaccacc

SEQ ID NO: 16073 - DNA, 202 bp, Homo sapiens
  misc_feature 198: s=g or c
aggtgaggcacgagaatcacttgaacccgggaagcggaggttgcagtgagccgggatcgcgccactgcactccagcctgggagacacagtgagactccgtctcaaaaaaaaagaaaaaaaaagcctattttctcctaaacagaagttcttccatgatcccaagtgacttgaaggagcacacaaatgacccattcagcsccaa

SEQ ID NO: 16074 - DNA, 176 bp, Homo sapiens
caaaaattagctgtgcatgatggtgggtgcctgtaatcccagctgctcgggaggctgaggcacgagaatctcttgaacccaggaagcagaggttgccgtgagccaagattgcgccattgcattccaggctgggcaacagagcgagactctgtctccaaaaaaaaaaaaaaaaaaaa

SEQ ID NO: 16075 - DNA, 59 bp, Homo sapiens
  misc_feature 5: r=a or g
  misc_feature 37: s=g or c
  misc_feature 38: m=a or c
ccttrgcctcccaaagtgctgagattacaggcgtgasmaccacacccagccttttttct

SEQ ID NO: 16076 - DNA, 100 bp, Homo sapiens
tactgtcaaattactttccactgacagtgtatgagaatacctgcttctccacattctcaccactctgtgttaatccagtttttttttttttttttttttt

SEQ ID NO: 16077 - DNA, 100 bp, Homo sapiens
acacacggacagagacgggagaggagagagagatgaagagatagagaggaggagagggaagggaggataggcaggagagagccaaaaagatagagagtca

SEQ ID NO: 16078 - DNA, 128 bp, Homo sapiens
  misc_feature 36: r=a or g
  misc_feature 49: r=a or g
  misc_feature 104: r=a or g
ttttttgtagagatggggtttcaccacgttggccarggtggtctcaaartcctgacctcaagtgatccgcctgcctcagcctcccaaagtgctgggattacagrtgaaccaccacacctggccttttt

SEQ ID NO: 16079 - DNA, 242 bp, Homo sapiens
  misc_feature 57: r=a or g
ttgtagcaagtgagagtgacccagaggccagttaggaggctgttgcagaggcctgartgagagaggatggtttaaacaccaaaatggtaacattcagaatggaggaggagatggtgggagattaaatttggggatggagcccttaggatctgttgattgactggatgtgtaagagagaaagggaagagcagaactgaggaaatgtcctcttgaactggctgggggccactgagatgggacta

SEQ ID NO: 16080 - DNA, 247 bp, Homo sapiens
  misc_feature 49: v=a or c or g
  misc_feature 50: m=a or c
  misc_feature 59: r=a or g
  misc_feature 200: r=a or g
gaagcctgaagcaccctgacagacaaagcccagctgggagaggcctcgvmcctgcctaraattccccttgctctggcattggccttggccatgggcctgggagcagagggaggttctgtccgctggctgggagcagcttctctgcatgtttggaagtggaaagactaagttctctgcagctgggtgtctccatgatctgrgtgaggagaaggagcctggctcctgagcccgggggaaaagagggaaa

SEQ ID NO: 16081 - DNA, 146 bp, Homo sapiens
  misc_feature 13: s=g or c
  misc_feature 14: w=a or t
atggtggtggacswctgtaatcccagctactcgataggctgaggccagagttttgcttttgtcacccaggctggagtgcagcagtgcgatcctggctcactgcaacctccgcctcctaggttcatgtgattctccggcctcagcct

SEQ ID NO: 16082 - DNA, 358 bp, Homo sapiens
  misc_feature 7: y=c or t
  misc_feature 8: w=a or t
  misc_feature 9: y=c or t
  misc_feature 26: s=g or c
  misc_feature 49: h=a or c or t
  misc_feature 54: w=a or t
  misc_feature 78: h=a or c or t
  misc_feature 79: b=c or g or t
  misc_feature 128: m=a or c
aaaaagywyaaataggctgagcatgstggcttgcacctgtaatcccaghacttwaggaggttggggtgggcaagacchbaggtcaggagttccagaccagcctggccaacatgatgaagccctgtctmaactgaaaatacaaaaattagccaggcatgattgcgcacatctgtggtcccggctactagggaggctgaggtgggaggatcacttgaacctgggagttggaggtttcattgggctgggacgtattaaataggttgaaaagatataaaaagagcgtgctggctctttactgcaggagtggtggaaaaagctaaaggtgaaattattagaggaaaatgttaggacttttgta

SEQ ID NO: 16083 - DNA, 181 bp, Homo sapiens
gccgggtgcagtggctcacgcctgtaatcccagcactttgggaggccagggcgggcggatcgcctggggtcaggagttcaagaccagcctggacagcatgacgaaacgctgtctctgctaaaaatacaaaaattagccagcacggtggtgggcacctgtgatcccagctattcgggaggct

SEQ ID NO: 16084 - DNA, 127 bp, Homo sapiens
cggagtctcgctctgtcacccaggctggagtgcagtggtgtgattttggctcactgcaacctctgcttcccgggttcacgccattctcctgcctcagcctactgagtagctgggactacaggtgcct

SEQ ID NO: 16085 - DNA, 317 bp, Homo sapiens
ccggctggtcatttcacatgtgcacctggaagtggggatggaccaggctgtgcccacagggagcttcttatgacctaggagccaggcagaggccctgcaagacagtgtctgtgcaagagctgtccctggcatcgtggggaacaagatgcaaggagggctgtgagttccaggaacagagagcccaaggcagccttggttggaaagggcttcagcgagccagggaagcaagactaagaggaagggagagctggagagggggaaatggcactcatgaccaggagcacagcctgcacaaaggctaagcagcaaaagagaca

SEQ ID NO: 16086 - DNA, 96 bp, Homo sapiens
acagcctcatgacaggaaaaaaatgaagaaagtctgggatagagctgttgacttccttgctgctaatgagtctagagttcgcacggaaacacgaaa

SEQ ID NO: 16087 - DNA, 105 bp, Homo sapiens
ctccaacaccaacagcccctattgccactctgaaccagcctccaccacttcttcgtccaacactgcctgctgccccggctcttcaccggcagcctcctccactcc

SEQ ID NO: 16088 - DNA, 217 bp, Homo sapiens
  misc_feature 94: r=a or g
  misc_feature 201: m=a or c
cgggctcaagctatcctcccacctcagcctcttgagaagctgggactacaggcgcgtataccaccacacctcgtaaaattttttttttttttaraaacggggtttcaccatgttggccgggctgatctcaaactcccaacctcaggtgattcatctgccttggcctcccaaagcgctgggattacaggcatgagccaccgmacctacacctcccgct

SEQ ID NO: 16089 - DNA, 106 bp, Homo sapiens
aaaattggctgggtgtggtggtgcatgcctgtagtcctagctactcgggaggctgaggcaggagaatagcttgagcctgggaggtggaggctgcagtgagccctca

SEQ ID NO: 16090 - DNA, 263 bp, Homo sapiens
  misc_feature 39: m=a or c
  misc_feature 40: y=c or t
  misc_feature 41: s=g or c
  misc_feature 42: s=g or c
cttgcttagcaaatgttactggatggatgtacagatggmyssatggatggatgatcagacggatgggtggatggatgatcagatggatagatgaatggatagatggatggatggatagatggatggataatcagatggatggatggataatcagatggatggatggatggtcggatagatgaatggatggatggatggatggatggatggatggatggacacatggatggatggatgattggatggacgcatggatggatgga

SEQ ID NO: 16091 - DNA, 101 bp, Homo sapiens
  misc_feature 76: s=g or c
acaaacccggcgagctcagagcggtggagcggagaggagggacggcacccggctgcagggaggagggaggcggcasggcagcgtcggcgtggagggcgctc

SEQ ID NO: 16092 - DNA, 161 bp, Homo sapiens
acaaaaattggccaggagtggtggcgcgtgcctgtagtctcagcctcctgagtatctgggagtacaggcttgtgccaccacagctggctaaattttttgtatttttagtagagatggggtttcaccatgttggccaggctggtcttgccctcctcacctcg

SEQ ID NO: 16093 - DNA, 114 bp, Homo sapiens
  misc_feature 35: s=g or c
acagtcagggaagggctctgagaggcgagcgtgasccagcgacaggagagtgaggtgggggccctggggagggatagagggactggggctccgtggcttgaaagccgggcagct

SEQ ID NO: 16094 - DNA, 264 bp, Homo sapiens
aggtaagtgagctcactcaggaagtgccaccgtcttccaggtcactggtggggacgaactgcctgctgcgtctaccttcattcaacagacctcgaccgagtcgcatcccaaggccggctgtgtgcttggaacttactgagcagctatggagtttggctttcgggaactctgggtccagtccttgaaaccaaaggtgcaatacagggcggtgagaacttctgttgctacattctcctggcggtaggggggacaaagccccagcag

SEQ ID NO: 16095 - DNA, 209 bp, Homo sapiens
cggggaattctcctgcctcagcctcccgagtggctgggattacaggcgcccgccaccgtgcccagctaatttttgtgtttttagtggagacgggttttcaccacgctggtcaggctggtctcggactcctggcctcgggggatccacctgcctcggcctcccaaggtgttgggattacaggcatgtactaccgtgtctggccacccatt

SEQ ID NO: 16096 - DNA, 236 bp, Homo sapiens
  misc_feature 149: r=a or g
gtagccggctgctcccgctgcgggtggctcgggctgttgctgtggtttcctgagttgctgctgctgcggcggcggcagcggcgtctgtgcttgtggaggtgtcggcctttgggcggatgttgacattgtgttgttgttattgctgatgrtaatggcggcggcggtggcggcgacggtccagaccccatcccctctgtagccggagccgagacagccgacagcgaactccgcggcct

SEQ ID NO: 16097 - DNA, 217 bp, Homo sapiens
  misc_feature 160: r=a or g
  misc_feature 171: s=g or c
atcccagctactcaggaggctgaagcaagagaatcgtttgaacccggggggtggagattgcagtgagccgagatcgcaccactgcactcccgcctgggcgacagagtgagactccatctcaaaaaaacacacacacacacacaaaaaaaaaaggaaaaaraaagggccgascgtggtggctcacgccagtaacaccaacgcttcgggaggccgaggt

SEQ ID NO: 16098 - DNA, 73 bp, Homo sapiens
gccgggcgcggtggcgcgtgcctgtagtcccagctactcgggaggctgaggtgggaggatcgcttgagcccct

SEQ ID NO: 16099 - DNA, 144 bp, Homo sapiens
caaagaactcaaatacttaaaaaagtgttttggccaggcgcggtggctcacgcctgtatcccaatactttgggaggccgaggtgggtggatcacttgaggtcaagagttcaagaccagcctggccaacatggtgaaaccccgtc

SEQ ID NO: 16100 - DNA, 249 bp, Homo sapiens
  misc_feature 174: b=c or g or t
  misc_feature 176: m=a or c
tttcaggtactgcatagaggtttgatttaccttattcttgaagtccttcaagaaagagaattttttgagtgtgatacaaatgggagccaattatcctattgcaaaaaaaaaatgttactgaattgctcctaaagtgttggctggcatccaacctctggggagaatcgcttaagbcmaggagttcaggatcagcctgggcaaccccgacatcattaccggattttcctcttaaaaaaaaaaaaaaaaaaa

SEQ ID NO: 16101 - DNA, 192 bp, Homo sapiens
tccccaccaaggtctctgagccagagctttcagctgcatgagcacagcctgctccccctgtggaggggattctggggtgggtgtggttgtatactgggggaagtgagaatgtggcctctctgtgggtgagtgcagcaccgtgaattgtgtttgtaacacttgagttgtgtttcccaggtgtatgtgatggca

SEQ ID NO: 16102 - DNA, 131 bp, Homo sapiens
ataatattagggccaggtgtggtggctatcacatgtgctgtaatctcagcactttgggaggccgaggcaggaggattgcttaaacccaggaaggagttcaagaccagcctgggtaacatactgagaccctt

SEQ ID NO: 16103 - DNA, 119 bp, Homo sapiens
tcttagtgtgacacatgaacccctccccttcatgatctggcctatgtctgcctctgtagctactctctggtcctttacctcttacataagctacccaagcaggttttactatgatgctt

SEQ ID NO: 16104 - DNA, 110 bp, Homo sapiens
ttcctggcatttattcacccattcgttgattgattcagtgaaacagatttactgagtcactgatatgtgctaggcacatgaggtgactaagactccactccacacccgca

SEQ ID NO: 16105 - DNA, 136 bp, Homo sapiens
tttgacaaaaaagttgccaactgcaggtgaccacagatatctttcctggcccctttctggagcatcatgcgttactgactggggtccttgtgctaacctgtttggcctcatttgtattgctcttacccacctgcaa

SEQ ID NO: 16106 - DNA, 129 bp, Homo sapiens
  misc_feature 39: r=a or g
acaaggagaaggaggggtctcgaggagaagaggatacarggcaagaggaaggtggctcccgccgggaacctcaagtcaaccagcaacaactgcaacagctcatggacatgggcttcacaagggaacgaa

SEQ ID NO: 16107 - DNA, 141 bp, Homo sapiens
aatggagtctcactctgtcactcaggctgcagtgcagtagcatgatctcagctcactgcaacctccgtctcccaagctcaagtaatcctcccacctcaacacccttgagtatctggcaccacaggcgcgcgccaccaccca

SEQ ID NO: 16108 - DNA, 141 bp, Homo sapiens
accaggtagctgggactacaggcatgcaccactacagctggctaatttttttgtatttttagtagagatggggttttaccatgctggccaggctgatctcgaactcctgacctcaagtgatccacctgcctcggcccccca

SEQ ID NO: 16109 - DNA, 97 bp, Homo sapiens
aattcaggaaggatgacatcagcaagatggcccagtaaaatcccctaatgcttgtgaccccaatgccccctccctggcaaataaagccaaaacaacg

SEQ ID NO: 16110 - DNA, 74 bp, Homo sapiens
gccgggcgcggtggcgcgatgcctgtagtcccagctactcgggaggctgaggtgggaggatcgcttgagcccct

SEQ ID NO: 16111 - DNA, 108 bp, Homo sapiens
  misc_feature 13: w=a or t
  misc_feature 97: r=a or g
gaggtcaggagtwtgagattagcctggccaacatggtgaaaccacatctctactaaaactacaaaaaattagctgggcatggtggtgtgcgcctgtratcttagctac

SEQ ID NO: 16112 - DNA, 79 bp, Homo sapiens
gccgggcgcggtggcgcgtgcctgtagtcccagctacttgggaggctgaggtgggaggatcgcttgagcccaggagaaa

SEQ ID NO: 16113 - DNA, 176 bp, Homo sapiens
  misc_feature 12: s=g or c
  misc_feature 13: m=a or c
  misc_feature 14: m=a or c
tacaaaaattasmmgggcatggtggcacgtgcctatagtcccagctactcaggaggctgaggcaggagaattgcttgaacctgggaggtggaggttgcagtaagccgagatcacgccactgcactccagctcgggcaacagagtgagacttcgtctcaaaaagaaaaaggagtggt

SEQ ID NO: 16114 - DNA, 112 bp, Homo sapiens
  misc_feature 12: s=g or c
  misc_feature 46: y=c or t
aattaataacasaatgagtatttgcagatgccatgccatttagggytgtagaaatcatttggactactgagagaaaacagggaaaggaagtgctgttttatccgggggggga

SEQ ID NO: 16115 - DNA, 71 bp, Homo sapiens
  misc_feature 11: k=g or t
  misc_feature 12: h=a or c or t
agtctctctckhatatctgtattcctggcactggcgaaaagctcgctgtctgcgactttttccaggtactt

SEQ ID NO: 16116 - DNA, 66 bp, Homo sapiens
  misc_feature 14: r=a or g
  misc_feature 18: m=a or c
  misc_feature 19: w=a or t
  misc_feature 39: r=a or g
  misc_feature 51: r=a or g
agtgtgtggagaarccamwctcccgaaaccagagggatrgggccggctgtrcagtagaacgggtac

SEQ ID NO: 16117 - DNA, 164 bp, Homo sapiens
  misc_feature 19: w=a or t
  misc_feature 46: m=a or c
  misc_feature 47: m=a or c
  misc_feature 48: m=a or c
tctctttctttctattttwtgtagaggcagggttttgccatgttgmmmaggctggtctggaactcctggcctcgggcgatcctcccacatgggtcgcccagggtgctgggattataggcgtgaccactgcacctggtctggttcagagagtttaacaggcattg

SEQ ID NO: 16118 - DNA, 98 bp, Homo sapiens
  misc_feature 50: m=a or c
  misc_feature 51: s=g or c
attttaggtgttggatctcagggggaaaaaaaagagagagggagagagcmsagaaagacgagcaggaaagatcccgaaaggaggaagaggtggcgaag

SEQ ID NO: 16119 - DNA, 80 bp, Homo sapiens
  misc_feature 13: s=g or c
  misc_feature 48: s=g or c
  misc_feature 49: m=a or c
  misc_feature 66: m=a or c
gcatattttccasaaagaaagaaagaaggaggagagggggtagaagtsmagggaaaggaagcagamagaacaacaacagc

SEQ ID NO: 16120 - DNA, 58 bp, Homo sapiens
  misc_feature 13: k=g or t
cgtccatgatgtkccgcaactacctacattgtttgatcctcatgaaagcagcactggc

SEQ ID NO: 16121 - DNA, 91 bp, Homo sapiens
  misc_feature 13: n=a, g, c or t
  misc_feature 14: m=a or c
  misc_feature 24: m=a or c
gaggccaggagtnmgggaccagtmtggccaacatgatgaaaccccgtctctactaaaaatacaaaaattagccaggaatggtggcagagca

SEQ ID NO: 16122 - DNA, 108 bp, Homo sapiens
  misc_feature 13: s=g or c
acttgagcccagsagtttgagacaagcctggtcaatgtggtgaaacctcagctctacaaaaaatacaaaatcagccaggtgtggtggcatgcgcctatagtcccagct

SEQ ID NO: 16123 - DNA, 164 bp, Homo sapiens
  misc_feature 12: y=c or t
aaggaatttacyaggccaggcatggtagctcacacctatatgttaacactttggaagctgaggtgggggcatcgcttgggctttggagttcaaggctgcagtgagctatgattgctgcactccagcctgatagacagagcgagacctggtctccactcccccct

SEQ ID NO: 16124 - DNA, 100 bp, Homo sapiens
ttttgtgtctgtgccagaaatctcccttaggtgtgaacttcaggtcttctcaggtcttttctgagcctgtccctttccctgggtgtgtgcagccacttac

SEQ ID NO: 16125 - DNA, 286 bp, Homo sapiens
cctggtccaacatggtgaaacccatcctctactaaatacacaaaaattagcctggcatggagtgcagtggcatgatctctactcactacaacctccacccgccacattcaagcaattctcccacctcagcctcccgagtagctgggattacagctgcatgccaccatgccagtagtcccggctactcgggaggctgaggcgggagaattgcttgaccccaggaggcggaggttgcagtgagctgagatcacaccactgcactacagcctgggtaacagagaaagat

SEQ ID NO: 16126 - DNA, 232 bp, Homo sapiens
  misc_feature 231: y=c or t
acctgaagtcaggagttcgagaccagcctggccaacatggtaaaacactatctctactaaaaatagaaaaaattagccgggcgtggtcgtgtgtgcctatagttccagccactcgggaggctgaggcaggagaatcacttggacttgggaggtgtaggttgcagtgagccaagatcatgccattgcactccaggctggagtgcaatggcatgatcttggctcactgcaacyt

SEQ ID NO: 16127 - DNA, 198 bp, Homo sapiens
  misc_feature 62: s=g or c
  misc_feature 63: s=g or c
  misc_feature 184: y=c or t
  misc_feature 185: w=a or t
  misc_feature 195: m=a or c
ctaaacatacaaaaattacccaggtgtggtggtgcgtggctgtaatcccagctactcgccassatacctggctaatttctgtatttttagtgaagacagggtttcaccatgttggccaggccggtcttgaaatcctgacctgaagagagctgcccgcctcggcttcccaaagtgctgagattaywggcgtgagcmacc

SEQ ID NO: 16128 - DNA, 127 bp, Homo sapiens
cagaacagcacatccatctggaaggcctttttcttcacccccaacttcaaccccgtgggttccaacggatgctttgccacacacgtgtgcttctgtttcgggagttatgtcacccatcacgacccac

SEQ ID NO: 16129 - DNA, 181 bp, Homo sapiens
tttctcgtaaatgatgagatggggttaaatggttttgcagaaatatgtgagaggtaatgtgaaataagttactttaagaaggcctggccctggtaatgtcgttaccagctgatgaagttgcggtttaccttgctgcccctggtgctacattcacaaagcagctgtgtcttttggaaagccg

SEQ ID NO: 16130 - DNA, 229 bp, Homo sapiens
atttatctttgatactacaccaaaacacaagtagcagttttttgttttgttttgtcttgttttgagacggagtcttgctctgttcccaggctggagtgtagtggcgcgatctcactgcaaccttcgactccctggttcaagcgattctcctgcctcagcctcccgagtagctaggattacaggcatgtgccaccgcacccagctaagttttgcatttttagtggagaaa

SEQ ID NO: 16131 - DNA, 156 bp, Homo sapiens
ataactctttcttgtatacaaagtaattagtaaataactatagaaagacaataaatggaaaaataacttttttgcacagaataaaattattcacatgcactcacacatgcacacacacactacctgtgcaagagaataatctgtctgccccgacca

SEQ ID NO: 16132 - DNA, 175 bp, Homo sapiens
aaatttttgaaacagtgtcctttgttttgagatggagttttgctcttgttgcccaggctggagcgcaatggcatgatctcggctcaccgcaacctccacctcccaggttcaagtgattctcctgcctcagcctcccaagtggctgagattgcaggcgtgtgccaccaggccctga

SEQ ID NO: 16133 - DNA, 67 bp, Homo sapiens
aaactgacaaatcactgatcttggagtcagatctggatttgaatcctgacatcatcatttgccagca

SEQ ID NO: 16134 - DNA, 106 bp, Homo sapiens
ggatgtgagggcgatctggctgcgacatctgtcaccccattgatcgccagggttgattcggctgatctggctggctaggcgggtgtccccttcctccctcaccgct

SEQ ID NO: 16135 - DNA, 175 bp, Homo sapiens
  misc_feature 104: s=g or c
agacacaccctcctgcttcggctggtggcgatcggagctcgggccctctaggggagggagctgccgccgccgacgccgtggggcaggacagtgagcgggcgaasgagcgagaaaaggagggaaggagggaacgagggaggagcagcgggtgggaggtgggagggaggagcagcga

SEQ ID NO: 16136 - DNA, 126 bp, Homo sapiens
cctttttctgccttcttcctttgtaccctcactgctaccagctccttctggcgacccccaggtaccccctcccacctttcgtttctctctgggtcagcagaccacgcatgtatccagaggcgcgta

SEQ ID NO: 16137 - DNA, 95 bp, Homo sapiens
aagactatactttcagggatcatttctatagtgtgttactagagaagtttctctgaacgtgtagagcaccgaaaaccacgaggaagagaggcagc

SEQ ID NO: 16138 - DNA, 68 bp, Homo sapiens
cgagtgattttcccggctcagcctcccgagtgcctgggattacaggcacacaccaccacgcccagcca

SEQ ID NO: 16139 - DNA, 107 bp, Homo sapiens
  misc_feature 7: m=a or c
tccgagmtggagtcttgctctgtcacccaggctggagtgcagtggcacgatcttggtcactgcagcctctgcctcctgggttcaagtgattctcctgcctcagcccc

SEQ ID NO: 16140 - DNA, 146 bp, Homo sapiens
aacaatctttttgtagaatctgcgattggagatttggactcctttgaggcctactgtagtaaaggaaataacttcatctaaaaaccaaacggaagcattcacagacaattcttagtgatcattggattgatctaacagagctgaac

SEQ ID NO: 16141 - DNA, 129 bp, Homo sapiens
attttttatttttattttttggtagaggtgaagtctctccatttgctcaggctggttttgaactcctggccttaagtgatcctcccgccttagcctcccgaagtgctggaatcacaaacatgaaccacc

SEQ ID NO: 16142 - DNA, 129 bp, Homo sapiens
  misc_feature 7: h=a or c or t
  misc_feature 8: h=a or c or t
caaatahhtttgttttgttttgttttgagacagagttttgctctcattccccaggctggagtgcaatggtgcaatctcggctcactgcaacctctgcctcccagacgattcttttgcctcagcccccca

SEQ ID NO: 16143 - DNA, 76 bp, Homo sapiens
caagatcttaaaggtggaggacctactcaagccgttgggtaaggactgcatcagagatggcaagttagaggatgac

SEQ ID NO: 16144 - DNA, 85 bp, Homo sapiens
attagctgggcgtggtagcaggtgcctgtaatcccagctacatggagtgcagtggcacaatcttggctcactacaacctcctctg

SEQ ID NO: 16145 - DNA, 115 bp, Homo sapiens
acttgagcccaggagtttgagacaagcctggtcaatgtggtgaaacctcagctctacaaaaaatacaaaatcagccaggtgtggtggcatgcgcctatagtcccagctcagcctc

SEQ ID NO: 16146 - DNA, 263 bp, Homo sapiens
  misc_feature 158: s=g or c
  misc_feature 159: s=g or c
agacggcctagcgctgcgtgggccatggtgcagctccgaccgcgagcgtctcgcgccccggcgtcggcggaggcgatggtggacgagggccagctggcctcggaggaggaggaggcggacacgggctgttgctcgggcagcccagcagcggcgcggcsscgagcccctggaggaagacgaggaaggggacgatgagtttgacgatgaggccccggaggagctgactttcgccagcgcccaggcggaacgagagaagaggagac

SEQ ID NO: 16147 - DNA, 245 bp, Homo sapiens
  misc_feature 17: r=a or g
  misc_feature 18: v=a or c or g
acaagatggccgctgcrvcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctat

SEQ ID NO: 16148 - DNA, 175 bp, Homo sapiens
tacaaaaaaattagctgggtgtggtggtgcacacctgtaatcccagctacttgggaggctgaggcaggagaatcgcttgcacctgggaggcagatgttgcagtgagccgagatcttgccactgcactccagcctggctgacagagggagactccatctcaaaaaaaggaaagaaa

SEQ ID NO: 16149 - DNA, 81 bp, Homo sapiens
  misc_feature 29: w=a or t
  misc_feature 34: r=a or g
  misc_feature 44: r=a or g
  misc_feature 47: r=a or g
tgttttacataaaaagttaatgtgaatawtagaraaaaaggacratrttaaagcagtttgtagaatttgtcccccccccct

SEQ ID NO: 16150 - DNA, 192 bp, Homo sapiens
  misc_feature 7: m=a or c
  misc_feature 8: w=a or t
cagggcmwggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccctcc

SEQ ID NO: 16151 - DNA, 182 bp, Homo sapiens
  misc_feature 13: w=a or t
  misc_feature 28: m=a or c
atctcggttcacwgtaacctctgcctamcgggttcaggcgattcttgtgcctcagcctcttgagtagttgagattacaagtgtgtacaggtgtgcaccaccgcatctggctagattttgtatttttagtagagaccacgttttgccatgttggccatgatggtcttgaactactgaccctga

SEQ ID NO: 16152 - DNA, 68 bp, Homo sapiens
  misc_feature 32: m=a or c
  misc_feature 33: w=a or t
actgcattccagcctgggagacagagtgagamwgtgtctctgaaatttaaaaaaaggaaaaaaaaaaa

SEQ ID NO: 16153 - DNA, 87 bp, Homo sapiens
  misc_feature 49: w=a or t
  misc_feature 50: r=a or g
  misc_feature 74: r=a or g
gttttgagacagagtctcactctgtcacccaagctggagtgcagtgcawratcttggcacactgcaaacctctrcctcccgggttgc

SEQ ID NO: 16154 - DNA, 112 bp, Homo sapiens
  misc_feature 17: n=a, g, c or t
  misc_feature 18: m=a or c
  misc_feature 32: v=a or c or g
  misc_feature 33: m=a or c
  misc_feature 49: m=a or c
  misc_feature 59: m=a or c
ctggccgggtgtggtgnmttacgcctgtaatvmcaacactttgagaggmcgaggcaggmagatcatgaggtcaagagattgagaccatcctggccaacatggtgaaacccca

SEQ ID NO: 16155 - DNA, 84 bp, Homo sapiens
  misc_feature 24: w=a or t
  misc_feature 48: h=a or c or t
  misc_feature 49: v=a or c or g
  misc_feature 50: r=a or g
  misc_feature 58: y=c or t
  misc_feature 59: m=a or c
ttttgttttagacggagtttcgcwctgttacccaggctgtagtgcaahvrtgcaatcymggctcactgcaacctccacccccct

SEQ ID NO: 16156 - DNA, 185 bp, Homo sapiens
  misc_feature 13: r=a or g
aagtgatgtcaargctgtgagctcagcagcagccctcctttaggagctgccggtggagagtgagtgctggtcctgtggaggagggagcaagccccgtggtgcggagtgcatttccatggatggcttcagagctggccaggatggacagtactccaggcagtgggaaccgcgcgtggaggcggcgg

SEQ ID NO: 16157 - DNA, 298 bp, Homo sapiens
  misc_feature 4: k=g or t
  misc_feature 49: y=c or t
aatkatcctgggcactgtgttagtgtcacgggttgaggaacccagcccyagggtgttcagagtctggagtcacagcacattagaaccaataacacacacacacacacacacacacaagtcgggcatggtggcgaacacctgtagtcccagctacttgggaggctgaggcaggagaatcgcttgaacccgggaggcagaggttgcagtgagccaagattgcaccactgcactccagcctggatgacagagtaagactctgtctcaaacacacacacacacacacaacaacaacaacaac

SEQ ID NO: 16158 - DNA, 108 bp, Homo sapiens
  misc_feature 13: w=a or t
  misc_feature 43: s=g or c
  misc_feature 49: m=a or c
aagttacttggcwcggagcgggcgaggggacgcgtgggcggasggggcmtggccagcctcggcccccatgacccgctgtcctgtgccctttcccagcgatggggcggc

SEQ ID NO: 16159 - DNA, 111 bp, Homo sapiens
ccctttatcattgcaattcataataaatgtattttttgtcctctagttcccccaagaagttagctcctaggtaataaaattatacacacacacgctcgccccccccaacac

SEQ ID NO: 16160 - DNA, 129 bp, Homo sapiens
cattcttcagaagaggccaggcatggaggctcgtgcctgtaatcccagcactttgagaggctgaggcaaatgaatcatttgaggtcaagagttcgagaccagcctggctaacatggtgaaaccccggca

SEQ ID NO: 16161 - DNA, 90 bp, Homo sapiens
  misc_feature 49: w=a or t
  misc_feature 50: w=a or t
aagactatactttcagggatcagttctatagtgtgttactagagaagtwwctctgaacgtgtagagcaccgaaaaccacgaggaagagaa

SEQ ID NO: 16162 - DNA, 119 bp, Homo sapiens
acaaattaggccgggcgtggtggtgggtgcctataactccagctccttgggaggctgaggcaggagaatcacatgaatccgggaagcagaggttgcactgagccaagatcccgccactt

SEQ ID NO: 16163 - DNA, 112 bp, Homo sapiens
  misc_feature 51: s=g or c
tcccctctcttcccctccctccccagccttccccgcgagcggacgcgacascctctgatctcgctttttcttatttttcccccctttcccctttcttttttttttttccttt

SEQ ID NO: 16164 - DNA, 151 bp, Homo sapiens
  misc_feature 136: r=a or g
taaacgaaagcactccgtgctggaagtaggaggagagtcaggactcccaggacagagagtgcacaaactacccagcacagccccctccgccccctctggaggctgaagagggattccagcccctgccacccctcargaccaacgtcaaggc

SEQ ID NO: 16165 - DNA, 140 bp, Homo sapiens
aactttcctgccccttccccggccaagcccaactccggatctcgctctccaccggatctcacccgccacacccggacaggcggctggaggaggtcggaccctcccccaaatctgggcccccatctcccgcccaccacgca

SEQ ID NO: 16166 - DNA, 78 bp, Homo sapiens
cgcatttattttttgtttttgttgcaattgcttttggggatttagccaaaaactttttgtcaaggctaatgttgagaa

SEQ ID NO: 16167 - DNA, 84 bp, Homo sapiens
ttttgttttagacggagtttcgctctgttacccaggctgtagtgcaatggtgcaatctcggctcactgcaacctccacccccct

SEQ ID NO: 16168 - DNA, 207 bp, Homo sapiens
accagccttggaaaacctgtgttggtgccccataagcttccctgctttccgggagagagtgttcagactgtgggtagaaagaggacctttgacccctgatccttgctctcctaccatgaggagtcaccctcagtgaaggcttgctgctccctggctgtggagacagaggagcagaagagactcctcctgccctcgctggccccaaca

SEQ ID NO: 16169 - DNA, 198 bp, Homo sapiens
  misc_feature 184: b=c or g or t
  misc_feature 195: n=a, g, c or t
ctaaacatacaaaaattacccaggtgtggtggtgcgtggctgtaatcccagctactcgccaccatacctggctaatttctgtatttttagtgaagacagggtttcaccatgttggccaggccggtcttgaaatcctgacctgaagagagctgcccgcctcggcttcccaaagtgctgagattabaggcgtgagcnacc

SEQ ID NO: 16170 - DNA, 109 bp, Homo sapiens
caagtgataagacagctctttgagcctcacatctcaaccgtaaaatgaagataaaaataggaattactggccagacacgtggctcacgcccagccccatcctccacccg

SEQ ID NO: 16171 - DNA, 80 bp, Homo sapiens
cgggatggagaagaactcgggggaggggccgtgcggggaaagacccggagtctggaggtagaactcgggagaggggcctt

SEQ ID NO: 16172 - DNA, 120 bp, Homo sapiens
  misc_feature 64: s=g or c
gtacgtcatcggcgacggctcccgccggctgggcgtccggtggccggtgtagcagagcgagagsgaacgggcggcgagcagaggagctaacaggtgggggcacggcacgcgaacggaccc

SEQ ID NO: 16173 - DNA, 127 bp, Homo sapiens
aggtctgtgtcctggcctcccaggagcagggacgtgaggctcggccagggaaatctcatttgcagcagctcataagccctggcacaggctcttccctgagccaggctggccaaggctcccggagggt

SEQ ID NO: 16174 - DNA, 99 bp, Homo sapiens
ttggctcaccgcaacctctgcctcccgggtttaagcaattctcctgcctcagcctcccgagtagctgggattacaggcgcgcacgccacacctggcctg

SEQ ID NO: 16175 - DNA, 128 bp, Homo sapiens
aataccggtcctccattttggtgcctgcaaagctctgggaaagaatcccgggaaacgaaaaatgaaaaacaaccagaaaaaaaaaatctcatcatggcaaatattcaccaggaaaacgaagagatgga

SEQ ID NO: 16176 - DNA, 172 bp, Homo sapiens
agaattggctgggcgtggtggcgggcgcctgtggtcccagctacttgggaggctgaggtaggagagtggcgtgggcccgggaggtggagcttgcagtgagctgagatcccgccactgcactccagcctgtgcgacagggcaagactctgtctcaaaaaaaaaaaaaaaaaaa

SEQ ID NO: 16177 - DNA, 82 bp, Homo sapiens
  misc_feature 68: m=a or c
  misc_feature 73: n=a, g, c or t
  misc_feature 74: n=a, g, c or t
attccctccaccttcttcttctaacctcttatcccactgattcctttcttcttcctcccctcccctcmccctnncctcccct

SEQ ID NO: 16178 - DNA, 145 bp, Homo sapiens
  misc_feature 15: k=g or t
ttttttgagacggakcttgctctgttgcccaggctggagtgcagtggcgcaatctcggctcactgcaagctccacctcccaggttcacgtcattctcctgcctcagcctcccgagtagctgggactataggcgcccaccaccaca

SEQ ID NO: 16179 - DNA, 97 bp, Homo sapiens
attttaggtgttggatctcagggggaaaaaaaagagagagggagagagagagaaagaagagcaggaaagatcccgaaaggaggaagaggtggcgaag

SEQ ID NO: 16180 - DNA, 202 bp, Homo sapiens
taacaaacctgcccattcactaacatttgtacacatctgcttcattggttagatgggtgttgtggaagaagggtctatgtctggtttgattctatttggaaaaatgccatgtggaccagttgcaccagctgatggtgatgtttctttacatttattcagaaccttcccatttcagaggaaatgggttacttttgggggccat

SEQ ID NO: 16181 - DNA, 203 bp, Homo sapiens
cccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccgga

SEQ ID NO: 16182 - DNA, 117 bp, Homo sapiens
  misc_feature 88: k=g or t
tgagattaggagttcgagactggcctggcccgcgtggcgaaaccccgtctctactaaaaatacaaaattagctgggcatggtggtgcktacctgtggttccggctactcggcaggca

SEQ ID NO: 16183 - DNA, 255 bp, Homo sapiens
ctagtctgggtgcattggctcacgcctctaatcccaccactttaggaggccgaggcgggtggatacctggggccaggagttcgagaccagcctggccaacatggtgaaaccccatcactactaaacatacaaaaattagccgggtgtgatggcaagtgcttgtaatcccagctactcgggaggctgaggcaggagaatcgctttgaaaccggaaggcagaggagctaagatcgtgccactccactccagcctgag

SEQ ID NO: 16184 - DNA, 118 bp, Homo sapiens
tgaaccggcccaggtcggaaacggagcaggtcaaaactcccgtgctgatcagtagtgggatcgcgcctgtgaatagccactgcactccagcctgagcaacatagcgagaccccgttcc

SEQ ID NO: 16185 - DNA, 136 bp, Homo sapiens
actaaaaatttgaaaattagccgggtgtggtggtgagcacttgtaatcccagctacttgggaggctgaggcaggagacggagtttgcagtgagccaatactgcgccattgctcaggctggaaagcaatggcgcagt

SEQ ID NO: 16186 - DNA, 199 bp, Homo sapiens
ccacgaacccaccataaggaagaaactccagacacatctgaacatctgaaggagcaaactgtggacacaccatctttaagaactgtaacactcactgtgagagtctgcggcttcattcttgaagtcagcgagaccaagaacccaccaattccggacacagtggttttcccctgcagtcaggctgcccagcagtagctac

SEQ ID NO: 16187 - DNA, 198 bp, Homo sapiens
tttggccgggcgcggtggctcatgcctgtagtcccggcactttgggaggccgaggcgggtggatcatctgaggtcaggggtttgagaccagtctggccaatatggtgaaacctcatctctactaaaaatacaaaaattagccggacgtggtggtacgtgcctgtaatcccagctactcaggaggctgaggcagggggt

SEQ ID NO: 16188 - DNA, 112 bp, Homo sapiens
ggatgtgagggcgatctggctgcgacatctgtcaccccattgatcgccagggttgattcggctgatctggctggctaggcgggtgtccccttcctccctcaccgcccccccg

SEQ ID NO: 16189 - DNA, 67 bp, Homo sapiens
gccattgagattctgtactgtcatggaggaagacctagtgaaaagtgacgaatactttttttttttt

SEQ ID NO: 16190 - DNA, 152 bp, Homo sapiens
tattaattaccaaagggaaaagttattttttatttttttatgagacaaggtctcactctgtcacctaggctgaagtacagtgacaaaatcatagctaactgcagcctcgaccccctgggctcaagtgaccctccaaattcagccccccaggt

SEQ ID NO: 16191 - DNA, 131 bp, Homo sapiens
  misc_feature 68: s=g or c
gagtgaggaggaggaggaggagaaggaggaggaggaagaggaggagcgcagtcggagcgcggcggcasggcagaggcgccgcggcggggaccagcccagagagaccccccgagcccgcgcacaggcggcac

SEQ ID NO: 16192 - DNA, 215 bp, Homo sapiens
  misc_feature 36: r=a or g
attaggggagcccacggctacaaaaacaagtgagtragaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcc

SEQ ID NO: 16193 - DNA, 131 bp, Homo sapiens
  misc_feature 77: k=g or t
aagaggaagaagagtttgagattgccttggcagatgcctctgacaatgcccgcattggaagggtggcgacagccaakgtgctcattagtggtcccaacgatgcctcgactgtgtccctgggcaacacgggc

SEQ ID NO: 16194 - DNA, 141 bp, Homo sapiens
  misc_feature 51: r=a or g
ataacagtggtaataatacgttaaatttgaagagccttgggcacaacagtrcccttaccccacatatccttagggcagggtgatggaggtaaagacctggaatattgtggtgttcttgccgggattgaaacactgggtaca

SEQ ID NO: 16195 - DNA, 254 bp, Homo sapiens
  misc_feature 13: y=c or t
  misc_feature 14: r=a or g
  misc_feature 40: v=a or c or g
  misc_feature 47: r=a or g
  misc_feature 138: r=a or g
  misc_feature 139: k=g or t
  misc_feature 205: d=a or g or t
  misc_feature 206: w=a or t
  misc_feature 234: s=g or c
  misc_feature 252: n=a, g, c or t
ctaatcccagcgyrttggttgggaggccaaggtggggggvtcgcttraggccgggagttcaggaccagcttgacaacatagcaaaaccccatctctgtaaaaaaaaatgaaaataaaccaggcatgggtgtgtgcctrkaatcacagtcgcttgggaggctggagcaggaggattgcttgagcctaggaggtcaaagcggcagtdwgctgagattgcaccactgcactccagtstgggtgacagagtgaganct

SEQ ID NO: 16196 - DNA, 63 bp, Homo sapiens
  misc_feature 36: n=a, g, c or t
tttccggtggcgggacgcggggccgcgcacgcgggnaaaagcttccccggtgtccccccaaca

SEQ ID NO: 16197 - DNA, 131 bp, Homo sapiens
  misc_feature 14: r=a or g
agccactgcgcccragctggcctgcgagttcagggctcctgccgctctccaggagcaacctctactccggacgcacaggcattccccgcgcccctccagccctcgccgccctcgccaccgctcccggccgc

SEQ ID NO: 16198 - DNA, 164 bp, Homo sapiens
  misc_feature 14: w=a or t
  misc_feature 80: r=a or g
  misc_feature 143: n=a, g, c or t
  misc_feature 148: m=a or c
gaggagatccagcwgggcgaggacgaggacgaggacgagatggacctggagcccaacgaggttcggctggagcagcagarcgtgccagccgcagtgtttgggagcctgaaggaagactgacccgtccctcccccctccccacnccctmcccaatacagctacgt

SEQ ID NO: 16199 - DNA, 175 bp, Homo sapiens
agagggaggggtccggcgagagggagggaggtctctctatcgacctacagttctcattctgttttgccaagtgtacgccaagaaggacatggcgccgcgtaaaagcaggaacgacgtctcctgggctgaacaggagcacaaactgttctgaaagggttttttttttttttttttt

SEQ ID NO: 16200 - DNA, 105 bp, Homo sapiens
tgcctgtaatcccagcactttaggaggccaaggtgggaggattgcttgagcccaggagtttgagaccagcctaagcaacacagcaagatccactatgcccggcat

SEQ ID NO: 16201 - DNA, 102 bp, Homo sapiens
agcagaccctgaaagctgagctgccctgacccccaaagtgaggagaagctgcaagggaaaagggagggacagatcagggagaccggggaagaaggaggaatt

SEQ ID NO: 16202 - DNA, 164 bp, Homo sapiens
  misc_feature 73: r=a or g
  misc_feature 116: n=a, g, c or t
  misc_feature 120: m=a or c
tgcctgtggtcccagctgctcaggaggctgaggtaggagggtcactgaagcctgggaagtcaagactgcagtratctgtggtcgcaccactgcactccagccttggtgacagagtnagamcctgtctcaaaacaaaacaaaaacaccaaaatactctgagcaaa

SEQ ID NO: 16203 - DNA, 135 bp, Homo sapiens
cagaagggaatgagatcattaaggagccagcccttgaaaagggaggaggttggggtctagagaacaggtggtgagagacacattgacctaggcagagagagggatgactttcagtttaagatggaaaggagggta

SEQ ID NO: 16204 - DNA, 87 bp, Homo sapiens
tatgggcagtgaggcctgacgcggggggcggacgctggggccgagggtagcttgagcgcggcggcggcgttgttcagtcagagcacc

SEQ ID NO: 16205 - DNA, 135 bp, Homo sapiens
attttcttgggggcggcgcggacgactgaagggacttggtggtagaggctgcggaggcggcgaggttcactttggtcccggcaggggctctgaccgcgacccactgctcgctgccggggcttgttccgaggagga

SEQ ID NO: 16206 - DNA, 81 bp, Homo sapiens
tgctggacccatgaggatttattgaagaaggttagaagtgttttaggtaaatgactaaattttaaaggctttttttttttt

SEQ ID NO: 16207 - DNA, 90 bp, Homo sapiens
agcttgttagagctgagctgccctactacagcagctgccggcccctaggacagagcagggacctcaactacactgatcaccagccccatc

SEQ ID NO: 16208 - DNA, 100 bp, Homo sapiens
  misc_feature 38: m=a or c
ggatgtgagggcgatctggctgcgacatctgtcacccmttgatcgccagggttgattcggctgatctggctggctaggcgggtgtccccttcctccctga

SEQ ID NO: 16209 - DNA, 157 bp, Homo sapiens
  misc_feature 73: r=a or g
gggggcgtggccgtctctgagcgccgcgactctgggcttgcgcgcgcgggagtcaggggtcacggcggcgtargctgtggcgggaaacgctgtttgaagcgggtgagtagaggggaaaaagggagttcggggcagtgggcctggtagggaatggggc

SEQ ID NO: 16210 - DNA, 134 bp, Homo sapiens
attgtatttttagtagagttgggggttcgccatgttggccaggctggtcttgaactcctgaccttaagtgatccacctgcctgggcctcccaaagtgctgggattacaggcatgagccaccacacccggcccca

SEQ ID NO: 16211 - DNA, 165 bp, Homo sapiens
tgagctaaatctcagttaagattttgactgatgagaaaagggttcagacagtggggaaaagatgggctaggcaaggaaatcgctctgtgaatgaacacacagaggcttcaaaagacccttttggggaagagcaagcaaggcatggcaggagagaagaagggcaag

SEQ ID NO: 16212 - DNA, 100 bp, Homo sapiens
  misc_feature 13: m=a or c
  misc_feature 14: m=a or c
agaagcggcaggmmggcggcgcggcgcaggcaccggcccggggagaggcaccatgagcggatcacagaacaatgacaaaagacaatttctgctggagcgc

SEQ ID NO: 16213 - DNA, 103 bp, Homo sapiens
cccttttacagcccctcgctcccgacatgcgaggcccgtctcttcttccagtttgacttccaagtctttccattccctaggatcgggccccagtctcaccccc

SEQ ID NO: 16214 - DNA, 149 bp, Homo sapiens
  misc_feature 23: n=a, g, c or t
gagacacagccggaaaggctggncaggcaggagggctggggcgagcactggggggccatggagcgggcagaagagcccgtggtctatcagaagctgctgccctgggagccaagcttggagtcggaggaggaagtggaggaggaggcggc

SEQ ID NO: 16215 - DNA, 119 bp, Homo sapiens
aacatggtgaaaccccatctccactaaaaatacaaaaattagcctggaggtgttggggggcacagaggaagacaccggtagtcacctagcagggcaggcaaggcatgattgagggagtg

SEQ ID NO: 16216 - DNA, 172 bp, Homo sapiens
  misc_feature 8: m=a or c
tggtgaamcccgtcgctactaaaaatacaaaattagccgggcgtggtggctcatgcctataatcccagatacttgggaggctgaggcaggagagtcgcttgaacccggtaggcggaggttgcggtgagctaagatcgcaccattgcgctccagcctgagcaacaagagaggt

SEQ ID NO: 16217 - DNA, 161 bp, Homo sapiens
  misc_feature 7: s=g or c
gactttsagcgtccggcggtcgcagagccaggaggcggaggcgcgcgggccagcctgggccccagcccacaccttcaccaggtagggacgctcccctgctcagagggcggaaggtgtagacagagaagaaacagggggagggggcaggtagaggaaccaca

SEQ ID NO: 16218 - DNA, 147 bp, Homo sapiens
gtcaacatcagagaggttgtgatgacagagcaagacagcggtgatgtgaagactcaacgtgccattcttggctttcaagagggaagagccaaaagtttgaagggccctaggagctagaaagtatagaaacaattatcccccagagcc

SEQ ID NO: 16219 - DNA, 289 bp, Homo sapiens
  misc_feature 178: v=a or c or g
ggggatgtagctcagagagggtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcgggvagcatttgacagtaaattcgagtgatgcgagggggacctgaactgtggcctctgtcatgggaacccagaggaggtcgatggcgtttgtggttgatgtgggaaggagagaca

SEQ ID NO: 16220 - DNA, 250 bp, Homo sapiens
aaaaaacacatgcactgaagagctttgggtggctgagccccaggtatttgcttatcacctgttaatgaccacataccccataggcatccaccacgaaggggctcttggggcacctgagagttgaaattaagttagtgaagatgcctgcgctgggtgtgaggaacaagtggaaattacagttctgaaaaggcacttggaaagcagggagcagaataccagtatctgatgggttttgtttgttgggagagat

SEQ ID NO: 16221 - DNA, 148 bp, Homo sapiens
tttctttttgagacagtctcgctctgtcgcccaggctggagtgcagtggtgcgaacttagctcgctgcagcctctgcctcctgagtatctaggattacaggcacccaccatcatgcctggcaaatttttttttttttttttttttttt

SEQ ID NO: 16222 - DNA, 187 bp, Homo sapiens
agtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcat

SEQ ID NO: 16223 - DNA, 202 bp, Homo sapiens
atttttttgagatggagtcttgctctgtcgcccaggctggagtgcagtggcatgatctcagctcactgcaatgtctgccttccgggttcaagcagttccctgcctcagccttgtgagtagctgggattataggccctgccaccatgtgtggctaatttttgtgtttttagtagaggcagggtttcaccatattgtccaggcc

SEQ ID NO: 16224 - DNA, 192 bp, Homo sapiens
ctggccttggcctcccaaagtgcttggattacaggtgtgagccacagctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaa

SEQ ID NO: 16225 - DNA, 121 bp, Homo sapiens
tttttaaatctttcttttagacagggcctcgctatgttacccaggcccagtgtctgccacttgcttgttttcttgtctgaaactcttggcttcaagtgattgatcctcccaccccagccct

SEQ ID NO: 16226 - DNA, 142 bp, Homo sapiens
  misc_feature 7: m=a or c
  misc_feature 8: s=g or c
tttgggmsggagtcttgctctgtcgcccaggctggagtgcggtggcacggtctcggctcgctgcaatctccgcctcccgggttcaagtgattcttctgcctcagcctcccaagtatctgggattacaggcgcgcaccaccac

SEQ ID NO: 16227 - DNA, 134 bp, Homo sapiens
  misc_feature 30: s=g or c
acacgccccaggcgcgctggattggcggasatggcccaggaggagggtgggagcctgcccgaggtgcgggcgcgggtcagggccgcgcatggcatccccgacctggcccaaaagctccatttctataaccgctc

SEQ ID NO: 16228 - DNA, 137 bp, Homo sapiens
  misc_feature 9: s=g or c
  misc_feature 10: s=g or c
  misc_feature 79: s=g or c
aagaacgcssgagagtcgccgcctggccgggcgtagacgcggtggcagagcccgcgcggcgctggaaggagtggcggasggcgggacctcggcggactcgccatggaggaggagggtgtgaaggaagccggtgagtt

SEQ ID NO: 16229 - DNA, 89 bp, Homo sapiens
cagctaatttttgtattattagtagagatgggatttcaccatgctggccaggctggtctcgaattcctgaccttgtgatccacccgctc

SEQ ID NO: 16230 - DNA, 100 bp, Homo sapiens
  misc_feature 7: h=a or c or t
  misc_feature 95: s=g or c
  misc_feature 100: r=a or g
attttghtcgcggacgctggggacggtgggagcagatccatttccgggttggcaaaaggggcggtggcggcggcggcggcggcggcggcggcgasccggr

SEQ ID NO: 16231 - DNA, 343 bp, Homo sapiens
  misc_feature 123: m=a or c
  misc_feature 194: b=c or g or t
  misc_feature 278: k=g or t
  misc_feature 298: v=a or c or g
  misc_feature 315: m=a or c
  misc_feature 332: y=c or t
aaaaaattagctgggtgtgatggcacacacctgttgtcccagctactcaagaagctgagatgggaggatcctgagctcaggaggtcaaggctgcagtgagccgagattgtgccactgcactgmagctggggtgacagtgcaagaccctgtctcaaaccaaaccaaaccacacacacacaaacgacaagcccgtbgtagtggcaagtgtctgtaatcttagccactcgggaggctgaggcaggagaattgctggaacccgggaggcagaggtggcagtkagccgagattgcaccactgvactccagcccagttgamaacagcatgactctgtytcccccaaaaa

SEQ ID NO: 16232 - DNA, 66 bp, Homo sapiens
agttggtcggtgggccagtggccgtcgctcgcttctgggctctcatgtttgaaggtgggaggcaag

SEQ ID NO: 16233 - DNA, 114 bp, Homo sapiens
cctagcagaaaaagaaaagaaaagaaagaaagaagggtcaagaatatccttggtaaataaatccaaggtaaattataagaatctctaattagacatatttaatagtaaccaaaa

SEQ ID NO: 16234 - DNA, 148 bp, Homo sapiens
actccagcctgacgcatggctcacgcctgtaatcccagcactttgggaggccaaggtggcaggattgcctgagtccaggagttcgagaccaacctggacagcatggtgaaacctcgtccctgcaaaaaatacaaaaattagccagaaa

SEQ ID NO: 16235 - DNA, 82 bp, Homo sapiens
  misc_feature 16: s=g or c
  misc_feature 17: r=a or g
gccgggcgcggtggcsrtgcctgtagtcccagctactcgggaggctgaggtgggactacaggcgcctgccaccacgccaaac

SEQ ID NO: 16236 - DNA, 182 bp, Homo sapiens
acacactaccggttccagcgtttgcacaggggcacctggacacgatgctcccgcggctagggctggctctcggcatccactaagttcaactgcacccctgaattaagcaaacacactaaggagggcagccctgcaccgcccaaacacgccggcccgggcctcgcccccagcggcagcaggat

SEQ ID NO: 16237 - DNA, 109 bp, Homo sapiens
ggatgtgagggcgatctggctgcgacatctgtcaccccattgatcgccagggttgattcggctgatctggctggctaggcgggtgtccccttcctccctcaccgctcac

SEQ ID NO: 16238 - DNA, 108 bp, Homo sapiens
ggatgtgagggcgatctggctgcgacatctgtcaccccattgatcgccagggttgattcggctgatctggctggctaggcgggtgtccccttcctccctcaccgctat

SEQ ID NO: 16239 - DNA, 142 bp, Homo sapiens
aaagaaaaagaagaagaaaaagaggaagaagaagaaggaggaggaggaggaggaggaggagggggccgagaagagcagctcacccttcgcagccgcgatgggggaagacgacgccgcgcttcgggctggcagcagggagcgc

SEQ ID NO: 16240 - DNA, 165 bp, Homo sapiens
  misc_feature 14: m=a or c
  misc_feature 160: r=a or g
cagagagttatgtmttcaaggagcttcatggaaagaatgaagtctgacaagtacgggtttctaataactttgagttcacactattgaactaaatttccaaaactcggccaggcacagtggctcaagcctgtaatcccagcactctgggaggccgaggtargcgga

SEQ ID NO: 16241 - DNA, 153 bp, Homo sapiens
  misc_feature 38: r=a or g
  misc_feature 77: d=a or g or t
  misc_feature 99: r=a or g
  misc_feature 117: s=g or c
agtgggaggcgcgcgcgagaggccgcgacggacgcaaratggcgacggcgaccatagctctccaggtcaatggccadcaaggaggggggtccgagccgrcggcggccggcggcagtsgtggcagcgggagacaaatggaaacctccacagggc

SEQ ID NO: 16242 - DNA, 177 bp, Homo sapiens
  misc_feature 17: k=g or t
  misc_feature 57: w=a or t
  misc_feature 58: r=a or g
tacaggccggacgcggkggctcacacctgtaatcccagcactttgagaggccaaggwrggcggatcacgaggtcaggagattgagaccaccctggccaacatggtgaaacctcgtctctactaaaaatacaaaaattacaggccggacgcggtggctcacacctgtaatcccagcac

SEQ ID NO: 16243 - DNA, 163 bp, Homo sapiens
ttgaaagcgtgcatactgggagtgagtgcccagaaaatggaattcctgctttctaggaaacgttgtgagggttagcaaggaaagagatacaaaatttagtgaaaatttagagtcatgttaaaaagtgtttgggaaggggagagaattgaaaataatcaagaat

SEQ ID NO: 16244 - DNA, 110 bp, Homo sapiens
tccagcaagtgcaaaggccctgaggtgagagacagcatggaggcagcagtgaggaacctggtgtagcttcctcactgaatgaatggggaaggctttgattaggcaagctt

SEQ ID NO: 16245 - DNA, 160 bp, Homo sapiens
aaaaaagcgggtcctgctagccccgcggctccgaactcggtggtcctggaagctccgcaggatgggggagaagatggcggaagaggagaggttccccaatacaactcatgagggtttcaatgtcaccctccacaccaccctggttgtcacgacgaaacaa

SEQ ID NO: 16246 - DNA, 93 bp, Homo sapiens
gaggccaggagttcgggaccagtctggccaacatgatgaaaccccgtctctactaaaaatacaaaaattagccaggaatggtggcagagcacc

SEQ ID NO: 16247 - DNA, 138 bp, Homo sapiens
aaatgtacaaggatgagcatggtggctcatgcctataatcctagcactttgggaggctgaggcaggcgggtcatctgacatcaggagtttgagaccggcttggccaacatggtgaaatcctgtctgtactgaaaatgc

SEQ ID NO: 16248 - DNA, 281 bp, Homo sapiens
  misc_feature 204: m=a or c
ctaccaaggaagaaggatgatcacttgagcctggggcatcgaggctgcagtgagccatgattatgtcactgcactccagcctcggtgacagagtgggaccctctcaaaaaaagttgggacttggccggacacagtggctcacgcctgtaatcccagcactttgggaggccaaggcgggtggatcacggggtcgggagatggagmcatcctggctaacatggtgaatgaagccccatctctagtaaagatacaaaggatttgcccggtgtggtggtgggcgc

SEQ ID NO: 16249 - DNA, 197 bp, Homo sapiens
gggaatacaaaaacttagcctggcgtggtggcagctgtctgtgatcccagctactagggaggctgaggcaggagaattgcttgaacctgggaggcggaggttatagtgagctgagatcgtgccactgctttctagcctggatgacagagcgagactctgtcaacaacaacaataaaaaaaaaacaaaaacacacacc

SEQ ID NO: 16250 - DNA, 306 bp, Homo sapiens
  misc_feature 250: k=g or t
  misc_feature 251: r=a or g
atacgctgggcgttgtggcttgcgcctgtgatcccaccactttgggaggccaaggtgggcggatcacttgaggtcaggagttcaagaccagcctggccggcatggtggaaccccatctctactaaaaatgcagaaattggctgggcgtggtggcggatgcctgtgatcccagctgcttgggaggctgaggcgggagagtcgcttgaacctgggaggcggagattgcagtgagccgatctcgtgccactgkrctccagcctgggtgacagcatgagactctgtcacacacacacacacacacacacc

SEQ ID NO: 16251 - DNA, 207 bp, Homo sapiens
atgtaaaaattagctgggtgtggtggtgtgcacctgtaatcccagctactcgggaagctgaggcacgagagtcgcttgaacctgagaagcagaggttgcagtgagccaagatcatgcccctgcattctagcctgggcgacagagcgaacctctgtctcaaaaaaatgaaaaaattaaacttgaatgaataatgaaaaaaaaagggac

SEQ ID NO: 16252 - DNA, 162 bp, Homo sapiens
  misc_feature 31: n=a, g, c or t
  misc_feature 33: r=a or g
ccgtaatccctgcactgtgggaggccgaggngrgcggatcacctgaggttaggagttctagaccaccctggccaacatggtgaaaccccgtctctactaaaaatacaaaaattagctgggtttggtggtgcgtgcctgtaatcccagcactttggaaggcca

SEQ ID NO: 16253 - DNA, 270 bp, Homo sapiens
  misc_feature 241: s=g or c
aacaggtacgggccagcattgggacaggctttgcctgtaagagggctggtctggggggacatctgaacccaattcaggaacacctcacaggtctgccagcagggctagacccggggtgagatccagggcaacagggtctgcctgggaagctcagctccggcactgcctggggcgtctctgcctacacaggaccattcctctcgcctggactcctcttggagtttgccaaggctggcctctscagaaataggagactcctggaggaagagg

SEQ ID NO: 16254 - DNA, 329 bp, Homo sapiens
  misc_feature 7: s=g or c
  misc_feature 8: v=a or c or g
  misc_feature 33: s=g or c
cctgggsvtgctgctgctggacgtcatcatctscctcctggtgctggttggcctcatccgcagctccaagggcatcctggtggggtgagtctgggggtgtcggccccccgtgggcccaaagcggaggggcagggcaaggcaccatgttaccccttcccccacctcatctgcagatcctagccacaagctctgcggtgggggctgagcgggacccccctgcactgggcctgctctgagatgccccttctgtgcctgtggcctgtgcccctgtggccagcatcccagcacacttgcccccagccttgatttcctgcaagagtctgcacgtg

SEQ ID NO: 16255 - DNA, 124 bp, Homo sapiens
  misc_feature 7: n=a, g, c or t
  misc_feature 8: m=a or c
tgttgtnmaggctggagtgcagtggcgctatcttggctcactgcaacctccaccttctgggttcaagtgattctcctgcctcagcctcctcagtagctgggattacaggcaagtaccaccactc

SEQ ID NO: 16256 - DNA, 124 bp, Homo sapiens
  misc_feature 7: n=a, g, c or t
tgttgtncaggctggagtgcagtggcgctatcttggctcactgcaacctccaccttctgggttcaagtgattctcctgcctcagcctcctcagtagctgggattacaggcaagtaccaccactc

SEQ ID NO: 16257 - DNA, 136 bp, Homo sapiens
  misc_feature 8: n=a, g, c or t
  misc_feature 9: n=a, g, c or t
  misc_feature 10: s=g or c
aaattcannscacagggcagggagtagacctggctaggagacaggaagtcagatgacaatcctacaatggcaggaaggcctgagaggaattcaaataggaaaaaaagagaactcgtttcagagctggttggcaacc

SEQ ID NO: 16258 - DNA, 129 bp, Homo sapiens
  misc_feature 30: r=a or g
  misc_feature 119: s=g or c
gttagccgggcttggtggtgcatgcctgtrataccagctactcgggaggctgaggcaggagaactgcttgaacctgggaggcagaggttgcggtgagccgaggtcgcgccattgcactscagcctggga

SEQ ID NO: 16259 - DNA, 101 bp, Homo sapiens
  misc_feature 74: r=a or g
caaaaatacaaaaattagccgggtgtggtggcatgcatctgtagtcccagctacttgggaggctaaggcaagaraattgcttgaacccaggaggcggaggt

SEQ ID NO: 16260 - DNA, 93 bp, Homo sapiens
  misc_feature 13: w=a or t
gacagtttggatwtcaggtcagtgcttcacaaattctcctactgccaggacccaagaattagtccagccatcggtattagcaccaccatcccc

SEQ ID NO: 16261 - DNA, 183 bp, Homo sapiens
  misc_feature 104: s=g or c
ctactaaaaatacagagaattagctgggcgtggtggcgggtgcctgtggtcccagctactcggcaggctgaggcaggagaatggcgtgaacctgggaggcggasttgcagtgagctgagatcgcgccgctgcactccagcctgggcgacagggcgagactccgtctcaaaaaaaaaaaaaaaa

SEQ ID NO: 16262 - DNA, 57 bp, Homo sapiens
tgcaaaaattagctgggcatgatggcatgtgcatgtaatcctaggtactcaggaggc

SEQ ID NO: 16263 - DNA, 217 bp, Homo sapiens
  misc_feature 65: r=a or g
  misc_feature 184: s=g or c
  misc_feature 187: m=a or c
atcccagctactcaggaggctgaagcaagagaatcgtttgaacccggggggtggagattgcagtragccgagatcgcaccactgcactcccgcctgggcgacagagtgagactccatctcaaaaaaacacacacacacacacaaaaaaaaaaggaaaaagaaagggccgagcgtggtggctcasgcmagtaacaccaacgcttcgggaggccgaggt

SEQ ID NO: 16264 - DNA, 65 bp, Homo sapiens
  misc_feature 24: r=a or g
  misc_feature 46: r=a or g
  misc_feature 47: r=a or g
actccagtctgggcaatgagagtrgaactgtgtctcaaaaaaagarraaaaaacctacccaaccc

SEQ ID NO: 16265 - DNA, 172 bp, Homo sapiens
  misc_feature 54: r=a or g
aattcaattcatttaaatgtaattataggctgggcatggtggttcaagcctgtratcctagcactttgggaggcctaggcaggtggatcacctgaggctaggagttggagaccagcctggccaacatggtgaaactccatctctactaaaaatataaaaattagctgggcac

SEQ ID NO: 16266 - DNA, 79 bp, Homo sapiens
  misc_feature 62: n=a, g, c or t
cctgacctcaagtgatccacctgcctcggcctcccaaagtgctgggattacaggcgtgagcnacggcacccaggctact

SEQ ID NO: 16267 - DNA, 124 bp, Homo sapiens
gccaggatgaagaagggaatggccgccagcgggaacttgtcgatggcggtgaacatctccttgggagccaggatgagcttgtcggcttcgtagatcgccatgccgagcatggccgcaccgcctc

SEQ ID NO: 16268 - DNA, 191 bp, Homo sapiens
aagtgagctagccgcctgccggccgacaggtttggaatctccagccagaggacagaaaacctgcatgggtcaggtgagcgggctctggccgagggcagccgggcagggggcagcagggtgcggcagcttgcccaccggaacctcccagggtgcacctcaggggggctgcctacctgaagggaagtgagctc

SEQ ID NO: 16269 - DNA, 191 bp, Homo sapiens
  misc_feature 87: s=g or c
  misc_feature 123: s=g or c
agttgtgaccattgcttgaaacccattcctatggcacgcacgaagcaaacagctcgtaagtccactggcggcaaagccccgcgcaasagctggccactaaggcggctcgcaaaagcgcgccascaccggtggcgtgaagaagccccaccgctacaggcctggtactgtcgccctccgtgaaatccgccagc

SEQ ID NO: 16270 - DNA, 175 bp, Homo sapiens
tggttcaatgaggtcattaggttgggccctaatccagtaggactggggttcttacaagaagaggaaatttgtacccaaacatcctcagagggaaggccacgtgaagacaccgggagaaggcagccacctgcaagcagaggagagaggcctcagaagaaaccaaccctaccagccg

SEQ ID NO: 16271 - DNA, 120 bp, Homo sapiens
  misc_feature 9: k=g or t
  misc_feature 72: s=g or c
ttccctctkgttgcccaggctgggtgatccacctgcctcggcctcccaaagtgctgggattacacgcgtgascactgtgcccagcctctctgttttatttcttctttttttttttttttt

SEQ ID NO: 16272 - DNA, 141 bp, Homo sapiens
ctgaagaaaatatcaatttttaattgacaaagactttatatcttagtgattttagttttgtttctctttatttggcaacattttcatctgaattgtatagatatatgattttctagtgagtgtatgttaggaacaaaagaa

SEQ ID NO: 16273 - DNA, 189 bp, Homo sapiens
  misc_feature 32: m=a or c
  misc_feature 33: r=a or g
agtcgcggttgctcagcgtgcacctgagaccmracgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccac

SEQ ID NO: 16274 - DNA, 145 bp, Homo sapiens
taggagatttttttgagagggtcccactctgctgcccaggctggagtgcagtgtacacaatctcagctcactgcaacctcgacctttcaggctcaagcagtcctcctgcctcagccttccaagtagccgggactacaggtatgcc

SEQ ID NO: 16275 - DNA, 163 bp, Homo sapiens
attctactaacatttgaactctgtaaggtggcttccagaaaagactctgggaatgtgatttgtaaacaacaccatgggtctgaagtcatttttaaagttgtattttcattgaatagtggtaacttctggtagctctgcaagagtgaccttgttagtagacgat

SEQ ID NO: 16276 - DNA, 198 bp, Homo sapiens
  misc_feature 8: n=a, g, c or t
  misc_feature 9: k=g or t
aaggaagnkggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctgg

SEQ ID NO: 16277 - DNA, 173 bp, Homo sapiens
aaagggaagaggaaggagcagaggacagggttccaatcagaatgaaatgaacagtatctgtttaaaggtgagtaagcctacgacagtagacccaatgggggaatataccacaaggctccagaaatactataggccctatcaagaaaatgctctcaagggcctatagtatttct

SEQ ID NO: 16278 - DNA, 116 bp, Homo sapiens
  misc_feature 32: h=a or c or t
  misc_feature 33: r=a or g
tcaacccgagtggaatgcaaggcaatggaathraatggaaaggaatggaatggaatcaactcgattgcaatggaatggaatggaatggaatggaatggaatggaattaaccggaat

SEQ ID NO: 16279 - DNA, 88 bp, Homo sapiens
tgtccctgacctgggtagagtggcatctggttggtgatgcccatctcatatcagccagggacaaagcaactccttgttcatcccagga

SEQ ID NO: 16280 - DNA, 140 bp, Homo sapiens
atcagcaggctccagttgaacactagtctgtgtaactttaaacatctagcagtaaatacttgcagttgtgatataaaggaccctgtttctgtagaaaagaaaacatttaacataatggttgtgaaatgtaacatgaagca

SEQ ID NO: 16281 - DNA, 98 bp, Homo sapiens
agcactctctcacttctggccagggaacgtggaaggcgcaccgacagggatccggccagggagggcgagtgaaagaaggaaatcagaaaggaagggct

SEQ ID NO: 16282 - DNA, 167 bp, Homo sapiens
gcagtgggaagcacctctcccattcacgccgggcaggacacctggccgggcgggggaggcagcgcaagggccggccggggagtacgggactcgagccggggacctgaggcaggagcaagcatcgtcgcagggcaaccagcagaacggagagggaggcgcgggggcta

SEQ ID NO: 16283 - DNA, 91 bp, Homo sapiens
gaaccgatccggattaaggggccggagggggtcctgggcaccagcggttccgacccccccgccctccgcgccgcacccgagtggcccacca

SEQ ID NO: 16284 - DNA, 143 bp, Homo sapiens
  misc_feature 12: y=c or t
  misc_feature 13: w=a or t
  misc_feature 54: r=a or g
ttgctatcacaywaaaaagaattaacaggccaggcgcggtggctcacgcctgtratcccagcactttgggaggctgaggtgggcggattacctgaggtcaggagttcgagaccagcctggctggcatggtgaaaccccgttta

SEQ ID NO: 16285 - DNA, 295 bp, Homo sapiens
  misc_feature 15: r=a or g
  misc_feature 50: r=a or g
tggcaaagccaaaaraaactcaagttgcaagaacaaaacccagtgactcrttttgatggttcaaaatggtttcctttatggaagtcacttcataaattgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacc

SEQ ID NO: 16286 - DNA, 175 bp, Homo sapiens
  misc_feature 12: y=c or t
  misc_feature 13: y=c or t
aacttgcggaayyagaggacctaaaaagtctgctttgctaaggttattttctaattgaacacttttttatgtacagggtatttgttgagttcactgtttgtcaatggacataatctgaatctaaaacaaaactaaatgaaacgccctaaccctgcttcccctcaaaccaaaccaa

SEQ ID NO: 16287 - DNA, 162 bp, Homo sapiens
  misc_feature 87: r=a or g
  misc_feature 88: k=g or t
  misc_feature 143: n=a, g, c or t
tcagggatggaatggaatggaatggaatggaatggaatggaatggaatggaatcaacccgagtgcaatggaatggagtggaatggarkggaatggaatggaacaacccgaatggaatggaatgtaatggagagtaagggagtngaatagaatcaatccgaat

SEQ ID NO: 16288 - DNA, 86 bp, Homo sapiens
attagagaaagaaagggagtgagggaggagagatgagtggctattccagaacgacataaagaatttccagccttggacggacacgt

SEQ ID NO: 16289 - DNA, 135 bp, Homo sapiens
ttttgtttatttgtgtattagtcgtaggcattatttatcgactcttctctctgaaagatgaaaggttagctctctttcacattcttaactgcccttttttcttaccttgtccatgtatttctaaccccctttctt

SEQ ID NO: 16290 - DNA, 65 bp, Homo sapiens
tgaacatctgccaccctgggtggtcttgggagtcttgcgcagttttaggaatctttttttttttt

SEQ ID NO: 16291 - DNA, 87 bp, Homo sapiens
gatcgtctggctcaactacgccgcctggctgcacatgcggctgatgaaggggttgcgcggcacggtcgccgcgtggtgggccctggt

SEQ ID NO: 16292 - DNA, 139 bp, Homo sapiens
ggaggatggggaaggcaggccagggcccggagtgggtgaagacttctcaggactaggccaggacagtgcccatccctgcagaagcccagtggccaattgaggcaggaggagctccagacaacagcatgtgagacaggcc

SEQ ID NO: 16293 - DNA, 91 bp, Homo sapiens
attttttcagtggctgtgaataagctaagaatggtaatgcagtttcaggggttagaaaatccaattcaaattagtcctcactgcagctgta

SEQ ID NO: 16294 - DNA, 163 bp, Homo sapiens
ctgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggtttttttttttt

SEQ ID NO: 16295 - DNA, 100 bp, Homo sapiens
gagatggtcttgctctgtcgcccagtctggagtgcagtggctcgatctcggctcactgcaacttctgccttctgggttcaggtgattctcctgcctcagc

SEQ ID NO: 16296 - DNA, 160 bp, Homo sapiens
attaatatattcaattatattttttttctagagttacaaaactttcaaatatgtgatttacctcccacataaccacaggtgactgctatcgaatgttttgccactccctatcttgttttacagtaaacagtaatgttttttcttgccactcactgccaat

SEQ ID NO: 16297 - DNA, 287 bp, Homo sapiens
cttagtggccgggcacagtggctcatgcctgtaatcccagcactttggggggccaaggtgtggtggcatctacctgtagtcccaggtactcgaggcaggagaattgcttgaacctgggagacggaggttgcagtgagctgagactacgccactgcattctagcctgaacgacagagtcagactcgaatgcagtggcgtagtctcagctcactgcagcctccacctcctgggttcaagcggttctcctgcctcggcctcctgagtagctgggattacaggcgcacaca

SEQ ID NO: 16298 - DNA, 62 bp, Homo sapiens
aattcacagttgaaattcttaatctttttatgttttccctctttttttcttttttttttttt

SEQ ID NO: 16299 - DNA, 71 bp, Homo sapiens
aatccgattggattactatggaaaaagcaacttgcctgttctgtttctttgcatactttgtgacctaaccg

SEQ ID NO: 16300 - DNA, 86 bp, Homo sapiens
  misc_feature 56: s=g or c
  misc_feature 57: y=c or t
tgacctcgtgatccacccgcttcggcctcccaaagtgctgggattccaggcgtgasyaccgcgcccggcatgctctgaccacctga

SEQ ID NO: 16301 - DNA, 211 bp, Homo sapiens
taaagagaataaaatacctaggaatacatcttacaagggatgtgaaggacctcttcaaggagaactacaaaccactgctcatggaaataagagaggacacaaacaaatggaaaaacattccatgctcatgggtaggaagaatcaatattgtgaaaatggccatactgcccaaagtaatttatagattcgatgctgtccccatgaagctccc

SEQ ID NO: 16302 - DNA, 76 bp, Homo sapiens
tttcttagtattaagttctatttttaatgagctatggtccaagagtatggcagtataatttcaggttttttttttt

SEQ ID NO: 16303 - DNA, 110 bp, Homo sapiens
ggcagaggttgccatgagccaagatcatgccactgcactacagcctgggcaacagagcgagactcctgcctcagccttatgagtagctgggattataggcacgtgcccac

SEQ ID NO: 16304 - DNA, 129 bp, Homo sapiens
ataaaaaaattgttgtttactatggaattagtattacattttgaggtaaacaaaagaatttgtattgcttgataaatattagcttgtaaatttaaagtttctttacttcaattaacttaaaggaccaag

SEQ ID NO: 16305 - DNA, 137 bp, Homo sapiens
tctatttttagtagaggcagagttttgcaatgttggccagggtggtcttaaactcctgacctcaagtgatctgcccaccttggcctatcaaagtactgggattgcaggcatcagccactgtgcccggccgccaccat

SEQ ID NO: 16306 - DNA, 132 bp, Homo sapiens
tctggctgggtgtggtggctcaaacctgtaatcccagaactttgggagaccaaggctgcagtgagctgtgattgcaccactgcactccagcctgaatgacagagcaggaccgtgtctcaaaaaaaaaaaaaa

SEQ ID NO: 16307 - DNA, 182 bp, Homo sapiens
  misc_feature 6: w=a or t
cgagtwtgtaagtagtgttggaagtaaatggttatgtcttcaggggaagttatttgaaatatcacacattagtgcccaagcattttcttgtgcattttgagtctcctaaaccatccctgacagtgtctactgagctgaaggacagtattttgactgatgtttgggcagttctccggtcccta

SEQ ID NO: 16308 - DNA, 139 bp, Homo sapiens
  misc_feature 66: w=a or t
  misc_feature 73: k=g or t
  misc_feature 75: m=a or c
  misc_feature 90: w=a or t
  misc_feature 118: r=a or g
  misc_feature 129: s=g or c
  misc_feature 131: m=a or c
  misc_feature 138: m=a or c
accagtaagcccttgaagggtttcgtgtgagctcgatttttttgtgcctgattttttttttttttwaactttkgmatactttgttttgawagtctgaggctgggcctctgcctttgtraagttgaagascmagggtgma

SEQ ID NO: 16309 - DNA, 79 bp, Homo sapiens
ggatgtgagggcgatctggctgcgacatctgtcaccccattgatcgccagggttgattcggctgatctggctggctcaa

SEQ ID NO: 16310 - DNA, 175 bp, Homo sapiens
cagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgtggg

SEQ ID NO: 16311 - DNA, 176 bp, Homo sapiens
  misc_feature 156: k=g or t
attattagatttagatttttggtcaagattcagagtgtttctctctctctcccattccctctctccttttttaacttatttttgcaagactgcttcatataatagatgttgttttccatcagagatactgattatctctctgtgatgtcagcagckactaattatcagcacccgaa

SEQ ID NO: 16312 - DNA, 107 bp, Homo sapiens
agaaatcttactgtgattaaaatgtgcctgataagcatttttccttaagtaccacaatttatgctttaatatcttcactagtctctgaaattttagaatgacaccct

SEQ ID NO: 16313 - DNA, 58 bp, Homo sapiens
  misc_feature 12: s=g or c
  misc_feature 15: n=a, g, c or t
  misc_feature 43: h=a or c or t
agacggcgacasagncggcggcgagcgcctcggagcgcggcghaacagcgccccccga

SEQ ID NO: 16314 - DNA, 157 bp, Homo sapiens
  misc_feature 74: m=a or c
  misc_feature 75: m=a or c
tggaatggaatggaatggaatggaatcaactcgattggaatggaatggaatggaatggaatggaatggaatggmmttaacccgaatagaatggaatggaatggaatggaacggaatggaatggaatggaatggaatggaatggaatcaacccgactt

SEQ ID NO: 16315 - DNA, 151 bp, Homo sapiens
  misc_feature 40: y=c or t
tctggttatgtcaagtggaatatttctggctttgggggayccagctctttttttctctctcactctgagtatttagaggcttttattgctatttttctaaaaggcaacattagtaatcaactttgccaaaaatttcatatgaacggtggga

SEQ ID NO: 16316 - DNA, 176 bp, Homo sapiens
  misc_feature 38: n=a, g, c or t
  misc_feature 112: s=g or c
gtagtctgcgagaatgcaggaaggcggcagtgaagcgntcggtcggcggggccgcggcaaagtggggaggaaactcatcccgggcaggcgtcagggtggctggagagcgcasacgcgcgaacagaacgggggcaggcgacaggaaaacgtgtgagcgcgcggctgaaagcgactgg

SEQ ID NO: 16317 - DNA, 189 bp, Homo sapiens
aaggagaaggaggaggtcgtccctgatggcccctggaggcgaagtcatcacaggatgaggaaaggacagaggcacagagaacccccaagaggagatggggctctgggagacggccaaggcctcggccattctctgactacggccagctggccagccgcagtttgtctattcctgaagactcggttgcat

SEQ ID NO: 16318 - DNA, 59 bp, Homo sapiens
atcttctaattaagaaaaataacttctagttaatttatttcaaggggaagcagtgggac

SEQ ID NO: 16319 - DNA, 88 bp, Homo sapiens
tttatattggaaatactgtgaatggaaaattgccaaatcccttcttagtatattttaagcaccctacaacactttacctccctgccga

SEQ ID NO: 16320 - DNA, 78 bp, Homo sapiens
  misc_feature 44: k=g or t
cgaaaaatttgccactacatgtttcttctgaatatgtgtgtgtkcctaggagtgttactgctacttgcttaagggaga

SEQ ID NO: 16321 - DNA, 119 bp, Homo sapiens
atctaaaattagaactgtgggaaaaggattatatgcaacaaaatgcaaaagattaatgtggaggcatgatgcctaacgattggatacccttaaaatattaatctacatcaggcacagcc

SEQ ID NO: 16322 - DNA, 243 bp, Homo sapiens
  misc_feature 17: w=a or t
  misc_feature 20: w=a or t
  misc_feature 29: w=a or t
  misc_feature 124: r=a or g
caatttttggcagcggwgtwaagacagtwtattggcaaaagagtaggtttttccacaggtgatgctgggacaactgaatatccacatgaaaagaatgaagttggaaccttatcttatgtcataracaaaaataactcaaaatggatcaaaaacctaaacttcaaaactcttagggaaaaaaatagatatgtcttggattccagaatgatttcttaaatatgacaccaaaagcacaagcaactt

SEQ ID NO: 16323 - DNA, 131 bp, Homo sapiens
tattaatatcaggtaaaatagattgcaacagaaaaattttgtatcaggtaatgtggattcttcatagtaacaaaagttcatcaggaggacatatcaatcataagtgtatatttatttaatgcagaatgaca

SEQ ID NO: 16324 - DNA, 145 bp, Homo sapiens
  misc_feature 32: s=g or c
  misc_feature 33: k=g or t
aggacttcaacatggcggctgcggcactggcsktggctacggtgacggcctggcccggagcgggcagagttggaggtggtggcgttcgctctccctaggggctgtcgggagctcagcggggaccgagcctgggaggccggccgaa

SEQ ID NO: 16325 - DNA, 108 bp, Homo sapiens
gggactctgtctctacaaaaaatctaaaaattagctgggtgcagtggcgcgcgcctgtggtcctagctactcgggaggctgaagttgggaggattgcttgagctgggg

SEQ ID NO: 16326 - DNA, 93 bp, Homo sapiens
  misc_feature 37: k=g or t
aagactatactttcagggatcagttctatagtgtgtkactagagaagtttctctgaacgtgtagagcaccgaaaaccacgaggaagagaggaa

SEQ ID NO: 16327 - DNA, 307 bp, Homo sapiens
  misc_feature 12: s=g or c
  misc_feature 258: r=a or g
ccgtctcaaaasaaaaattaaaaaacagttgtttctggccgggtgcggtggctcacatctgtggtcccagcactttggtaggctgaggcaggaggattacgacgtcgggagttcaagaccagcctggccagcatggtgaaaccccgcctctgctgaaaatacaaaaactagctgggcatggtggtgcgtgcctgtggtcccagctactcgggaggctgaggcaggaaaattgcttcaacctgggaggtggaggttgtrgtgagccgggatcgcaccactgcactccagcctcgggaacagagcagct

SEQ ID NO: 16328 - DNA, 355 bp, Homo sapiens
  misc_feature 290: s=g or c
  misc_feature 308: s=g or c
  misc_feature 309: s=g or c
  misc_feature 337: n=a, g, c or t
  misc_feature 345: n=a, g, c or t
aacacacttaaacaccaaatgaataaaaagaggaaatcattagggagataagaaaatatattgagacaaattaaaaggaaaacatacataccaaaactcatgggatgtagtaaaaactcagagggttcacctcttaagcatttattagatgcctattatatgccatatctcagcttctctggacatagacctcatagacatctacagaactctccaccccaatcaacagagtatatattcttctcagcaccgcatcccgcacttattctaaagattgaccacataattgsaagtaaaacagtcctcassaaatgcaaaagaatggaatcataacagnctctcagnccacagtgca

SEQ ID NO: 16329 - DNA, 251 bp, Homo sapiens
agaacattcctgcctatcctccagctctcagctccgataccccctcctccaggaagccctcctgactctccaggatcagagggggttaggcaccctctttgggctctcacagcccatcctgtccattctggggatgcctgcccccgctgcactgtgagcagggttagggctgtctcggtcactgctgtgaccccagcacagggccaggcacagagctgggcctcgggaccacgtatggagtgaaggacaaa

SEQ ID NO: 16330 - DNA, 86 bp, Homo sapiens
cattttggaactagatgtaagtggtggttgcacggcattgcgaacgtagtaaatgccattgaattgattattttagtcgtgtgaat

SEQ ID NO: 16331 - DNA, 93 bp, Homo sapiens
gtcctgcgcgctttccgcgccagcttcagtgtcagctcgcgagccctggcgtcgcgtaggagggaggatggagagcggcgacgaagcggccac

SEQ ID NO: 16332 - DNA, 121 bp, Homo sapiens
tcattttttaaataaatgcaatataaataatatcaagtctgacgattcatctcaaacctgatctgatggcttatgatgtttcctaaaagtagcaggtagctttatatgtatttttatttga

SEQ ID NO: 16333 - DNA, 196 bp, Homo sapiens
tttagctttggtcagtttgagaagtaggcaaaacttaaatactttttttgttttcagagatgaagtctccctctgttgcctaggctggagtgcggtggcatgatcatggctcgctgcagcctccacctcctgggctcaagcaatcctcctgccttagcttccttgagtttctgggactacaggtgtgcaccagctc

SEQ ID NO: 16334 - DNA, 54 bp, Homo sapiens
tcctgggtgacagagcgagactctgctttttaaaaaaaaaaaaaaaaaaaaaaa

SEQ ID NO: 16335 - DNA, 220 bp, Homo sapiens
tttttattcttttgttctctttgagtttcagtttgaataatttcttttttaattttactttgatttctgggatacatgtgctgaacttgcaggtttgttacataagtatgcatgtgccatggtggtttgctgcacctatcaacccgtcatttaggctttaagccccgcatgcattaggcatttgtcctaatgctctccattcccttgtcccccagccccc

SEQ ID NO: 16336 - DNA, 103 bp, Homo sapiens
ttaaattgtattgggtgctaacttttcattagtctttgccacactttttgttgagctagacatagcagtgagtgtccataagtgacatgtaatgtaaggcccc

SEQ ID NO: 16337 - DNA, 94 bp, Homo sapiens
taaaaaacaggaatcatattttgatgttttgatcaaggttttgacgttttccagtggctcagtcagaactcactacagtctcgacctcaggagc

SEQ ID NO: 16338 - DNA, 117 bp, Homo sapiens
acacagacacgcagacacagagacaccggggcccagggcctcctatggaccctgcccgctcccctcccattgtccacggctgtccgcccacccccattctccaagcttcagcccccg

SEQ ID NO: 16339 - DNA, 160 bp, Homo sapiens
caatagaagctcactggactacaataaaactgcaggctgcaacgattcattttaatactgtctgtcctactcatctcaaaaactgccctcaaggacagaagccctgctttttcttttgaaccgagcaccagaaacaggtgcacacacataagcacaccat

SEQ ID NO: 16340 - DNA, 128 bp, Homo sapiens
agccatgaggcaactcacgaagaagaagaggttgaaaacgaagaggaagtacttgatgaggctgaggcagctctcctgggctgacatcttcacctagtggggtaagcggtccactcaccacacagtta

SEQ ID NO: 16341 - DNA, 80 bp, Homo sapiens
caaagaaaagactcctttcaagaaaatgaagatggttataggtggcaagacacaagaggctgcagaactgtaagacgaca

SEQ ID NO: 16342 - DNA, 151 bp, Homo sapiens
tgacttttgcatgtgcaaccctcccttttttgccaatcaattggaagccaagggagtaaactcacgaaatcctcgaagacctccgcctagttctgttaatacaggaggcatcacagagatcatggcagaaggaggtgaattagagtttgtt

SEQ ID NO: 16343 - DNA, 182 bp, Homo sapiens
ccatatttacatctcccttctccaacagagagagccccagttcctaagaatatcaatatattcacacaattgctctttcctgcctttcatataaattgggattagaattattatgctaaagtcattataagttcagtagttgtttgcagttttttttgtccttacagtatatcacaccccga

SEQ ID NO: 16344 - DNA, 171 bp, Homo sapiens
gtttaaaactgtggagaagataagcaaaatacaagttgagcagtctgtctttctgtgcgatttctcaaccttagcaacatcctctgagcagtgattcttagttccttgttctcttcgagaaatagtgtgttcttgtggagacagcactggtaagaaagtacaaaacctgat

SEQ ID NO: 16345 - DNA, 133 bp, Homo sapiens
agttaaatatttttttaagtccatgctaagtaaaaattcttacatgttgtctgatcccagagctttatctactaaaaattatacataaggatttccaaatcttagagtttcaaaaagtaaccatagggaaaga

SEQ ID NO: 16346 - DNA, 82 bp, Homo sapiens
tttagcacaaaaaaaattgtacttttttattgtcgaattgtttaaaagacttcattctttacttgttcttacgaaaaggact

SEQ ID NO: 16347 - DNA, 90 bp, Homo sapiens
gtttctttagtgagtgaccatcgctgtcattgcacagcagataactttactaacctgctagaacctcattggaaaaaaaacttttttttt

SEQ ID NO: 16348 - DNA, 70 bp, Homo sapiens
aggcgcacacagggctcagctgcccctcctttgaggctgctgcagaaggcaggccctgagacggaggttt

SEQ ID NO: 16349 - DNA, 124 bp, Homo sapiens
  misc_feature 18: s=g or c
catacattgctggtacasccctttagaaaacagtttggtggttcctcaaaatgttaaacagagttacgatatgacccagcaattgcacatcttgggatttaccgaagaaaaataagacatagac

SEQ ID NO: 16350 - DNA, 173 bp, Homo sapiens
caaaaaaattagccggcttagtggtgggtgcctgtagttccagctactctggaagctgaggcaggagagtggcatgaacccgggaggtggagtttgcagtgagctgagatcgcgccctgcactccagcctgggtgacagagcgagattctgtctcaaaaaaaaaaaaaaaaaa

SEQ ID NO: 16351 - DNA, 182 bp, Homo sapiens
aatattaatatttgccctggccggtgaacccagcagaggctgtgcacggaagcccagagcacgatgtcttgttagaatgctacctcctggaacccagctgccaggctctgagaagctcaagtcacatggggaggccacgtgtaggtgacctggtcaacagtctcagccaaagccaacctctc

SEQ ID NO: 16352 - DNA, 168 bp, Homo sapiens
caaaggttggccggtcatggaggcgggcacttgtagtcccagctacttaggaggctgaggcaggagaatcacttgagcccgggaggcggaggttgcagtgagctgagatcgcaccactgcactccaggctgggcgacagagcaagactctatctcaaaaaaaaaaaaa

SEQ ID NO: 16353 - DNA, 155 bp, Homo sapiens
gtttccattttcacacagcactgctgcccatcttagggactttagcattcacaggcccattgccccatatctacttgtcaatatgagaaagcaggaggccaagaattacaaaatgattctcctttggttggacttcagtacccaggccaccacga

SEQ ID NO: 16354 - DNA, 130 bp, Homo sapiens
  misc_feature 12: m=a or c
gtatttttagtmgagaggaggtttcaccgtgttagccaggatggtctccaatctcctgacctcgttatctgcccaccttggcctcccaaagtgctgggattacaggcctgagccaccacacccggcccca

SEQ ID NO: 16355 - DNA, 82 bp, Homo sapiens
ttatttggataaccgctttgttcagcctcgtctagagagcttggtatctagaagtcgttggaaagagcaatataaggagcta

SEQ ID NO: 16356 - DNA, 182 bp, Homo sapiens
  misc_feature 12: m=a or c
  misc_feature 84: m=a or c
  misc_feature 85: y=c or t
acagcacggctmggctcatgcccagagaaagaggaagaagctgagtgtgagacagaaaggaaacaggggatgacagagagagamyagaagaggaaaattagcaagagagactaaaagagacagagatcaaagagaaacacagaagggatgtagatggcaacgtggctctcattcccctccct

SEQ ID NO: 16357 - DNA, 289 bp, Homo sapiens
  misc_feature 12: s=g or c
aaatagagagtstaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatc

SEQ ID NO: 16358 - DNA, 223 bp, Homo sapiens
caaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggac

SEQ ID NO: 16359 - DNA, 92 bp, Homo sapiens
  misc_feature 13: s=g or c
  misc_feature 34: s=g or c
  misc_feature 35: r=a or g
aattgcaggtgasccagggtctcccgagaacctsrccccccggtattcccctcaccctgaagtaagggagtctccctcttcccctcatctcc

SEQ ID NO: 16360 - DNA, 245 bp, Homo sapiens
tttaattcaaccaaatggcatgtatatgggtaactagttgacagtgattagggctgcagtcaaggtgatcccatgacttgtgatcaccatgatcacatgtgtgcttgagtgcttggccattttcactgagggaatgaggtgactgcccctgacccccagtgtcctgccttccttttagagttaagccagatggtcgactgctgcaggcttccacaggatgtatcggtgcttggcgtgtgaggtca

SEQ ID NO: 16361 - DNA, 150 bp, Homo sapiens
gattgattgattgattgattttgagatggagtctcgctttgtcgcccagtctggagtgcagtggcgcgatctcagctcactgcaacctccgcctcctgggttcaaacgattctcctgcttcagcctcctgagactacaggcacggccacc

SEQ ID NO: 16362 - DNA, 100 bp, Homo sapiens
tgacgtggcacgctggtgggtgtgtctgattgaaagctgctttcaccccagccctgttttagtgagtcctcaatctggtccagtgtctgagccccgcata

SEQ ID NO: 16363 - DNA, 134 bp, Homo sapiens
ctctagcttgcatgggtgttgcattgactttaatttattgaaaaatacaaatttttgtaaatatcagatcagtgatactggtgttagtgttgtaatcaggttaaacccacttccattaaacttgacaggaccgc

SEQ ID NO: 16364 - DNA, 72 bp, Homo sapiens
tttccagaagaaaacagttccacgttgcttgaaattgaaaatcaagataaaaatgttcacaattaagctcca

SEQ ID NO: 16365 - DNA, 114 bp, Homo sapiens
  misc_feature 108: y=c or t
tttcttctgaattgaggagggggcaaaacagggtgaacatccatgaggttttgtatcaggacgtattttattgatggcaattggtagttgatggctaatgagtatgtytggggt

SEQ ID NO: 16366 - DNA, 263 bp, Homo sapiens
  misc_feature 14: y=c or t
  misc_feature 231: w=a or t
  misc_feature 239: r=a or g
attttccaacccaytatgccagttcagggttgtatgtggctggagtccatccctgcagctcagggcacaaggaaggaactagccctagacaggacaccataccattgcaaggctcactcacacacacccatactcactcaggctggactatgtatatatgccaattcacctaccatgcacatctttgagatatgtggggaaactgcagtacccagagaaaacccacacagwcatgagtraaatgtgcaaattccagacagact

SEQ ID NO: 16367 - DNA, 125 bp, Homo sapiens
  misc_feature 61: s=g or c
ctgtagtcccagctacttgggaggctgaggcaggagaatggcgtgaacccgggaggcggasttgcagtgagccgagatcgcaccactgcgctccagcctgggttacagagtgagactctgtctca

SEQ ID NO: 16368 - DNA, 84 bp, Homo sapiens
tggcgtaacaaattgggcgctgtctcaacgagagatccggtgaaattttaatacctgtgaagatgcaggttacccgcgacaaga

SEQ ID NO: 16369 - DNA, 245 bp, Homo sapiens
caaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggccc

SEQ ID NO: 16370 - DNA, 256 bp, Homo sapiens
tatgtaaaaatggaaaatgctaaatatacaacatatgcaataccttgtaacaggatggtgaaatggaagttgaggttgcaaaacaacagatgcccattccaaattgaagttctgagaaaggatttacaaagaggctgagaaccagtagatcattcttaaatccctcacccttataaggaatactaaagcatagaaggggagtttgaaatataacttcttaggaagagttatttggaaagctgtactgagagtcgct

SEQ ID NO: 16371 - DNA, 188 bp, Homo sapiens
  misc_feature 70: b=c or g or t
tttgtctgttttgaattatgggtatcactaatacgcctctgctgatgtggctaatgtgttgttgactgtbatgctgtttttaggttcttgtgggtttaggtcacactggcaatggaatcaacctctcctctcccatctgattccttgtatcaggagtacaataataattttttcccctaacacagaga

SEQ ID NO: 16372 - DNA, 96 bp, Homo sapiens
ttttgagtccttgtttttaattctttggagtatatacctaggagtggaattatcacatggcaattctgtatataaatttttaaggaagtcccaacc

SEQ ID NO: 16373 - DNA, 125 bp, Homo sapiens
  misc_feature 31: k=g or t
  misc_feature 44: s=g or c
  misc_feature 79: y=c or t
  misc_feature 106: y=c or t
ctgtgaaaaaccaatagctgaaatcatagtkaatgctgaaagastgaatgctttccctatataatatttagaacaagtyaagatatctgctattcccaattgtgtycagcattgttctggaggga

SEQ ID NO: 16374 - DNA, 290 bp, Homo sapiens
  misc_feature 116: r=a or g
  misc_feature 119: r=a or g
  misc_feature 123: y=c or t
  misc_feature 283: n=a, g, c or t
tggggattttccagctctaagaggctaaggagtaggaggccctccagtggcgagggtgggaacagcggcacgtggtgcagggtttaggaatgcagcccaagttgtttccggaacarggragtyctggggtgatgggttcaacaggggtgtccagtggtggctaggagaggtggagatggtgtgatggctgcaggcaagggaggagctgctcggtagggacttacccagcagtgactgctgtggacaccacgctggggggagtaccatcacctctatgtcagtnacgctgc

SEQ ID NO: 16375 - DNA, 125 bp, Homo sapiens
gtgaaggtttagaacagaagacggttagataagactgaatatttgcaggatagcaagaggatgttagcagttacagtggcattggatgtccatttgcagtgagtgactgggagtgtcaaagttga

SEQ ID NO: 16376 - DNA, 58 bp, Homo sapiens
tgggctgggctgcttggggcttggcatagggtggaaagggctaccctggggccctgaa

SEQ ID NO: 16377 - DNA, 89 bp, Homo sapiens
actcaaagaataattaatatcaatgaaattccaagcacaggctagaaaaagcagcctgttctttgcctgttaattgctaccccatgcct

SEQ ID NO: 16378 - DNA, 141 bp, Homo sapiens
atgtcttcagcatttgttaaggaaaagttttctctacttgtgtgtgtatgtgtgcacatgtgtgtatgtacaggtgtatgtatatagatagatacacctgtacaaacacacacacacacacacacacacacacacacaaac

SEQ ID NO: 16379 - DNA, 116 bp, Homo sapiens
ctccatcctgccttccttaagaaatcttgtcctggctaggcgcagtggctcacgtctgtaatcccagctgaggcaggcagatcatgaggtcaggagttcgagatcaacctgcccaa

SEQ ID NO: 16380 - DNA, 139 bp, Homo sapiens
ccccaggcctgaagccactgctccctagcatcccctgtcctcacctgtctccccattcctgtccagtcagcttgcaggtcctgtggattcttcctcatgatgttcatctctgtcctttcctctgtctgcatctttatcc

SEQ ID NO: 16381 - DNA, 72 bp, Homo sapiens
  misc_feature 32: w=a or t
atgcgcggtgcacagaggcttgtttcacatcwgtaacaacaggaggaggcccagcctcgtgatgaggaatca

SEQ ID NO: 16382 - DNA, 101 bp, Homo sapiens
tgaatcgttaaggagactaattatatccaaacaagtgggggtagcaacctgggtaggagtttctgacttccttgtgtaggctgaagaattagatggcgtcc

SEQ ID NO: 16383 - DNA, 96 bp, Homo sapiens
atccctgttgagtagcagggacacatatgtggatggcattcaggtggctttgcctgtttctaattggtatagagttctagtaagtatgaagttgtg

SEQ ID NO: 16384 - DNA, 151 bp, Homo sapiens
  misc_feature 58: y=c or t
taatgaaaactgtaaaatatctcttaaacaattattcaagcccttttgaatgtcagtyatgattttgaaaatctgaagtgaatgccactgatactacagttcatcagaattgatttggaagaggggaggacttaaataatttaattctgat

SEQ ID NO: 16385 - DNA, 107 bp, Homo sapiens
  misc_feature 33: r=a or g
attttatagtcttgaagtgggaaaatgacccaraagccataaaggagatatattttactacttaaaactaaaaaacaaacagccaacaacaacaaaaaaaccccaca

SEQ ID NO: 16386 - DNA, 218 bp, Homo sapiens
  misc_feature 161: b=c or g or t
  misc_feature 192: r=a or g
  misc_feature 194: k=g or t
  misc_feature 195: w=a or t
gtcacgtcagcgcgggagagagaaagagaggaaccgactcggcagggactgggggaccgggccgagagtgcgagcgagcgagggagggagtgagggagcgtgcgagccagaaggggaaaggcggccactcgtgcctgagcgaccgcagaggggagtgggabcagtggggtaaaggagcggggggcgggaatrakwaaggccgagagaaggcggaaaat

SEQ ID NO: 16387 - DNA, 195 bp, Homo sapiens
  misc_feature 58: r=a or g
ataagacctgtgtttccgaagattaatttagcagcaatatagagaccatccgcaaggraattggttacaaggttattacagaggtctggttgagagacattgagggagacagttggggaggaggggaaaggtacgcattattatggaaataggatgagtacaatttagcaattaagtcagaggtacaggacggac

SEQ ID NO: 16388 - DNA, 168 bp, Homo sapiens
ccttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctctt

SEQ ID NO: 16389 - DNA, 105 bp, Homo sapiens
cataggaaaactaccacccagatcaagaaataggatattaccagcaaccctgaaatctccctgtactcagtcatatatgtccctcaaaagtaggcagtcaccaca

SEQ ID NO: 16390 - DNA, 179 bp, Homo sapiens
cacattaaacgcatgtttgacactctaaactttctatactctcaataccacaaaatacatataatatactatacagatgtggaaaaatctagttagtatataatactttgctcaccattaacagctttatcgtgtgaaatgcacatactgacttagaaatcctagcttttgagccccgc

SEQ ID NO: 16391 - DNA, 381 bp, Homo sapiens
  misc_feature 51: m=a or c
  misc_feature 89: s=g or c
  misc_feature 244: k=g or t
  misc_feature 245: s=g or c
attttcatgaaactctgaagaaggaagggctggacattcagattccttgamccttgacatttggaagcatgaactccagtctctcacasaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagkstccgcgaaagcccttagagccggtgttgctccacaggaagccaagaagcacacaggaaaaggagcttagctgctggttgctgctggcaagatggaaaccaacttctccactcctctgaatgaatatgaagaagtgt

SEQ ID NO: 16392 - DNA, 162 bp, Homo sapiens
  misc_feature 122: h=a or c or t
  misc_feature 152: v=a or c or g
tttgagttttggggtacatgtgcacagtgtgcaggttggttgcatatgtatacatgtgccgtgctggtgtgctgcacccattgactcgtcatttagcattaggtatatctcctaaagctathccacccccctccccccaccccacaacagtvcccagagcca

SEQ ID NO: 16393 - DNA, 206 bp, Homo sapiens
cagaatttatataaaagtagatttgttttcttaaatctaaattctgatattgtgtacttctttttttgaggtggagtctcactgttgttgcccaggctggagtacaacggtgcgacctcggctcactgcagcctccgcctcctgggttaaagcagttctcctgcctcagcctcccgagtagctgggactacagacacctgccagca

SEQ ID NO: 16394 - DNA, 307 bp, Homo sapiens
  misc_feature 12: v=a or c or g
  misc_feature 236: w=a or t
  misc_feature 252: s=g or c
agtcggctcggvattggacttgggaggcgcggtgaggagtcaggcttaaaacttgttggaggggagtaaccagcctgctcctctcgctctcctcctcgtctgcgccgcgtttcagagagaaaattcctgttccaagagaaaataaggcaacatcaatgaaggagagaagagccagccagaaattatccagcaaatctatcatggatcctaatcagaacgtgaaatgcaagatagtwgtggtgggagacagtsagtgtggaaaaactgcgctgctccatgtcttcgccaaggactgcttccccgagat

SEQ ID NO: 16395 - DNA, 241 bp, Homo sapiens
attggttaagatgacattctgagaatgaagaaggatataagcaaaggtgcaagcatattccatataatttcagaaaattgaaattaaagtgtgaaatgtgaggttgtcaaatgttgttgagcaccaagtgtatgtccacttttgagaaccctttaccatagaacacatctacaaaagaaagaaaagatacttcatgaaaactgggctttccatcttcattttctctcacatcccccaatgc

SEQ ID NO: 16396 - DNA, 91 bp, Homo sapiens
agactcctctctgctcctgaggaagacagggcagcccggcgccacccgctcggccctcacgaagctaacacagaggatagacaagctccct

SEQ ID NO: 16397 - DNA, 142 bp, Homo sapiens
tgaagtcagtaggaggatgagagataggttatatggaaaaaccaacaatttaacttgataatcaacactctaggcagaatagttaggttttgggatgatggttttgatggtggggaagctaagacaggaagatgaaggaaaa

SEQ ID NO: 16398 - DNA, 124 bp, Homo sapiens
gtgggaagcggagtgacggagcgagcggctgttggaggaaggaggtgggggccgggagcgcaaatggcgttgagatggttcagggccctgttcaaactccagcactgaccattcaccggcatga

SEQ ID NO: 16399 - DNA, 168 bp, Homo sapiens
tcaatgctgatacatttaaactgtggaggcatcaggggaccaacctgcagtgatgctaagtggaactgacaagataatgacatgcgggttattgttgattaatccagttcactggagaatcattgggaaatgcatttatcctttcacctgaccctcccaaccccacaa

SEQ ID NO: 16400 - DNA, 209 bp, Homo sapiens
tacacccactttgctatttgtaatagacgacaagaccattagagtattcagttgctcttttccttctccttttgcaggacagaaaatatgcaaagcctaaaatggcagcctacaggttattatatatgcaaattttatagactctgttttcattttaattacatttgtcactttggattactttcaaaaacaactgttagcataaatga

SEQ ID NO: 16401 - DNA, 56 bp, Homo sapiens
ccatgtgtttctttagcctgggcatgaatcaaaaatagttgaactttttttttttt

SEQ ID NO: 16402 - DNA, 88 bp, Homo sapiens
aagactatactttcagggatcatttctatagtgtgttactagagaagtttctctgaacgtgtagagcaccgaaaaccacgaggaagat

SEQ ID NO: 16403 - DNA, 82 bp, Homo sapiens
ttcacacttgaaattaaaaaaaatagtttttttttttaattttgggaaaaaattacattataggacaatataagggacgcga

SEQ ID NO: 16404 - DNA, 426 bp, Homo sapiens
  misc_feature 384: s=g or c
  misc_feature 392: y=c or t
  misc_feature 426: k=g or t
ttactcgggaggctggggcaggagagtcgcttgagcccgggaggtggaggttgcagtgagccgagatggcgccactgcactgtagcctgggcgacagggcgagacgccgtctcaaaaaaaaacacacaaacagaaagtgatagatcagccccaagtctctgtcctgatccaaggctgtgtcctgctaggattccccctcctcctgtttcctctccttctcgtgctgcttctccagtggctcacacttatcctttttacagcattgcagtggttgacagtttcctcctcctcctcactctccccactagaaatctgtgagactcccatacttaacttgttttcctcctccttctgtggaagctcctcttgggctttttcccaggstccctctyccctaaattttgatcattctcagagactcacgtk

SEQ ID NO: 16405 - DNA, 81 bp, Homo sapiens
atttggaccatttccctgcttcgggattttgatacgacacctatgtttaggtaacaggccacagagtaactgaacaactac

SEQ ID NO: 16406 - DNA, 159 bp, Homo sapiens
ctgacctcgtgatccgcccgcctcggacacccaaagtgctgggattacaggcgtgggccaccgcgcccggtctgcttctccccttttcatatgccttcgtgcactctccacaacagacaggattgcattaactctaaatcagacacatgaagcccagac

SEQ ID NO: 16407 - DNA, 248 bp, Homo sapiens
  misc_feature 78: m=a or c
  misc_feature 87: m=a or c
  misc_feature 154: r=a or g
  misc_feature 248: w=a or t
ctaaaaatacaaaaatttagccaggcattgtggtggatgcctgtaatcccagatacttggggggctgaggcaggagamttgcttgamcatatgaggcagaggtggcagtgagctgagatcgcaccactgcactccagcctcatatgttcaagcrattctcctgcctcagccccccaagtatttgggattacaggcatgcagccaccatgcctagccagctatactttgttgaatacttctgaggtacw

SEQ ID NO: 16408 - DNA, 71 bp, Homo sapiens
cttagataattttcttcctgtttgccgaagatttttcagtctcaattttctctgttcttgctccagcacca

SEQ ID NO: 16409 - DNA, 239 bp, Homo sapiens
  misc_feature 148: k=g or t
  misc_feature 158: s=g or c
  misc_feature 224: k=g or t
  misc_feature 226: w=a or t
ctaaaaatacaaaaatttagccaggcattgtggtggatgcctgtaatcccagatacttggggggctgaggcaggagaattgcttgaacatatgaggcagaggtggcagtgagctgagatcgcaccactgcactccagcctcatatgtkcaagcaattstcctgcctcagccccccaagtatttgggattacaggcatgagccaccatgcctagccagctatacktwgttgaatacttct

SEQ ID NO: 16410 - DNA, 178 bp, Homo sapiens
tgcccccactgtaaacaaacactgtagaggtgaaaggctttgtttccaaggctcaggaacatggagagaggagccctctacctttgcagttcattcaacagactagggatctacttgccctcacagggctcttagaataaggaaaaaaaagcagaaggcatgttccgcaacctcactc

SEQ ID NO: 16411 - DNA, 89 bp, Homo sapiens
attaaatttgtgatggataccccaaagttggcagaagttaatcttcccaatttacttacctctctctgagcctcctcaaccccaagccc

SEQ ID NO: 16412 - DNA, 77 bp, Homo sapiens
gagatggagttttgctcctgctgtgcaggctggagcgcaatggcatgatctcggatcaccgcaacctccgcctccaa

SEQ ID NO: 16413 - DNA, 167 bp, Homo sapiens
agaatatagaagtgaggttggacttggtggctcgtgcctgtaatcccagcactttgggaggctgaggcgggcggatcgcctgaggtcaggagtttgagaccggcctgacaaatatggtgaaaccctttctctgctggaaatacaaaaaattagctgggtgtggtggt

SEQ ID NO: 16414 - DNA, 206 bp, Homo sapiens
atcctcagggcctgggcctggcctccttgcctgtgagatggcactgtgacggtgcccacctcgtggggtgtgtgagggccgagtgaaatcgtgcatttgcggagaagaaaggaaggagagctgagtgtggtgaaaaaagtgaagagtgctggctttggaagcatgtatgctaaaattggaaccacacagagatgaccatgaccccc

SEQ ID NO: 16415 - DNA, 76 bp, Homo sapiens
aagactatactttcagggatcatttctatagtgtgttactagagaagtttctctgaacgtgtagagcaccgacggg

SEQ ID NO: 16416 - DNA, 165 bp, Homo sapiens
tgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcca

SEQ ID NO: 16417 - DNA, 381 bp, Homo sapiens
  misc_feature 212: s=g or c
  misc_feature 260: n=a, g, c or t
  misc_feature 314: n=a, g, c or t
tctgcgcaacgcgaccgaccgagcagctccgaggagtccgcccggaaacaaacattccccagggcaatgtcacgacttggtcttcccgaggagccagtcaggtaaaggctttccgggccctggcaccccgagcttggtcaggcccggccttgatcgtagcggaggccaccggggccttttggccgggactgattttgcagctcccgccagtscacctgcgagcgccggatgggggagcactcgcctccagcaacccgcangtccccgaacctttgcactgctctggccaggaacagagccggcttaagccagtntggtttacatacacgctgctccccttcccagccggcttggctgttctgcaatccgcgtctccagagt

SEQ ID NO: 16418 - DNA, 179 bp, Homo sapiens
  misc_feature 32: m=a or c
  misc_feature 44: m=a or c
agtaactcgggaagacgaccaagcgggagcgmgagcgagagcgmgagccggagcgagagcgcgcgggcgcggccgacagcagtgcctgatttgagatggggtcccaggtctcggtggaatcgggagctctgcacgtggtgattgtgggtgggggctttggcgggatcgcagcagccctg

SEQ ID NO: 16419 - DNA, 161 bp, Homo sapiens
caagaatattttatattggccgggcgcggtggctcacgcctgtaatcccagcactttgggaggccgaggcgggcggatcacgaggtcaggagatcgatactagcctggccaacatggcgaaaccctgtctctactaaaaatagaaaaaattagccaggcga

SEQ ID NO: 16420 - DNA, 145 bp, Homo sapiens
  misc_feature 49: s=g or c
  misc_feature 73: s=g or c
  misc_feature 74: s=g or c
gtcggggcaggaggcacgcgcgcggctgaggcgaggtcgctcggcgcastgttgcggggccatggcggggacssgctcaagaggctgatggccgagtacaaacaattaacactgaatcctccggaaggaattgtagcaggcccct

SEQ ID NO: 16421 - DNA, 118 bp, Homo sapiens
  misc_feature 41: n=a, g, c or t
ccccgccggttcgcgtctctctgctgcggcgcggggaccgntgtgctctcgacccctcctcctgtagagagtggtgctgccctctcgggatgtacctgcaggtggagacccgcaccaa

SEQ ID NO: 16422 - DNA, 370 bp, Homo sapiens
  misc_feature 314: r=a or g
  misc_feature 315: r=a or g
tcagaaggaaaaatggttttaagaagtccagctagtttgggcatggtggctcacacccacagtcctagcactttgggaggccaaggcaggcaaattgcttgagcccaggagtttgagaccatcctgggcaacatggcagaaccctgtctctacaaaaaacacagaaattagctgggtgtggttgtgtgcacctgtagtcccagctactggggaggctaaggtggatcacctgagcccagggaggttgaggctgcaatgagctgttatcatgcactgcactccagcctgggtgacaaagtgagaccatgtctcarraaaagaagtccagctagtagaagatcaaactgaggagggaagaaatagatgcaat

SEQ ID NO: 16423 - DNA, 116 bp, Homo sapiens
  misc_feature 102: k=g or t
cattaattttgttttcaaaactagaataatctcaccacagaatcagaattttctaccgttccacacccaaccccttcaaatacacacaaccttgttactttkcactccagccacct

SEQ ID NO: 16424 - DNA, 67 bp, Homo sapiens
tctgcttaaggttagtttgttctcaagtcttgtcaccatatcagtactcttatcatttaaactgcct

SEQ ID NO: 16425 - DNA, 153 bp, Homo sapiens
gtggtatcaaaacctctaaaagggggaaaatgagttcttgaaatcatgggtttaaaatgtatgtgaaatactggtctgaaggagcccagggaccttttgcaatgttgacatttcatacgaatattgaattttaaattctgagagaaggtaata

SEQ ID NO: 16426 - DNA, 188 bp, Homo sapiens
tacatatatcttttgatttattctaatcagatgtttaaattgttcttatgtgggaacactaaggtagctatggagaattatggagtggacctccacccataaagagcttacaaaatctatagcatgtatcaattgttaagtgacagtattagatagtaaggcatctagtggggtagtaagcatggaca

SEQ ID NO: 16427 - DNA, 93 bp, Homo sapiens
aagagagaacaacaacactcaaatcaagaaattcagcccatcagattgcgaacttcaagtgcctgctggctggctagagtaagagaggtgagt

SEQ ID NO: 16428 - DNA, 87 bp, Homo sapiens
aagactatactttcagggatcatttctatagtgtgttactagagaagtttttctgaacgtgtagagcaccgaaaaccacgaggaact

SEQ ID NO: 16429 - DNA, 208 bp, Homo sapiens
cggtgaagccccgtctctgctggaaatgcaggaaattagccgggtgtggtggcgggcgcctgtggtcccggctactctggaggctgaggcaggagaatggcatgggcccgggaggcggagattgcggtgagccggggtcgcgcccctgcactccagcctgggtgacagagccagactccgtctcaaaggaaaaaaaaaaaaaaaaaaa

SEQ ID NO: 16430 - DNA, 175 bp, Homo sapiens
tagatgtacaatgaaattattatatgttaaagctactgggaataatttctacgtggttatgccacaaacttaattggccaataggtttttttgtttcattttgttttttgtttgaggtattgctttttattgttttgctttataattatataaactatatggttccaaagggcag

SEQ ID NO: 16431 - DNA, 105 bp, Homo sapiens
acaaaaatggccttgtgttttacttgattaaaattaagccttaagtttagaacatctttaaacttggtttaaaatgttcattttagggtgtttgccagcttccga

SEQ ID NO: 16432 - DNA, 291 bp, Homo sapiens
tcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgt

SEQ ID NO: 16433 - DNA, 89 bp, Homo sapiens
ccttaaccccacatgctcaaaatcaaatgatacatattcctgagagacccagcaataccataagaattactaaaaaaaaaaaaaaaaaa

SEQ ID NO: 16434 - DNA, 170 bp, Homo sapiens
  misc_feature 98: y=c or t
  misc_feature 106: n=a, g, c or t
acctgtttttgatacataaggtttatgttatgacccatactgtaaaatgtgacgcatataattacagtggtatatataatgcagtaccagaaaacttytgtgtgtnttttttcccccccagaaaccagggtggttatgaccgctactcaggaggaaattacagagaccaa

SEQ ID NO: 16435 - DNA, 60 bp, Homo sapiens
aaaaggtaggacagtacattagttttgaagtcatgactgggatcgagtgataaagggaat

SEQ ID NO: 16436 - DNA, 141 bp, Homo sapiens
aggcctctcgcgggttcgcaccgggtgacggcggggactggcctggactctgggggactggcgggactctggaggagggcccggcggcctcggaggagggaccgaggtctcctgggcgggaaactgggaccccggcgaaca

SEQ ID NO: 16437 - DNA, 94 bp, Homo sapiens
agtactgctagtttcttaatcaaggcaaagaaagccacatgcttcattactcattttttaacatttccttcaaattattgtaaatggccgctat

SEQ ID NO: 16438 - DNA, 99 bp, Homo sapiens
atgaactccttccctttttgccagtcacctccaccacagtttccattgaaaaatagaaggtaggccaggtgcggtggcttatgcctgtggtcccagaac

SEQ ID NO: 16439 - DNA, 192 bp, Homo sapiens
taacatgatataatataaaatatgagttaatccattttctatgatatcaggcttccagtcaacagtaggctattaataattaagtttatggggtatcaaaacttacatgcagtttttttggctgcactggggttaacagctcctacccccatgttgttcaagggtcaatctcatgcgcgtgcacacacaaac

SEQ ID NO: 16440 - DNA, 307 bp, Homo sapiens
cacttttcatatccagacatgagatcatccatttctccaaaaagccctgattcctttcagtggagaatggtatttaaaaactgaaactggaggccaggtgtggtggctcacgcctgtagtcccggcactttgggaggctggggcgggtggatcatttgaggtcgggagtttgagaccagcctggccagcatggtgagatcctgtctctactaaaaatgcaaaaaaattggccaggcatggtggcaggcgcctgtggtctcggctgcttgggaggctgaggcaggagaattgcttgaatctggggggc

SEQ ID NO: 16441 - DNA, 179 bp, Homo sapiens
gcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacagga

SEQ ID NO: 16442 - DNA, 183 bp, Homo sapiens
  misc_feature 154: k=g or t
attagaacaaggattggcaggttgttagaagtgagatactaagatgctgtcagactactgatactcttgatttataggggtaaagagttcagattgcaagggtttggggaaggttcccctctggaaaagaatgacctgcatattgttatgagtkagtgattcttctattttaataaagcaccc

SEQ ID NO: 16443 - DNA, 158 bp, Homo sapiens
taaactttagtactatatcatatgttgggttaggctatgtcagtcagaggaatagagatccgtgaaggctggcacagtcaaaaatggaggaagtggaactcgacgggagcctttaaagaaaatcttcagactggaggaccaagaaaaggcggtggaag

SEQ ID NO: 16444 - DNA, 143 bp, Homo sapiens
gtataaagaaatttcatgctccttcctgacgtaggtattttgctgccggtgttttgggaatcaagtgggaatcaaggtggctagtgagaatcttactgttggggacatgaatttatatttaatcttagctctttctggtgccc

SEQ ID NO: 16445 - DNA, 82 bp, Homo sapiens
ttaatttttacaggttaaaagctcaggctctgtttaagtcgagagaactggttgctgaaaaacagcttactaaaccccaaga

SEQ ID NO: 16446 - DNA, 243 bp, Homo sapiens
  misc_feature 111: r=a or g
taaccaaagggctgctcttcctggcttgcggggaggagaaattaatcagtgaaggacactgattgattgtgccttaaagggtttaagatctcacgggagcatagtgatatratcccacagattaggaacttagaatgggatgtataattctagggtgcttgagttgaagtgtttctttttgaaatttctaagataaagcacaaactttaaaagttaaacattgtcaagtgcatctccccctac

SEQ ID NO: 16447 - DNA, 145 bp, Homo sapiens
cttaaatacattaaacaaaaataggaaaaaaagcagttaaaatttgatggcatatcagccagctgacccaattcttggcacagtcaacaagtatctttgatttgttttcagcagggctaagtcatcagatatgtcagaaggggcc

SEQ ID NO: 16448 - DNA, 200 bp, Homo sapiens
taaaggggaaatcgttgatgagataaggaaggcaggaaagcaagagcagacatggagaactttgaatggccatgtgcctgttctaaggagtttagattttgttttggaggcaatgcagaggagaatggcatcatcatatgcaagttggaaaaatgctaatgtccacatggagaaagaaggtggtgtagcgatggacaggg

SEQ ID NO: 16449 - DNA, 145 bp, Homo sapiens
gtgcctgagtaaagaagagatttaattattctccagtagctgagcaatgcttgtgaatcttttcttaagaaatcccaaaaagccaatattagttaaaattctgttgtttaatttggttatcttgctttataaattatgcccctaa

SEQ ID NO: 16450 - DNA, 255 bp, Homo sapiens
  misc_feature 157: y=c or t
agtaggaagccgcggggtggtggcgagagaggacccaggtgtcctggcagtgggcgccgcggggcacacgctgggccaaggtgcaggcggccagggtgggagactgttcgccccgccctgagtactcctatcttgtttctccacctgttcgggagtyggagatgtgcacctaaaggaggcgcatctggggacggacacatctggcactgaggccctcgccacctgcctcgccacctggcgaccctgaccccaccg

SEQ ID NO: 16451 - DNA, 332 bp, Homo sapiens
  misc_feature 284: w=a or t
aaggaaaactgttgctaatgcataggatttattcttttcctagttcttctggtgcgctctgaaatgttgataattatgttgacttgcagctatgacttggttcagctgttttgattttcatgttatctcactaagttatcaaaaatctgttccaccctccaatctctactccccttcagaaagaaagagtacatgcacttatggtgtatatctctttctttgaccttaaaggattaaagcaaaaataacacattagcttacagacttttgattttttttttttwaatttggaattaatactaatgagactttgagaattgtattggtggcaa

SEQ ID NO: 16452 - DNA, 177 bp, Homo sapiens
cagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccgcacc

SEQ ID NO: 16453 - DNA, 67 bp, Homo sapiens
tagcatgtggcttgttccctaactttgtccaggaggaacatgagcagaaagagcagaggaacaacca

SEQ ID NO: 16454 - DNA, 64 bp, Homo sapiens
atttagctctcactctgataatgattagatttaaaaccgtgcttttctctctgaggccctacaa

SEQ ID NO: 16455 - DNA, 251 bp, Homo sapiens
tatgctttttgacaaactgttatatttgtcagaaaagctatcactgcagaataattttctcaccatgttttctgacttccctttgccgcccctgaagcttgcgacccacttgtcctaatgttagttgatttatgttcaaggaatgaaagttgatttttaggccaatcgatttaggctccttatattaaacagaatttagtaaatcaagcaaatttgccatcagcttttctctttcttcttcagccccttta

SEQ ID NO: 16456 - DNA, 135 bp, Homo sapiens
ccctttctcagtttgcaataatcttacgtccatgctattgacactaattttgaaactggaaagctaattaatgacatattcatgtgttctttcatctaataaacatttattaatgtatagttctacaccaggcac

SEQ ID NO: 16457 - DNA, 177 bp, Homo sapiens
  misc_feature 93: s=g or c
  misc_feature 94: n=a, g, c or t
caaaaaaattagctgggcgtggtggcgggcgcctgtagtcccagctactcaggaggctgaggcaggagaaaagtgtgaacccaggaggcggasnttgcagtgagccgagatcacaccactgcactccatccagcctgggtgacagggtgagactctgtctcaaaaaaaaaaaaaaaa

SEQ ID NO: 16458 - DNA, 423 bp, Homo sapiens
aatcctatgatttgggcaccaaacttatttgcagtttgtttctttttcagcataagtcactgctagacctttgaagttgttagcacagaagaaataggaacagggtgatgtggaataaaaataattcaaaaatactcttcaagtggaggttctttagaaatactgttgattcataatgtagcagtgttactttttgttgttaatgttcaaggacttggtttatcttcttcaaaaagtagtaatagcaggcttatttgatgcctactactagaaaaatattttaggtgatttacataagatacgcctagctcgggttgattccattccattgcattccattccattccattcaattccattccgttccattccattccattacattcggattcattctattcactcccttactctccattacat

SEQ ID NO: 16459 - DNA, 105 bp, Homo sapiens
acctatcaataatgacattgaatgtaaatgaatatctccattaacagccatagagtggctgcatgggcttaaaaaaaaaaagaaaactaagacacaactgcctac

SEQ ID NO: 16460 - DNA, 393 bp, Homo sapiens
  misc_feature 145: r=a or g
  misc_feature 156: s=g or c
  misc_feature 157: r=a or g
aattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaartaaaagatgtsrctaaaacctctgaggctcctgagcacattttgctgatacagtctgtggggcttgaggagaccgcatgtattgttctttcttttgtttttcttctgagttctcaactgcggagagcacctgaaccccctttcctttttgaccgcagctgcactttgggccccagccagccctttttctttttctttttcttttgtggttcttccctggagcgactctggggagtcctggatatccca

SEQ ID NO: 16461 - DNA, 222 bp, Homo sapiens
  misc_feature 84: n=a, g, c or t
  misc_feature 123: r=a or g
ctgccttcattttgttatgtacccagtagtcattcaggagcaggttgttcagtttccatgtagtagagaggttttgagtgagtntcttaatcctgatttctagtttgattgcactgtggtctragagacagtttgttataatttctgttcttttacatttgctgaggagagctttacttccaactctgtggtcaattttggaataagtgtgatatggtggct

SEQ ID NO: 16462 - DNA, 83 bp, Homo sapiens
aagactatactttcagggatcatttctatagtgtgttactagagaagtttctctgaacgtgtagagcaccgaaaaccacgagc

SEQ ID NO: 16463 - DNA, 110 bp, Homo sapiens
accatcatgatgaacttcacgaaagtccctgctgtttcagggaagaaggctcttccttcatttctgtgggagatgtgaccatgcgaggttgtgcaggtagaagccgggac

SEQ ID NO: 16464 - DNA, 143 bp, Homo sapiens
ttgctatcacattaaaaagaattaacaggccaggcgcggtggctcacgcctgtaatcccagcactttgggaggctgaggtgggcggattacctgaggtcaggagttcgagaccagcctggctggcatggtgaaaccccgttta

SEQ ID NO: 16465 - DNA, 69 bp, Homo sapiens
acttatagaaatcacactctttccatatggatgtcatttacccaaagcataagctagtaacaggaaccg

SEQ ID NO: 16466 - DNA, 127 bp, Homo sapiens
tcaggagtttgagaccagcctggccaacttggcgaaaccccctctctgctaaaaatacaaaaattagctgggcgtggtgacatgtgcctgtagtcccagctactcgggaggctgaggcaggagagcc

SEQ ID NO: 16467 - DNA, 77 bp, Homo sapiens
tgtaaactgagataagactttatcccagaggcaatggggagttatattttttaaacaaatgcacctacacagtcagc

SEQ ID NO: 16468 - DNA, 117 bp, Homo sapiens
catgtgcacaatgtgcaggttagttacatatgtatacatgtgccatgttggtgttctgcacccagtaactcgtcatttaacattaggtatatctccaaatgctatccctcccccaca

SEQ ID NO: 16469 - DNA, 121 bp, Homo sapiens
acacgtgtgctccctgccctgctcctggccccttggccggccgggctgtttctggccatgggtcgctcccgccggacaggcgcgcaccgagcgcactctctagcccggcagatgaaggcag

SEQ ID NO: 16470 - DNA, 147 bp, Homo sapiens
ttaaaatacacatcgcatttttgctgtagatgtcctccatgatctagctgctgcctgcatctcttacgtcatcccttcccactctccccttgctccctgtgctctacccacacagcctttctgtctttctgtcactcactccagcaa

SEQ ID NO: 16471 - DNA, 90 bp, Homo sapiens
cactagaatggttaaaatataaaaacactgataataaatattggagaggaagtggatcaaaataaatttttatactatacggaggatact

SEQ ID NO: 16472 - DNA, 124 bp, Homo sapiens
caaaaataaccttcaggaaaaagaaaatcaggaaaaaaattttttttcaataatcttattccctatattaaattagatttgaagaggattaacgttgttttagtttgggtccagaccagcctgt

SEQ ID NO: 16473 - DNA, 184 bp, Homo sapiens
  misc_feature 171: k=g or t
tatttttcttgtttcaaaatttatattattcctattaaaaatggaatttttcatcatgtttggattttctgtgtcatggctgctgtttttcctggccaaattcttcatctacgaggcaagctctcctggaagactctgtccctgagtttcttatagcaagttgagtatgckaaaagccagtaac

SEQ ID NO: 16474 - DNA, 163 bp, Homo sapiens
ttcttccagaatggaatggaatggaacggaatggaatggaatggaatggaatggaatggaatggtatggaatggaatggaatggtacagaatagaatggaatggaacgaattgtaatggaaaggaattgaatggaatggaatggaatggaatggaatggagga

SEQ ID NO: 16475 - DNA, 109 bp, Homo sapiens
tggatgaaattatatgctatctggaattgtcttctaactgatccttggttgggcatgggtggagtgtgagggtatatgccaggcattggcaaattatctgtaaagggca

SEQ ID NO: 16476 - DNA, 181 bp, Homo sapiens
  misc_feature 28: w=a or t
agccgggcctgatggccctgaggcagtwcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtca

SEQ ID NO: 16477 - DNA, 176 bp, Homo sapiens
ttgaaacttttcaaatatatgaagaggtaggttctactgtatacattttattggaaagccattaatcattgaagaacttaagcaggtggggcatttaatttcttccaaataccttattttttggatctgctcaagtggttagggcgagtgcaccattattcccgaatccctgcaaa

SEQ ID NO: 16478 - DNA, 140 bp, Homo sapiens
aaaggaatggaatcaacccgagtgcaggggaatgtaatggaacggaatgcaatggaatggaatcatgcggaatggaatggaatggaatggaatggaatggaatcatcccgattgcaatggaatggagtggaatggaacag

SEQ ID NO: 16479 - DNA, 342 bp, Homo sapiens
  misc_feature 108: k=g or t
  misc_feature 274: n=a, g, c or t
aatggtatggaatggaatggaatggtacggaatagaatggatggaacgaattgtaaaggaatggaattgaatggaatggaatggaatggaatggaataaacgcgagtkcaggggaatgtaatggaacggaatgcaatggaatggaatcatccggaatggaatggaatggaatggaatcgaatggaatcaacccgagtgcaatggaatggagtggaatggaatggaatggaatggaatggaacaacccgaatggaatggaatgtaatggagagtnagggagttgaatagaatcaatccgaatgtaatggaatggaatggaatgcaatggaattgaatcaaccc

SEQ ID NO: 16480 - DNA, 193 bp, Homo sapiens
  misc_feature 151: y=c or t
tttgttaattaaatgatttgcagtagcatgagtttctctcccatgctctctgcttatttcttactatagtttgtgatggccataagatggtgctgcagttttgcagtcagccttaaggataaggcttaggggaagaacacctactgcagtygtgaggcagatgggacatcaggagggtcttagaagggactga

SEQ ID NO: 16481 - DNA, 99 bp, Homo sapiens
tattattgtgtctgtttaggggggtaggatggagggggagatattcggctgctgttgatgccgattgttgacttgccatttgatatcagatagggagga

SEQ ID NO: 16482 - DNA, 152 bp, Homo sapiens
  misc_feature 13: k=g or t
  misc_feature 14: w=a or t
  misc_feature 16: w=a or t
  misc_feature 17: w=a or t
  misc_feature 117: s=g or c
ttgtttgtttgtkwgwwttaattggaatcttgctctgtcacccaggctgaagtgcagtagtgtgatctcagctcactgcaacctccgccgcctgggttcaagtgattctcgtgcctsagcctcccgagtagctgagactatagatgtgcgct

SEQ ID NO: 16483 - DNA, 147 bp, Homo sapiens
  misc_feature 112: k=g or t
accagcattactccaggctaacaagccttgggagtatatcgttccttgtggctaaggggttactgacatcctctggacctttctccagtagctccccatcatgaaagctttkgtttgaaaaaccttccttatccccaccccccacaa

SEQ ID NO: 16484 - DNA, 176 bp, Homo sapiens
  misc_feature 93: s=g or c
caaaaaaattagctgggcgtggtggcgggcgcctgtagtcccagctactcaggaggctgaggcaggagaaaagtgtgaacccaggaggcggasttgcagtgagccgagatcacaccactgcactccatccagcctgggtgacagggtgagactctgtctcaaaaaaaaaaaaaaaa

SEQ ID NO: 16485 - DNA, 190 bp, Homo sapiens
tagttcgtgtaaattctctgagaatgttctggagatagataactcatttacagtggtttctattaactaattaaagtacccatgattttttccttttctgctcagggatgatggagatttccttttaccttctgaggtagaattttttaatggggaaaataggccttttaaatattattgccagggtcaa

SEQ ID NO: 16486 - DNA, 68 bp, Homo sapiens
caaaaattagccgggtgaaattagccgggcgtggtggtgtgtgcttgtaatcccagctactcgggatg

SEQ ID NO: 16487 - DNA, 114 bp, Homo sapiens
  misc_feature 55: s=g or c
  misc_feature 56: v=a or c or g
  misc_feature 57: k=g or t
tttctaacggtgccatttcctccctgaggcgtggaggactggccagcccccaaasvkccaagcccatcggctggatgccgtggataagcgaggggagagcgactaggccctgtc

SEQ ID NO: 16488 - DNA, 107 bp, Homo sapiens
agtcggtaatcgtttatcggtgcggccttagagaaaggacctccaagcccttgttcaatacatgttgggtggtggtcacaggtgccagtctccggacggatggcggc

SEQ ID NO: 16489 - DNA, 111 bp, Homo sapiens
cagcactatttgcagtagccaggatatggaatcaatctaggtgtcaaacaatggatgagtggataaagaaaatgggaatatacgcacaatagaatagtattcagccacaat

SEQ ID NO: 16490 - DNA, 267 bp, Homo sapiens
cttatgagacagtgaagggtgttcccaagttgtggtagacagggtgtgttcctctttgcttgtgatactaccagtactagttttcattggtcctaaggtgcatattttagcattgccgaaatccagaagtgtcttaaaattgctggtgaccaggtgtcagctgtgacgtattatcattgcctgcacctgtgcaactttgatgttattggcatggcgtgactggttagctgtactccctggcttttcagttaataaataatttaagga

SEQ ID NO: 16491 - DNA, 145 bp, Homo sapiens
  misc_feature 3: y=c or t
  misc_feature 13: s=g or c
gtycagaagaggsaaatctatagggatagaaagcagattagtagttgtcaggagctgaggtaagggaagatagtgaatgactattaatggatatagaatttgtggtaatgaaaacgttctggaattaataatgatggctgcacaa

SEQ ID NO: 16492 - DNA, 218 bp, Homo sapiens
ttataggatttgggctttggataattttggggggaaggtctaaggacatgagggcttgctctagatagggtgctgtcggaaaacagaggcaattctatgattgggtatcaacagatcttatagagggggtcaagtagattgaggttaaagctgtaattggtgaagaaatagctgtcactcattcagcaagaaagagaattttgtattttgtgggtcga

SEQ ID NO: 16493 - DNA, 156 bp, Homo sapiens
  misc_feature 11: w=a or t
  misc_feature 26: w=a or t
  misc_feature 27: w=a or t
  misc_feature 32: w=a or t
  misc_feature 33: w=a or t
  misc_feature 88: w=a or t
  misc_feature 89: k=g or t
  misc_feature 106: r=a or g
  misc_feature 107: w=a or t
  misc_feature 108: w=a or t
  misc_feature 109: w=a or t
  misc_feature 134: w=a or t
tattggtagtwctgaacgttagatawwttttwwccatggggtcaaaaggtacctaagtatatgattgcgagtggaaaaataggggacwkaaatcaggtattggcarwwwttccattttcatttgtgtgtgaatwtttaatataaatgcggaggact

SEQ ID NO: 16494 - DNA, 152 bp, Homo sapiens
  misc_feature 117: n=a, g, c or t
ttgtttgtttgtttgttttaattggaatcttgctctgtcacccaggctgaagtgcagtagtgtgatctcagctcactgcaacctccgccgcctgggttcaagtgattctcgtgcctnagcctcccgagtagctgagactatagatgtgcgct

SEQ ID NO: 16495 - DNA, 105 bp, Homo sapiens
aatggagtggaatggaatggaatcaaaccgagtgcaggggaatggaatggaatggaatacaatggaatggaatcatccggaatggaatggaatggaatggaacct

SEQ ID NO: 16496 - DNA, 209 bp, Homo sapiens
  misc_feature 18: s=g or c
ttataattcatttcactsaaagtatatgattaaagctcattcaaagccctaagagttgggaatgaaggaagaattgtaggatgttctgctgtgccacaagacttaatttataccatttattagtcttaccaagtacattgaaaggaaaaagttgttgggggccaggcacgatggcttgcatctgtaatcccagcactttgggaggctga

SEQ ID NO: 16497 - DNA, 112 bp, Homo sapiens
aatttatataagccatcccccactgtcagattcttttttgttttaacttttattaggttcaggggtatatgtgcaggtttgttatgtaggtaaactgcatgtcacggggttt

SEQ ID NO: 16498 - DNA, 137 bp, Homo sapiens
  misc_feature 52: n=a, g, c or t
ttagaggttgagaacttgtcacttgttgtgaagctggggttcaaaggcagtnaaagtctgattctaaagtctctgctcatagcagtgcgttttaagccactctgacatatcttgcttttctttgctcatgtcattct

SEQ ID NO: 16499 - DNA, 53 bp, Homo sapiens
aagctgcccctgaaccccagaacaaccagctggatcagttctcacaggagcta

SEQ ID NO: 16500 - DNA, 203 bp, Homo sapiens
ttctgggggacaatgggattggaatgcaaacaaaatagagctttctatgaactaggtggtattcttagaatccaggatctggctggataatctgggccttttctctttcctaaaaagagccttttcctttctttctgggttactaacagaatatgacactgtttgctggcacaactagaatggctgctgagggtcaccgcgaa

SEQ ID NO: 16501 - DNA, 68 bp, Homo sapiens
atatatcttcaacatacttaaaaattatggctgttaatacatttgagcaatatgggtttaccccgcca

SEQ ID NO: 16502 - DNA, 57 bp, Homo sapiens
aaaaaactcctttttctctgcatgatacttctgcttattgtccttcacactagcacg

SEQ ID NO: 16503 - DNA, 135 bp, Homo sapiens
attttaatgttggcccaagccaggcacacccagggatagaagcacattgttctgtgcattccaaagcttgagcaaaagccctggccatacccacatcgagctcccctccactagttgctagaaatcagaaaggct

SEQ ID NO: 16504 - DNA, 147 bp, Homo sapiens
cctttatttccatagtgacactgaaatgactgctctttggtacagttctctaagggttaagtgccagaaagccaaggtaaaactttctgattgggttcagctccacagcttctgtcccacaaacatctgtctcttctagccccttat

SEQ ID NO: 16505 - DNA, 118 bp, Homo sapiens
aggtaggtcttttgtggcaaggaatatttgaaattgggcaagatgagtgagctgagatcgcgccactgcactccagcctgggcaacagagcgagactccatctcaaaaaaaaaaaaaa

SEQ ID NO: 16506 - DNA, 145 bp, Homo sapiens
cgtaaatgattaggttatagaaaacctgcagctggcctctcctgcttgtcccaagattctttgtattatgtaattagaaaatagaaatctctttgttgagaagagaaatttgaaatggaatttttctcttcttgccccctctgaa

SEQ ID NO: 16507 - DNA, 312 bp, Homo sapiens
  misc_feature 132: k=g or t
  misc_feature 142: w=a or t
  misc_feature 182: s=g or c
  misc_feature 194: y=c or t
  misc_feature 203: s=g or c
  misc_feature 205: w=a or t
  misc_feature 234: y=c or t
  misc_feature 275: k=g or t
  misc_feature 280: y=c or t
  misc_feature 288: n=a, g, c or t
aagtcaaagagtaataactgctcactagttgctttttagcatctctggtcttatcagccatgctaaatcactttaattagccttagtgattctatggttgagtaatctctacttgaactaaacaaacatctkttgtttctgwgtgtgtgtgctgtgtgtgagagtgtgcgcgcgcgtgtgtstgtgtgtgtttyaatggagtstwgccttgaatgaatcactgggaagccagcyatggtaagggctggtgaggttggggagaaaggaagagcttkatgtytctctgtngtttggaccctacttggcatgcca

SEQ ID NO: 16508 - DNA, 68 bp, Homo sapiens
aagcatagagcgatgctgggaactctcccaccgggtttggagccacgtggaggtagcgtggggaggta

SEQ ID NO: 16509 - DNA, 76 bp, Homo sapiens
cttttcaaaggatacagccctttgcctgtctgcacacaatggggaccttgaatttccagccagtgatacccaacag

SEQ ID NO: 16510 - DNA, 78 bp, Homo sapiens
ggatgtgagggcgatctggctgcgacatctgtcaccccattgatcgccagggttgattcggctgatctggctggctat

SEQ ID NO: 16511 - DNA, 120 bp, Homo sapiens
tttttagtagagacagggtttcagcatgttggccaggctggtctcgatctcctgacctcagatgatccaccctctcagccttccaaagtgctaggattataggtatgagccaccacgccc

SEQ ID NO: 16512 - DNA, 174 bp, Homo sapiens
caaaaaaattagccggcttagtggtgggtgcctgtagttccagctactctggaagctgaggcaggagagtggcatgaacccgggaggtggagtttgcagtgagctgagatcgcgccctgcactccagcctgggtgacagagcgagattctgtctcaaaaaaaaaaaaaaaaaaa

SEQ ID NO: 16513 - DNA, 315 bp, Homo sapiens
  misc_feature 184: k=g or t
tttgactgggcccacattaaagcatgtcccaaacgctatcttgatatatgtcctcagtagcaatcttgttttttaagccttcctttacaggttgattcacagtgggagagagccatgttcagaatttttttctgatagcctgaattttcttcttgtctttcatgtctttgcttctatttatgtkctttgtacctcttcttccttgaacttggatcttctgcatagttgactctattatatcatctttggggctgcagaataaaatgtggaagattttaaagttaaggttcccagaataatgttgtcgcccaccga

SEQ ID NO: 16514 - DNA, 128 bp, Homo sapiens
  misc_feature 86: s=g or c
catggcttcaacttcaaccagcagtatgcccaaggcatcccctaccataagggcaatgacaagggtgatgagagccagagccagtsagtacggaccctattcctggagctaatccgagcccgccaacc

SEQ ID NO: 16515 - DNA, 102 bp, Homo sapiens
gtcatcttttccccagaggcgtcggaatggacctgtgccacccagagcccgcggagtgagcagcggggagacggaagagttacagaggatcaagtggcacct

SEQ ID NO: 16516 - DNA, 195 bp, Homo sapiens
cagggaaaataggtagatcctctgaacacagaggaaggagggacgtccacgtttgtcctgtttagtgtcatactgaagaagagtatgaccagccagtgctgggcgttctgcagcttgggacagatgttggggggaagggcactgcctttcttgtgaactttcttgcccaagggacaaatgagctaagcagtacaa

SEQ ID NO: 16517 - DNA, 196 bp, Homo sapiens
  misc_feature 143: w=a or t
ccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcwacaaataatgatggttcctttgagaaagatactggtaaatgacagcaccaaac

SEQ ID NO: 16518 - DNA, 163 bp, Homo sapiens
aaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatat

SEQ ID NO: 16519 - DNA, 120 bp, Homo sapiens
tatagaccgggaggtattctaggtaaactttttgtctttgtctctatccattttgttagtatcttaaagagatgggaggaaaggcaagattaagttggttctttcaactctgagggttaa

SEQ ID NO: 16520 - DNA, 262 bp, Homo sapiens
aaatcaagtgtcatgcatgagctttccaaatgtctggcacaaatatctggttgatggtggtgctccttgtctgatattgtaaatgatggcagagtagatttgcaaggaaaattaagactttctgaacatgttaaaattgaggcactaatgagccattagtgacctaggcttcatgcatgagtgtaggactataggacacctagatgtgagtgtaccaaattgtccagagaatattaagagagaagagtccctagaccaagct

SEQ ID NO: 16521 - DNA, 121 bp, Homo sapiens
cgaatagacatggcattggcagacacatggtagacctcaggtctggtaggagcgcttggtgggactaaatataaacaaaggtattaagtatgaatacaattttataaaattcaggggaaac

SEQ ID NO: 16522 - DNA, 243 bp, Homo sapiens
  misc_feature 21: s=g or c
  misc_feature 23: k=g or t
ttatttgtttttgagatggastktcactcttgttgcctaggctggagtgcattggcgctatctcggctcaccgcaacctccgcctcgcaggttcaagcgattctcctgcctcagcctcctgagtagctgggattacaggcatgtgccgccatgctcggctaattttgtatttttaatagagacagggtttctccatcttggtcaggctggtctcgaactcctgacctcaggtgatctgcccaa

SEQ ID NO: 16523 - DNA, 76 bp, Homo sapiens
attccttgttacgggtaaagaaacaggcacaggaagttgtatcaggcgcctgctgaacgtgcgcatcgaccccgta

SEQ ID NO: 16524 - DNA, 60 bp, Homo sapiens
gaactccaggctgtcatggcggcaggacggcgtacttgcagtatctccacgacccgccca

SEQ ID NO: 16525 - DNA, 241 bp, Homo sapiens
  misc_feature 163: k=g or t
catttctggctattagacttcatgtggcataatggaaagattgtggcttttgtggcatacatatccaattttaaatcccaggcagccaccttttagctctggaagatagtttctgagccttggtttcctcatctctaatggggtgtggcggtgggggtgagtkatccaaccccccacgccccagagcttttgagaaatttcagtgagatcctgttatatagcagctgcgacactcccccac

SEQ ID NO: 16526 - DNA, 188 bp, Homo sapiens
taatcatcgttagaaccaaatcctcttataaagaacaaatataaaaaagttttctgtggtgaagctattttatagatttgatttccggagtagaattttaccttaattcacttaaagaaaattaaccattttttggtccaacttcagatattttcttaatccagaagctgtgactgttcccagaaacc

SEQ ID NO: 16527 - DNA, 105 bp, Homo sapiens
tatctaagactcatcctgatttttactatcacacatgaataaagcctttgtatctttctttctctaatgttgtatcatactcttctaaaacttgagtggctgcaa

SEQ ID NO: 16528 - DNA, 286 bp, Homo sapiens
aaagctgtggaacagaggaggctccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggggacaccatcgccagcgtcaatggcctgaatgtggaaggcatccggcatcgagagattgtggacatcc

SEQ ID NO: 16529 - DNA, 96 bp, Homo sapiens
  misc_feature 86: n=a, g, c or t
tgttggccaggctggtcttgaactcttgacctcaggcaatccacccgcttcggcctcccaaagtgctgggattacaggcgtgagcnaccgcgccta

SEQ ID NO: 16530 - DNA, 201 bp, Homo sapiens
tatcagaaaaacctcatcccttccatttatatgaaatgcctagaaaaggcaaatctgggccaggcgcggtggctcactcctgtaatcccagcactttgggaggccgaggcaggtggatcacgaggtgaggagatcgagactgtcctggctaacacggtgaaaccccgtctctactaaaaatacgaaaaattagctgggcaa

SEQ ID NO: 16531 - DNA, 102 bp, Homo sapiens
cattttacttggaaatatgatttcttgccccttctatgccatgacactgtggtatgaagaacattttttactgtttatttcttgatttgctgcctccagaaa

SEQ ID NO: 16532 - DNA, 81 bp, Homo sapiens
tgtcactggagagttgaaggcaataattgtaaaggttgggccagatgtcttcatgtgctcacagtggtatagcctactccc

SEQ ID NO: 16533 - DNA, 199 bp, Homo sapiens
tgtagactgggtggtttatagacaacagacctttatttctcatagttctagaggctgggaagttcaagatcaaggtactggcagattcagtatctggtgaagactgattcttcacagaagcactcctacatggtggaaggggcaagggcatctctggggctgcttttataaaggcattaatatccaagaatccgcacca

SEQ ID NO: 16534 - DNA, 201 bp, Homo sapiens
actcagtgtttctgtctcaagacagccagctcctaacccttctcagcaagcagaatcctgacgttagtgtcccggacagcatctaaaagctttatgctagaacattcctagcaggacacagaaggaccaggatcatcggctgcctccagggagagaaatgggaaggcagggggtagagaacacttgcttttcacagaataa

SEQ ID NO: 16535 - DNA, 96 bp, Homo sapiens
aacctgctctggttcccttccacgctgtggaagctttgttcttttggtcttcatgataaatcttgctgctgctcactcgttgggtccgtgccaccc

SEQ ID NO: 16536 - DNA, 181 bp, Homo sapiens
aataggaaaatacatgaagacatgtgagatgtgtgcatgcacctgtacgtgcaacttcagttggctaagatggtctaagattaatacactcagggagtaggaatagataagacattataaaatatgctgtctaaacatgtttgaatcactctaagtgccaagaatttcttttggaactact

SEQ ID NO: 16537 - DNA, 221 bp, Homo sapiens
gctccgcctcccaggttcaagcgattttcctgcctcagccccccaagtagctgggactataggtacgtgccaccatgcctggctaattttttgtatttttagtagagactgggtttcaccatgttagccaggatggtcttgatcttctgacctcatgatcctcccacctcggcctcccgaagtgctgggattacaggcatgagccaccacgccgggccaga

SEQ ID NO: 16538 - DNA, 88 bp, Homo sapiens
aacatttaggagtaaggagaacactcattctatcagctttggggttaagggaggataagaacataaaaagcacccatctcacccacgc

SEQ ID NO: 16539 - DNA, 107 bp, Homo sapiens
ggatgtgagggcgatctggctgcgacatctgtcaccccattgatcgccagggttgattcggctgatctggctggctaggcgggtgtccccttcctccctcaccgccc

SEQ ID NO: 16540 - DNA, 78 bp, Homo sapiens
ctatcaaatagtaggtcttattcattctttctatttgtttgtacccattaaccatccctaccttctccccaaccccca

SEQ ID NO: 16541 - DNA, 149 bp, Homo sapiens
aaatattcatgagtcaaagcttgaataaacaaacaaataggagaagctcaacaccacccctcaagtaggtagagtttaacactccaacccttgagtttgagctgtgcttggtgacttacttgtgaaaagcagaatgtggaaagtggacc

SEQ ID NO: 16542 - DNA, 127 bp, Homo sapiens
attatttcaaaccacactagggtacagagctcgtgcttcgggatggaaacctatggttatctgcagagggagtcatgctttcaaggacctcatgaactctattttaagaacctctcaaaacgaacac

SEQ ID NO: 16543 - DNA, 171 bp, Homo sapiens
aggttagagaggggttggcttctggcctctgagcagcaggggagcctgggcgcatccacagaagatagagaggactcaggacagactgataagaggattggatggtctggaggggagaaaagaatgaaaagagatgaagagagcggggagaggcaggcctctgtggggata

SEQ ID NO: 16544 - DNA, 135 bp, Homo sapiens
aggaagaagagtggaagtgaagaaggtggtataaatgctgtcaatttttttttaacccaagtattttggtggggaaaagcaagtatctattgcttagcatatgtaaagttgtagtctatatttatggggccatat

SEQ ID NO: 16545 - DNA, 119 bp, Homo sapiens
ttctgtcgcatgcagtgcctgtactggtgcctaccatacacggaaagcaaaacagaaaaacagaagacaaaaaatagagatcagcaagaaaacacacgccctgccctgccaccccccct

SEQ ID NO: 16546 - DNA, 341 bp, Homo sapiens
gctcaaaaaagcctaactcactcggctccacaggctggggacaggggtggcatgtgtctcccagggctcataccctaatgcacatgcccctaatacggtcttcagtgttactcatcttgttttgtgtccccttccagactctcctgtacctagaccagggctggacatacagtaggtactcaataaagtctagttaattccaggctctttccaacacaaatcaaatcacatcaaatttttagtaattcccatgactcttagaataaaattgcaaacccacactgggtcttataaggccctgcatggtagctctgcctcttctggccccaggctcaccccga

SEQ ID NO: 16547 - DNA, 316 bp, Homo sapiens
  misc_feature 54: k=g or t
  misc_feature 303: s=g or c
tctccacgtcttgatggtagtggtcccccggggcccagctgctctttatctcgkgtctttattacaatctctggtctctgcacacggggaggacacctgctaagcccccgtaggctggaccctacagaaaaccacacccctctcttgccctgctccttagttacctccacctttaccttcccctttgcagcaaattgacctgaaagagaagttggtgttcacagcccctgcgtgctctctgctcactctccaaactccagcccctggccccagcgccgctggccctcggtgagtcgcagtggsccaccctgctgca

SEQ ID NO: 16548 - DNA, 127 bp, Homo sapiens
tctatacctgctatgcagagattgagaaccaaaccaaatggatatctgcttttaagattagaatttgttcttcatccttaaagcgaactcattgagatgaaaagatgctcttaatttatcacagaac

SEQ ID NO: 16549 - DNA, 85 bp, Homo sapiens
aagactatactttcagggatcatttctatagtgtgttactagagaagtttctctgaacgtgtagagcaccgaaaaccgcgaggaa

SEQ ID NO: 16550 - DNA, 203 bp, Homo sapiens
ctcttcgcttttgtggcggcgcccgcgctcgcaggccactctctgctgtcgcccgtcccgcgcgctcctccgacccgcgagacctcctctttttcttcttctcatcgcttccactccaggttgctttcaggaccttcaaaatctctttgtattttaaagaccaatttaccccccaaggcctgcagatcatgattgagcaccct

SEQ ID NO: 16551 - DNA, 90 bp, Homo sapiens
tttttaatgtgtagttggtctatgatatgatttggatatttgtacccttcaaatctcatgttgaaatgggattcccaatgtaggatgtgg

SEQ ID NO: 16552 - DNA, 90 bp, Homo sapiens
  misc_feature 36: n=a, g, c or t
  misc_feature 40: s=g or c
ccctccctccccagccttccccgcgagcggacgcgncagscctctgtctcgctttttcttatttttcccccctttcccctttcttttttt

SEQ ID NO: 16553 - DNA, 113 bp, Homo sapiens
  misc_feature 56: s=g or c
aagggttttctttcacgctttctgaggaggagagcatggcgcgggcctcggcgaasacttccgtcagcctcgggcggaggatcgtcttagtagctggccagacctggaggaaa

SEQ ID NO: 16554 - DNA, 183 bp, Homo sapiens
gtctatagggtaagctgggcctttagggtcagaaagaggccagtcctcgatgatcagagtatagggaggacttgggcccattcattgcaggagaagggctccaccttcctgcagctgggctcttccaccgagcaacagcttcaggtcatctttgaggtgctggaggagtatgactggacgccc

SEQ ID NO: 16555 - DNA, 137 bp, Homo sapiens
ccaaaagaacaaagaaataaaaaagccacgaaagactcaaaggaagcagattttcgaccacagccaacctcagaacaattctgagttgctcattttaagatcaataaggcatttttttagggtgtgtatgcccgaga

SEQ ID NO: 16556 - DNA, 225 bp, Homo sapiens
tttttcctatcagtgcctaggactttaatgtatataacttaaaaaaaaacatctcttagagttgtagctacatatacaggaaatctaacaaatgtgtagcataatgtattatacaaaggcagacacccttgcagccaccaacaaggtcaagaaacaattttgctgcctgtcctagaagcccctccttatggtcctatccagacacacacttctggcttccctcaa

SEQ ID NO: 16557 - DNA, 93 bp, Homo sapiens
aagactatactttcagggatcatttctatagtgtgttactagagaagtttctctgaacgtgtagagcaccgaaaaccacgaggaagagaggcc

SEQ ID NO: 16558 - DNA, 121 bp, Homo sapiens
  misc_feature 33: m=a or c
  misc_feature 34: m=a or c
aaagaaaaaatagaaggtgaatcggtaggtaammagagacaatagactaccagccaatctcaatgtgtgaaccttgtttgtatcctgattcaagaaaagacattaaaaagattgtctgaaa

SEQ ID NO: 16559 - DNA, 162 bp, Homo sapiens
atggaatccccttaaataggtgtctccagccaacggcttgaaccgcctgcccacaccctcccctgagccaccccccagcgtggtccgcttcgccatgccgcccggccacacgcacagcgggtctgattcctccgactcggagtatagttcccagacgacaca

SEQ ID NO: 16560 - DNA, 151 bp, Homo sapiens
ggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcggagaggaca

SEQ ID NO: 16561 - DNA, 122 bp, Homo sapiens
  misc_feature 12: y=c or t
tgtttctacctygtgggtggggcctggttaatggtggggatgtagaatggggctcaacaggcagggcatccagatggtactggaaaccccaaactcaagaactaactaggtcagacccccct

SEQ ID NO: 16562 - DNA, 240 bp, Homo sapiens
agagaaggtaatatggccattgggcaggtagctaggagtgtttggtattaataccctccatctcacccactctctctcagtaaatgacataccattcaactcaaccagttcttgtagccagaaacctgggactcatcctcagatctccacctctctcctcttccacactattcaatcaataattccattgattctaccttgaacacagctctgtaatcagctttctcttttgccgcccat

SEQ ID NO: 16563 - DNA, 98 bp, Homo sapiens
gtgcccaaaagcgggcccctcaaggggaggcaaccacggtctctgaatatttcttcaatgatatcttcattgaagtggatgaaacagaataaaagcct

SEQ ID NO: 16564 - DNA, 159 bp, Homo sapiens
caatgttattagggagcctgctattggaacttggaagattatcagtagcagaaaaactgaagtgggaatggaaagacgtgaaagtagaacttagcctgggctagttctccagagtcttgagtctggggaggaactgccctttcatctttaccatgggaa

SEQ ID NO: 16565 - DNA, 164 bp, Homo sapiens
aatgtgggtgtgcgctgggtttctggatctctaggtctggaaaggctttcctttctttgacacccagcagtgatcttagggagtgcttcatgctctcttcaggatggaacagagcgctttgcatagagtgcccctgggtgatggtggcgagttacccggcaggg

SEQ ID NO: 16566 - DNA, 294 bp, Homo sapiens
  misc_feature 84: k=g or t
  misc_feature 115: r=a or g
  misc_feature 116: r=a or g
ctctccattcccataaacctcaacaactgctcgaagtcctgcttgacttcttgtctccagactttgaaatcttccttgcatatkactgtctcattaccttcctaaaatctagttrrttcacctaatcaagaatctacaggggtctactctggccaatttgataagttctcatttcttctctttactaatacttcttacttcctttacttcatctattccctagtataattccctagtataattcctccatcctaattagaactgtcttcctacacatccctgactctccaccca

SEQ ID NO: 16567 - DNA, 210 bp, Homo sapiens
  misc_feature 23: s=g or c
  misc_feature 31: r=a or g
  misc_feature 43: k=g or t
  misc_feature 44: k=g or t
  misc_feature 75: r=a or g
  misc_feature 107: y=c or t
  misc_feature 108: w=a or t
  misc_feature 209: s=g or c
  misc_feature 210: r=a or g
tttttcgtgtgtgtgtgtgtgtstgtatgtrtgtgtgtgtgakkgagcttcgctcttgttgcccaggctggagtrcaatggtgcgatcttggctcactgcaacctcywcctcccgggttcaagcaattcttctgcctcagcctcccgagtagctgggattacaggcatgcactaccatgcctggctaattttgtatttttagtagagasr

SEQ ID NO: 16568 - DNA, 104 bp, Homo sapiens
ctttcgtgtccctcttctggttgctttagaagtgacgtgtaatttctgaacccatgtttcatctgtataaaagaacatctgcaccagtttttctcctgccccca

SEQ ID NO: 16569 - DNA, 127 bp, Homo sapiens
  misc_feature 105: n=a, g, c or t
agacttccggaaggactttggcgagggggcagccattttggggggtgctgatggatacctgcggggtcggctatgttgccctgggggaggccggccccgtggggnaacatgactgtggtagactctc

SEQ ID NO: 16570 - DNA, 307 bp, Homo sapiens
tcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttggct

SEQ ID NO: 16571 - DNA, 129 bp, Homo sapiens
  misc_feature 56: s=g or c
agagaagggctgtcgcaggctccacccttgccaccgcagaggcccggggctgaaasaggcagccaggcccaggccctgctgacctaagccgcgacccctgaccctcggcctcgccctctagccccaagt

SEQ ID NO: 16572 - DNA, 211 bp, Homo sapiens
  misc_feature 65: y=c or t
ttcttccactccccgcggcgcagcggctgactgcccggagaggaaacgacattcggagctgcgcyccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggc

SEQ ID NO: 16573 - DNA, 189 bp, Homo sapiens
  misc_feature 95: r=a or g
taatcagctcagggtatttgccaatctgaaataaaagtgggatgggagagtgtgtccttcagatcaagggtactaaagtccctttcgctgcagtragtgagaggtatgttgtgtgtgaatgtacggatgtgtgtttgcgtgcatgtttgtgcatgtgtgactgtgcatgttatgtttctccatgtggtg

SEQ ID NO: 16574 - DNA, 138 bp, Homo sapiens
gcgttcccctttttcggggggcagggtgggggagtgtccctgcatccttccaccaggcagatttaagactgctaagcgtttgcggacaggattatcttgtgttttcttttctttttttctttaacctttttttttttt

SEQ ID NO: 16575 - DNA, 262 bp, Homo sapiens
ttgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaaca

SEQ ID NO: 16576 - DNA, 227 bp, Homo sapiens
aaattaccaaacaggaactgtttgttttagcttaaggttttcgtcttttctttttccttcctgaaaattaactacagaaaattccaggtttccagggttgtagcgagttgaattttaagtgatttgagatacgaagtccacatttctgtggcctgtctagaggttctcatcttgctaaatgacatttagaagcagcataactgcttctaatctaggattaccacgcc

SEQ ID NO: 16577 - DNA, 100 bp, Homo sapiens
  misc_feature 93: s=g or c
actgggatgcagaggctgcagtgagccatgttggtgctggtgcactccagcctgagcaagaccttgtctcagaaaaaaaaaaagttcacaaascccacca

SEQ ID NO: 16578 - DNA, 137 bp, Homo sapiens
ctttttttttcgtctgggctgccaacatgccatccagactgaggaaggcccgagagcatgtccgcatggtcatcattaaccagctccaaccctttgcagaaatctgcaatgatgccaaggtgccagccaaagacccg

SEQ ID NO: 16579 - DNA, 218 bp, Homo sapiens
  misc_feature 12: y=c or t
acttttgttgtytcaggttttcctgggagtgtttggcagggagggataagaatgcagagttaaaagttaataaatactggtgaggtcagaggaggccgagagctggagggaaagggaaaggggttcggaatgtaacctacttgttaacacctgtcacagggttccccctccagcaagcggagaagccctttgctgcagccaattatcgaggacgaaac

SEQ ID NO: 16580 - DNA, 116 bp, Homo sapiens
acatagttgtttagaatatgacttacttgctttataaaaccattttttcattttttatttttcgaggagggatgaggatttgcctgaaaacatttttttctcacaagctgcccccg

SEQ ID NO: 16581 - DNA, 113 bp, Homo sapiens
aaattatttgaaaagcaagcctgtgaattgctgtggaggaacaatagcctgtctcttatctggagcctttccaaggaaaagcaaaggggaccctagaaggcttcctggccact

SEQ ID NO: 16582 - DNA, 106 bp, Homo sapiens
ggatgtgagggcgatctggctgcgacatctgtcaccccattgatcgccagggttgattcggctgatctggctggctaggcgggtgtccccttcctcccacaccgca

SEQ ID NO: 16583 - DNA, 80 bp, Homo sapiens
aaagactatactttcagggatcatttctatagtgtgttactagagaagtttctctgaacgtgtagagcaccgaaaaccac

SEQ ID NO: 16584 - DNA, 183 bp, Homo sapiens
  misc_feature 117: s=g or c
caacatggccgcgcccaggggagatggcgtgcaagtatccgctgcggtgttctggtgctagagtggagaggctggcaaagaagaaggcacacgcatggtgagaatccggcctgagcsgaagcggagtttgctatggacagcaaccatcaaagtaattacaaactcgcacctgaaacaagctac

SEQ ID NO: 16585 - DNA, 242 bp, Homo sapiens
acaagcgtgtcattttcagtggctccattttaaatcagtctgctgcctcagaatcccttgcaagaacagcaaggaaaaggaagccctctccagaaccagaaggtgaagtcgggccccctaagatcaacggagaggcccagccgtggctgtccacatccacagaggggctcaagatccccatgactcctacatcctctttgtgtctccgccaccacccactgcctcacctcattccaaaccgg

SEQ ID NO: 16586 - DNA, 113 bp, Homo sapiens
  misc_feature 32: r=a or g
  misc_feature 75: w=a or t
  misc_feature 76: w=a or t
gaattgttatacatttcaggtctaaggcattraattattcgtgcctcgggcctgcggaagtgaagatatacagtwwaattaggttagccttaagaagcatttaaatatgttca

SEQ ID NO: 16587 - DNA, 67 bp, Homo sapiens
ccttgttttggggggtttaggggtgtttttgtttttcagttgttttgtttttttgtttttttttttt

SEQ ID NO: 16588 - DNA, 242 bp, Homo sapiens
  misc_feature 30: w=a or t
  misc_feature 31: y=c or t
  misc_feature 35: h=a or c or t
  misc_feature 36: k=g or t
  misc_feature 63: m=a or c
  misc_feature 64: w=a or t
  misc_feature 110: k=g or t
  misc_feature 111: k=g or t
  misc_feature 118: y=c or t
  misc_feature 133: s=g or c
  misc_feature 152: w=a or t
  misc_feature 153: y=c or t
  misc_feature 200: m=a or c
  misc_feature 201: w=a or t
  misc_feature 202: k=g or t
  misc_feature 204: s=g or c
caacagtttcaggcccccaaaccgtttccwycgghkggtctccaaaacaacccacggctcaamwcctcctttatcattaccatctcccgcgtggagttctcctcaggtckkgcgaaayacccccagattcttsgcacagtgtctagatccgwycgcccaacgtttgcctcccagcctgactccctcggcccttacccacmwktsaccccctctacgctctccttcctcgccagcacgcctat

SEQ ID NO: 16589 - DNA, 146 bp, Homo sapiens
aaatgaggatagtaagaactacctcgtagtgatattgcgaaggttagaagaaacgcatggcataattacttggtagctattgttagatctgggagtgtgaaatggtagcgttttgtccctgtcttcacactatcatagggaggtaa

SEQ ID NO: 16590 - DNA, 80 bp, Homo sapiens
agacggagatcaactaaggtggcaggtaaggttcagaaaaggagaaggacaacaaatttggagaaataggagaaggcacc

SEQ ID NO: 16591 - DNA, 122 bp, Homo sapiens
  misc_feature 91: b=c or g or t
ctatcaagaggctttccccctatgttttcttctaggagttttatggtttcaggtcttatttgggtctttggtcttgtatctgttttgagtbgatttttgtgtatggtgtatgatcagggtca

SEQ ID NO: 16592 - DNA, 84 bp, Homo sapiens
aaattttttgtatttttagtagagatggggtttcaccatggtagccaggatggtctcgatctcctgacctcgtgatccacccgg

SEQ ID NO: 16593 - DNA, 65 bp, Homo sapiens
  misc_feature 65: k=g or t
agaggggaaatgcgacggcacatcaagtggcaaaaaactagatttacaagaggaaagaggcgcak

SEQ ID NO: 16594 - DNA, 125 bp, Homo sapiens
ccttgtctgcgttccgtgtccaggcaggtgcaggcgccgcggggccggatcctccgcgcggccgagtccatctcctgggaaatggggcggacagtgtttccttgactgactattgtgagcgcccc

SEQ ID NO: 16595 - DNA, 100 bp, Homo sapiens
agtcgtcccaccggaggcgtcgctttctagtgtctgtggtgtcggcgctgcaggatgacgcgagcctctcgcgtccctgcttttctcggtcgcagcgtat

SEQ ID NO: 16596 - DNA, 191 bp, Homo sapiens
ctagaatatagaaatacattgacttttgtctatctctgtcaaagtcaaataaaaatatagagataaatctctaaacaaaatgttttctttgggaaaacagaaatgtaatttcgggcatacaaacagagtagagtagtcttcagtgtgtctacagagcaaagagaaggttgaggattttttttttttttttt

SEQ ID NO: 16597 - DNA, 165 bp, Homo sapiens
catcatcttgattttggagttttaaaaataccaaaactctgtgccccactgtctatgctgcattctttgactgtagtcccttctctggggtggcctctgggcagctgacttcagtgtgctggtcccactgtacagctgtactttcctgacctgtttagctcccga

SEQ ID NO: 16598 - DNA, 100 bp, Homo sapiens
tggtaaattcaaaatttgcttcttgggactttggtggtttttttccccaaatatttttgacttgcagttgtttgaatccatgaatgtgaaacccacagat

SEQ ID NO: 16599 - DNA, 273 bp, Homo sapiens
  misc_feature 243: n=a, g, c or t
  misc_feature 244: n=a, g, c or t
gagtctcactctgttgcccaggccggagtgcagtgccatgatctcggctcactgcagcctctgcctcctgggttcagacgattctcttgcctcagcctcccaagtagctgggactacaggtgcgtgccaccacgcctggctaatttttttattttagtagagacagggtttcaccatgtgagccaggatggtctcgatctcctgacctcgtgatctgcccaccttggcctcccaaagtgctgnnattacaggcgtgagccactgtgcctaacc

SEQ ID NO: 16600 - DNA, 170 bp, Homo sapiens
ccaaaagttttctgtaattacaggttgccaacctgtaaaaagaagggctaattatacatcctggttgctgctctcctggggccaatggccagtgttaacagggaaggctgccatgtttcacaattactgcaaaccaacacagctagaaactttttccctaaaggatgaac

SEQ ID NO: 16601 - DNA, 213 bp, Homo sapiens
  misc_feature 7: n=a, g, c or t
  misc_feature 8: m=a or c
  misc_feature 9: s=g or c
aactagnmsgaagtccggggttgacgatggctgtgttgttgaagggcctgtagccggggggttcctggccggatcccggtctacccttagcccagactcgttccggaccccagcccggcccggaacactctaggcgagacggcggtggcaactctccccttgccgccatgcacgacgctttcgagccagtgccgatcctagaaaagctgcccc

SEQ ID NO: 16602 - DNA, 244 bp, Homo sapiens
aaagtgagggcggcggatgggcgaaggtccggtgactgcgactgtcgctgctttctgaggccacaggaaaggggccgtcggtcgccgccatgacagcgagcgaggcggaggtttgtagcacttcttatgggctgagggcgtagacacatcctgcttccagcctagcaggcaaacgggaacggaagtgataggggatcagaagttgcgaggggatgaggagtaggggaaaccgacaagcggcgga

SEQ ID NO: 16603 - DNA, 87 bp, Homo sapiens
atgatgaccggactccaagctttgtctcatgcaccaccttgttcagtgcccagcctcagcaaggaccgatccctatgcctctgccca

SEQ ID NO: 16604 - DNA, 217 bp, Homo sapiens
taattttttgtatttttagtagagatggggtttcaccgtgttagccgggatggtctcgatctcctgacctcgtgatccgcccgcctcggcctcccaaagtgctgggactacaggcgcgtgccaccacgcccagctaatttttgtatttttagtagagacggggtttcaccatgttggccaggatggtctcactctcttgacctcatgacccacctgc

SEQ ID NO: 16605 - DNA, 173 bp, Homo sapiens
gcacacacgcgaaggcacttccacgcggtccccacgcgccaagagactggcagatgcacgagcctacagctggagggttggactgacagcccctcttgatcaggagtaaatagaacgggaaagaatttgatttgcgcaactgggcgctaaggagcggctcggacggagggaga

SEQ ID NO: 16606 - DNA, 184 bp, Homo sapiens
acacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggga

SEQ ID NO: 16607 - DNA, 162 bp, Homo sapiens
ttgatatgagactatgtggttaaaaaacccaagtatgtccatgtgtttcttataaggtacacttgaaactagtgagtgtttgtcacatttcactttcatggtatataaaatgcagtttgcatatataacttgaatatctggtactagttttttcacgccttg

SEQ ID NO: 16608 - DNA, 372 bp, Homo sapiens
  misc_feature 8: s=g or c
  misc_feature 9: s=g or c
  misc_feature 136: s=g or c
  misc_feature 138: n=a, g, c or t
  misc_feature 139: s=g or c
ggctctgssccctgcagctctgccactcaggtctcccatggtaagtctctccttccccagcacctgtccattcctaccttttggaagcaccaggaggtgggcctgggtcctctgctgcctcttcaagccttcatasgnsgctcgcaggaactggatgctgagtgggggccctttcccaggggcctgagtcctggagccctcagccattaagtgagacctaagctgccagaagtggggcagggctgggcacgggcagggcaacccctccatccggatccgggagaaaagcaaacacagctgggtggggcaggacctggggaggggagagagagggagggggcagtgagggagaaggagaagtgacgggccaca

SEQ ID NO: 16609 - DNA, 110 bp, Homo sapiens
aggatgtgagggcgatctggctgcgacatctgtcaccccattgatcgccagggttgattcggctgatctggctggctaggcgggtgtccccttcctccctcaccgcccca

SEQ ID NO: 16610 - DNA, 77 bp, Homo sapiens
aagactatactttcagggatcatttctatagtgtgttactagagaaatttctctgaacgtgtagagcaccgaaaact

SEQ ID NO: 16611 - DNA, 227 bp, Homo sapiens
aattccaaaatctgaaaaagttaaatctgaagcacttctgttcccacacatttcagataagggatactcaacctgtatctactttttaaaaataatattctgaaattcgatactgtttttcatcttccatgctatttttgctatcaagatatggttacatacagtggctggtccataatatattcctatataatattttagatgtttccttatgagtcatgattcag

SEQ ID NO: 16612 - DNA, 181 bp, Homo sapiens
agggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggct

SEQ ID NO: 16613 - DNA, 171 bp, Homo sapiens
gcagaggattggccgggtgtggtggcgtgtgcctgtggtcccagctactcaggaggctgaggcaggggaatcgcttgaacccgggaggtggaggtttcagtgggccgagattgcaccactgcacttcagtctgagtaacaagagcaagactctgtctcaggaaaaaaaaaa

SEQ ID NO: 16614 - DNA, 179 bp, Homo sapiens
atatattcccgatcagacctctttgaaccacaccggccattcctcccacggtccaggcctgtgctgcccttgcctgctgggtctcctccctgccacggagcttcctcttcaacagttttttcttacatgacaggcagagggttacttttaagccccaaaccagatcctgtgggttccac

SEQ ID NO: 16615 - DNA, 216 bp, Homo sapiens
tggatctatttttctacctgtatctgggaaacccctggggtgtggctcctggggcggggtttggggggagtaggaggatgcacaaacgttctgagtcagagcccaccttctcccagcccagagacccctgcagcctgcgtgggtccccttcccctggcctctgcccttagggatgaggagcccaggaggatggtgaccgggagtggaggacagctt

SEQ ID NO: 16616 - DNA, 132 bp, Homo sapiens
gggccacaacggccgtcggaccacggcgcggcggccagttcctttatagttttgttcagaaaaacatatggagacgtttatacccattgatttgacaactgaaaatcaagagatggacaaggaggaaaccaa

SEQ ID NO: 16617 - DNA, 131 bp, Homo sapiens
tgtaatcccagcactttgggaggccaaggcgggcggatcacctgaggtctcgaactcctgaccttgtgatccgccggcttcagcctcccaatgtgctgggattacaggtgtgagcaactgtgacccggccc

SEQ ID NO: 16618 - DNA, 258 bp, Homo sapiens
gcacacccactgacctgcgcccactgtctggcactccctggtgagatgaacctggtacctcagatggaaatgcagaaatcacccgtcttctgcgtcactcaggctgggagctgtagaccggagctgttcctattcggccatcttggctcctccccgtctttctactattttttgacttaaagattgttttatgtaagtatagctactcctcctcttttttgattttcatttttttcttaatccatttagcccaccgac

SEQ ID NO: 16619 - DNA, 95 bp, Homo sapiens
taaaaataaatttaagaaacctagccaggcgtggtagcgtgtgcctgtggtcccagctacttgggaggctaggatgggaggatcacttgagccca

SEQ ID NO: 16620 - DNA, 205 bp, Homo sapiens
  misc_feature 174: m=a or c
  misc_feature 178: r=a or g
  misc_feature 179: r=a or g
tcgaattatagaagattggccaggcacagtggctcatgcctgtaatcccagcactttgggaggccaaggtgggagagtcgcttgagcccagagtttgagatcagcctgggcaacatggcaagaacctgtcccaaatttaatataataaattttaaataaaattttaaaaataamattrrataaaaaattatacaggagggcacaa

SEQ ID NO: 16621 - DNA, 129 bp, Homo sapiens
gtcagtagtcgcggggcaggtacgtgcgctcgcggttctctcgcggaggtcggcggtggcgggagcgggctccggagagcctgagagcacggtggggcggggcgggagaaagtggccgcccggaggaac

SEQ ID NO: 16622 - DNA, 282 bp, Homo sapiens
  misc_feature 176: n=a, g, c or t
tatggattacgttttccttatacaatccaccattgatgagcacctgggttgattccatatttctgctattgtggatagagctgtgacgaacatacaggtgcatgcatcctttgggtaaaatgatttattttcctttggatatatacccagtaatgcaattgctgagtggaatggtngttcaaatcttggttgtttgagaaatctccaaagtgctctactcaatggctaaattaatttacattcacaccaaaaaggtatgtgtccccctttctccacagcctc

SEQ ID NO: 16623 - DNA, 105 bp, Homo sapiens
attttgtgtctcagcagtgcagggattggggatggaaaaagtcgccagtttttgtgtgtttgtgtgtgtgtgtaaagtggactttccactgtaatccaaccacca

SEQ ID NO: 16624 - DNA, 160 bp, Homo sapiens
agcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggct

SEQ ID NO: 16625 - DNA, 92 bp, Homo sapiens
  misc_feature 92: s=g or c
agctgggggcgagagcgaggctacggagcaggcgagaggcgacggcgagagctagagcgggcgcacgttagggtggccgtgcaaggggagcs

SEQ ID NO: 16626 - DNA, 288 bp, Homo sapiens
agtttcactgttgttgcccaggctggagtgcaatggctcactgcaacctccacctcctgggttcaggttgttctcctgcctcagcttcctgagtagctacaggtgcccacaaccacacccagctaatttttgtgtttttggtagagatggggtttcaccatgttggccaggctggtctggaactcctgacctcaggtgatctgcccacctcggcctcccaaagtgctgggattacaggcgtgagcaccgtgcccagcccattgtcactttttactgagcacctgcata

SEQ ID NO: 16627 - DNA, 68 bp, Homo sapiens
  misc_feature 2: w=a or t
  misc_feature 3: w=a or t
  misc_feature 4: w=a or t
  misc_feature 16: w=a or t
  misc_feature 18: r=a or g
  misc_feature 37: w=a or t
  misc_feature 40: r=a or g
cwwwattcagattagwtrtttaaccaagctctctggwtaratgtttctactcctccattcccattcgt

SEQ ID NO: 16628 - DNA, 230 bp, Homo sapiens
actccgcagaggcccgagcgggctcgcgagggaacgggttctccgagtctggccggtgctccccgaaggacaccagcccaatggagatggtctgcaggaatggccggatggcaggcgtgaactgtggagagacgcggctgcgtcacccaccgctcaagagagggatggggacagggcaggagcgaggcacagggctgtgcggggaagacacattcattcagtaaacgaca

SEQ ID NO: 16629 - DNA, 243 bp, Homo sapiens
tctttgaagccctgagggctggtgtataggagttcaaagcactggctttggaaccggactgtctgggtttgaatcctggcactgcagctgactcactgatggactcaggcaatgccttaaactccctgagcctcaggttccttgtctgtaaaatgataaagatagcccctgtttcatagggctgtggtgagaaaccaatcagacaaggcatgtgaacgccattatagcacagcgcccggctga

SEQ ID NO: 16630 - DNA, 73 bp, Homo sapiens
attagggcctctcactggggagcacaaaggcagctgccccatttcatgtcttttttttttttttttttttttt

SEQ ID NO: 16631 - DNA, 283 bp, Homo sapiens
  misc_feature 206: y=c or t
  misc_feature 207: s=g or c
gatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagccysgggttcggcgctatggaggagctcgatggcgagccaacagtcactttgattccaggcgtgaattccaagaagaacc

SEQ ID NO: 16632 - DNA, 135 bp, Homo sapiens
cctccaaaaagaagtggggaaagaaccatcaaacctttcctcctgacttaccaaaccaggaaaacagcaggagagggtggctcaggacttagggacagggtatagcttagatggtggaaagcaaaggagagcaaa

SEQ ID NO: 16633 - DNA, 352 bp, Homo sapiens
tcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttttggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattat

SEQ ID NO: 16634 - DNA, 171 bp, Homo sapiens
  misc_feature 33: s=g or c
  misc_feature 83: s=g or c
agctccgagggcggctggcccggtcgcggtcgsgctctttccagctcctggcagccgggcacccgaagaacgggtcgtgcaasacgcagctggacctggcccagccatggaccgaaaagtggcccgagaattccggcataaggtggattttctgattgaaaatgatgctca

SEQ ID NO: 16635 - DNA, 176 bp, Homo sapiens
tatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccaccatga

SEQ ID NO: 16636 - DNA, 176 bp, Homo sapiens
aaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaaca

SEQ ID NO: 16637 - DNA, 245 bp, Homo sapiens
gcctctagggatggctgggaattctgccaccttcccctaattctaaccagagggctggatcctgaaggtcactgagtcctgctgaggggatcaatacaccttccataacggggaagctgggacaggaggggtggggtcagcaggaaccccagcaggcttttctcatggggagggaattcactcccccctcaacaattatagccaacattgtggagtcttacccttattctaagcttttttttttt

SEQ ID NO: 16638 - DNA, 62 bp, Homo sapiens
ttgataagtctgctttaattcttcattttatatatatatgtattcttttttttttttttttt

SEQ ID NO: 16639 - DNA, 292 bp, Homo sapiens
  misc_feature 291: r=a or g
agaagagggtccttgagagcgctggccgtgccgtgccgccaaacactcctcaccaccgaatgtgggaaacgtcttccttggagtctagcactccctgcccgccccggatggaatttggttttctgcgcagggtcgccccttggagcccgtttccaaatgattttaagagggaagggaatctagggaggccgattccaggggcgagggcggaaaacccaggccgggcagccgaggagcggcgtgggcactagaagcggctcgccgcttcctactgtgagaggcggaaagcgra

SEQ ID NO: 16640 - DNA, 105 bp, Homo sapiens
aaaaggctccgggcgggcccgggacctggagggcccgagctagcgggggcgagcggtccggaggtccggtttcggcggctgcatgttgtgcctgggtcagtccaa

SEQ ID NO: 16641 - DNA, 161 bp, Homo sapiens
ttagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaa

SEQ ID NO: 16642 - DNA, 103 bp, Homo sapiens
agttttcgctgaggagaaacacgaaacggaccctttggctctcccccttccccttccccgtcctgaacccctctcctggtcaccgagaatcagtccccgtgga

SEQ ID NO: 16643 - DNA, 280 bp, Homo sapiens
agtgctgctggacattgcaaactggaattgtacatggaaaaataacattgttgctataaattcctttctgctttgaaatatgttgtgtgttagaaacagagaggtaatgtttatggtgtaactcagaatactgggatagagttatgcattaagagtgggacgataggacattatgcaaacagagtccctaaagagagatgttttagtgggtaaaataatttttaagaattatttagatactccctaccaataagtactcacagatattaacctcccagac

SEQ ID NO: 16644 - DNA, 335 bp, Homo sapiens
gaatagggaaatagcctagctatagaaacagcacttttaaatttcatatgtacagtgatttattatttgcaaatcatctactttttaaaagtatgatactttattatttgcaaattatttaatttttaaaagtgatttttgtgggagcttagactttcttctgaccctctccctgcccaagaaacgggattcctttctcaccaaccgccatattggcaagaatttctgccacagagttttactattaatactagaagttccaacctactttccaccaataaaaggttcccacaaatcgtcctaggggagaatttatttaagtaatttaaatgtga

SEQ ID NO: 16645 - DNA, 157 bp, Homo sapiens
tgtgccaaattaatatttgttcaatgcatgaatgatcagggcatgtcccattgacgtggtgatcctaattcaaaccctaggttgaaaagcacgtctgtggaggagagggctgctttagaatcctagctccttggtcatacctagtactctgccccca

SEQ ID NO: 16646 - DNA, 423 bp, Homo sapiens
actctgtcgcccaggctggagtgcagtggcgcgatctcggctcactacaacctctgcctcccgggttcaagcgattctcctgcctcagcctcctgagtagctgggactacaggcgcccgccaccacgcccggctaatttttatatttttattagagacagtgtttcaccatgtacaccaggctggtctcgaactcctgacgtcaggtgatccgcccgcctcgtcctccaaagtgctgggattacaggcgtgaaccgccgcgcccggccacaatctttaaaagattacaactatgtctcctgggactgcacgttcactacacaccacgctcacgagcgctcgcagcgggtatggaactctacagagtcctttcatctcccgtctcactgaggaagaagccctttcttttcactgtgacaactcc

SEQ ID NO: 16647 - DNA, 415 bp, Homo sapiens
  misc_feature 200: n=a, g, c or t
tgtattacacgtttcataccaattcagtgcttaaaaacatacattatagaaaactgacaagggactgagactttctgaaggaaggactgactgagaggttggagaggtgaagggaaaccagcagtgggatctaaggagagatggaggtaaattaagaggtttcagactcttggaagaatttcacatatgcacgtaacacncatgcatacaaagggtaactgtcatgctgcactggaatcaagaaaaatgaggattgagaatgattattgcgtttcgccagaggtcattgatagcttttaggactttgattttgccagagctgtggaaatggaagcttttctgaaaatttcagaattaatatggatgaataaatgtggcagttcatatcaacagataattcttggtgcttttgaat

SEQ ID NO: 16648 - DNA, 95 bp, Homo sapiens
gcttttctttttaattgtcaaatacagtaaggaatttcagtgaggatgtttgtgtgtgttttagagatggggtcttgctttgttgcccaggcatt

SEQ ID NO: 16649 - DNA, 134 bp, Homo sapiens
aaatcttatcagtttgtttatttgtaggcatttctctccccctctccccacaaaaatgattcttatcaagaggaggaaaggacaataaactgggaaatgggaggtaaggatgtctggtatcagatttcacgcaa

SEQ ID NO: 16650 - DNA, 94 bp, Homo sapiens
gtttgcagccatgtttgtggttggtggcagcgatggacactgcagccagccagagtgtagaaaggcattgggtgaaagaagattgccacgggag

SEQ ID NO: 16651 - DNA, 138 bp, Homo sapiens
caattttttgtaaagatgggggtcttgctatgttgcctaggttagtctcaaattcctggcctctctggaaatgatcttcctgccttggtctcccaagttgctgggattacaggtgtgagccactgcacccaccccaca

SEQ ID NO: 16652 - DNA, 137 bp, Homo sapiens
tagataaaaatattgatgctcagaaaagtgccctacttatcctggtggctcaggaagtgagtgagcttagccccaggtcctctcgcttccgggatagtttccgcctgcagccccaaggagggtcctcggcgccccag

SEQ ID NO: 16653 - DNA, 103 bp, Homo sapiens
agccggctcgcccgggggccatggcagcagcggctactgcagccgagggggtccccagtcgggggcctcccggggaagtcattcatctgaatgtgggaggccc

SEQ ID NO: 16654 - DNA, 368 bp, Homo sapiens
  misc_feature 25: s=g or c
  misc_feature 316: n=a, g, c or t
  misc_feature 317: n=a, g, c or t
  misc_feature 318: r=a or g
  misc_feature 319: n=a, g, c or t
aaagtgctgggattacaggcgtgascaccacgcccggccggatgaatgtttaaaacattttgctaagtagaagaaactagacacgaaggactccatattgtatgaatccgttcatatgaaatttcaaaaccgtatacacagaatgcagattagtggttgcctgggcctggaaacacagattggctgcaaatgggcacagagaactttctgggtagtagaaatgtcctaaaactggggtgtggtgatagttgcacaactctatgtttatactagaagtcatcaaaccatacaattaatttttagtagagacggggtnnrntcatgttggctaggttggtctcaaactcctgacctcaggtgacccacat

SEQ ID NO: 16655 - DNA, 114 bp, Homo sapiens
ctgaatgccatgtggtgttctggaaagcttcctctgtaatttccagttcagatcagttgttcatcctgtgcactccagcctcatcctgtgcttaattctaccacaacaaacaac

SEQ ID NO: 16656 - DNA, 96 bp, Homo sapiens
ggatgtgagggcgatctggctgcgacatctgtcaccccattgatcgccagggttgattcggctgatctggctggctaggcgggtgtccccttcctc

SEQ ID NO: 16657 - DNA, 137 bp, Homo sapiens
attattcctttgtgatgtatcttgcatacacgttattactggtgccacttcccattcttcattctgtactaatatgagaatctcctagttggtgtgtctatctggttgctacccatccacgtctatccccccaccac

SEQ ID NO: 16658 - DNA, 94 bp, Homo sapiens
agcctagtatgtgcttaagaatgtttgtcgaatcagttaatgaaacgtattttatgaggttctaatgtagcgcagtattgcactcccggctgcg

SEQ ID NO: 16659 - DNA, 83 bp, Homo sapiens
aagactatactttcagggatcatttctatagtgtgttactagagaaatttctctgaacgtgtagagcaccgaaaaccacgtat

SEQ ID NO: 16660 - DNA, 234 bp, Homo sapiens
cttatcccaaaaaaccctctgccctcgtggagtttacgttcttatgttccagagaccctgtctgccagagttccaggcctgattttcaattttgaggaaagtgctaagactaaagagtgaatggttcttttatgagtactgacacaaggactccaggccacacatatcttcttgaaagcccttttcctgtttgaaaaaaagatcgtttgtatttgatagagcaaaagaagacaa

SEQ ID NO: 16661 - DNA, 99 bp, Homo sapiens
ataaagtagcagatgtaggaaagtatcgacccaaagtgaggtcatgaatacaacagcatctcgtgttcgctacgtttcctctggaattagcccacactg

SEQ ID NO: 16662 - DNA, 90 bp, Homo sapiens
  misc_feature 25: m=a or c
  misc_feature 26: r=a or g
agaggcggccgcgtccaggtgcggmrtccataccggagcgcaatggcgtccaaccccgaacggggggagattctgctcacggaactgcag

SEQ ID NO: 16663 - DNA, 79 bp, Homo sapiens
tggaaagatcagcattggaagataaagaaagagatgaagatgatgaagatggagatggcgatggagatggagcaacggg

SEQ ID NO: 16664 - DNA, 199 bp, Homo sapiens
  misc_feature 176: s=g or c
  misc_feature 177: n=a, g, c or t
agtaaaggaataagagaatagctactctgcttgagcagagcagctatgccttataattttttattggataccagacatgtggcatgggtgctatttttgctctgctataaatatttttgaactttattctgagattgtggtgggtaatattgagtgttaactcgattgggttgaasnatgcaaagtattgtttcggggt

SEQ ID NO: 16665 - DNA, 107 bp, Homo sapiens
ggatgtgagggcgatctggctgcgacatctgtcaccccattgatcgccagggttgattcggctgatctggctggctaggcgggtgtccccttcctccctcaccgatt

SEQ ID NO: 16666 - DNA, 69 bp, Homo sapiens
aaaagattctgtcttatagggtaaaaaaagccaccgtgatagaaaaaaaatctttttgataagcactgt

SEQ ID NO: 16667 - DNA, 59 bp, Homo sapiens
ctacatacttgcaggtagtccacaaattcggctctgaattttttttttttttttttttt

SEQ ID NO: 16668 - DNA, 322 bp, Homo sapiens
  misc_feature 89: k=g or t
  misc_feature 211: r=a or g
  misc_feature 212: s=g or c
  misc_feature 321: s=g or c
  misc_feature 322: m=a or c
tagataggtgagatgatgggagataggatatataggttcagaagtgttcatagcctgtagaaaggatgactttttaaatgatctatttktgtagttgttatctattgagcatattttgggtgtaggcttggttaaaaaagtgggtcttggctgcgcgtggtggctcacgcctgtaatcccagcactttgggaggccgaggtgggcagatcrsgaggtcaagagatggagaccatcctggccaacatggtgaaacctgtctctattaaaaatacaaaaattagcgtgggggtgcgtgcctgtaatcccagctactcgggggsm

SEQ ID NO: 16669 - DNA, 113 bp, Homo sapiens
aaattgtatacagtttttattctaaccactaactaggtagtgtatgccccttcagaacatgcagagtgtatctttttttaaatttctccttccgtttcttaagtattgcgcag

SEQ ID NO: 16670 - DNA, 292 bp, Homo sapiens
  misc_feature 19: k=g or t
  misc_feature 62: n=a, g, c or t
  misc_feature 69: r=a or g
  misc_feature 70: v=a or c or g
  misc_feature 71: r=a or g
ctgtggcgagtgccggcckaaagctaggtccggattgcacgtggagggccgcccgaaggacntctcggrvrttaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtcaga

SEQ ID NO: 16671 - DNA, 181 bp, Homo sapiens
  misc_feature 101: w=a or t
tttatatttttagtagagatggggtttcgccatgatagccagggtggtcttgaaatcctgaccacaggtgtgagccactgtatctggccaaaaaaattttwttattttttgtagagacagggtctcactatgttgcccaggctggtcttgaactcgtgacctcaaatgatcctcccgcccc

SEQ ID NO: 16672 - DNA, 132 bp, Homo sapiens
  misc_feature 29: r=a or g
  misc_feature 30: m=a or c
  misc_feature 73: m=a or c
  misc_feature 87: s=g or c
  misc_feature 106: m=a or c
  misc_feature 109: m=a or c
acttcgcggtcgggcccgccggctgcggrmacccgcgcgacgggcgggaagatggcggacgtggtcgtgggtmaagacaagggcggsgagcagcggctcatctcgmtgmctctatcccgcatccgggtctat

SEQ ID NO: 16673 - DNA, 226 bp, Homo sapiens
ctccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccct

SEQ ID NO: 16674 - DNA, 97 bp, Homo sapiens
  misc_feature 19: m=a or c
  misc_feature 60: k=g or t
  misc_feature 61: k=g or t
  misc_feature 87: y=c or t
  misc_feature 88: r=a or g
  misc_feature 96: b=c or g or t
  misc_feature 97: k=g or t
agtgttgtggtctgctgcmtggaggcagaccagggcttgtgcgtggcttttggctagagkkactcacaggtgacccacggagtcagyrcagggcabk

SEQ ID NO: 16675 - DNA, 124 bp, Homo sapiens
atttatgtaagataggagttctaggtattgtatttatgaatagtggttaaaaaaacatgtcacttaaaatgttcatatgataggaaaataatccttcccaaaggagttgtgtgttcccaagatt

SEQ ID NO: 16676 - DNA, 120 bp, Homo sapiens
cttttgtcccgtgtgctctggagattgcatcccacgcaggcagcccccttccgtacaagagaggctggcggttacctttcttggggagacgcgtccgactgcttcattgtgggggccata

SEQ ID NO: 16677 - DNA, 84 bp, Homo sapiens
ggctttgttgacggggaggtggcgaggatggggacagaaagcgcacagaatcttggaccaggtctctcttccttgtccccccta

SEQ ID NO: 16678 - DNA, 190 bp, Homo sapiens
gttcacgcgttcggtcctccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtctt

SEQ ID NO: 16679 - DNA, 100 bp, Homo sapiens
taacctgatcatgattatacctccaatgttcggtgcaattcagagtgttagagacggtctggaaaaacggtacattgcttcttatttagcactcgcccgt

SEQ ID NO: 16680 - DNA, 127 bp, Homo sapiens
ttaattgtgatgtatctgtaaattatctgttgcctgtaaagacaaaattggggtgtccctggagacttttttttcttcacaggcatgctcataaaggaaaggttaaaaaaagtaaaaggaactcggc

SEQ ID NO: 16681 - DNA, 134 bp, Homo sapiens
gatctctcactccgaactgggttgaatgaggtcagtagcaggatgacagctctccaatgaaaatctgaatgaatcaggaagtagtttggaagcttgcgggtgtagtactgtcctcagaatcagcattggccggt

SEQ ID NO: 16682 - DNA, 122 bp, Homo sapiens
  misc_feature 87: r=a or g
  misc_feature 88: r=a or g
caaattaagttctaagcttttccaagttgttatgcctgcccagaggaatcataaactatgaaatgtcgaatttggttgggtgccgtrrcttgcgcctgtaatcccagcactttgggagggtt

SEQ ID NO: 16683 - DNA, 123 bp, Homo sapiens
tactcagacatttaaaattactcttcattaagaatcacaggcccacctgcccttttaggtagactctaaagcaaacaaaaatcatctcgttcagcccatgcatcttccacgtgaggacggcta

SEQ ID NO: 16684 - DNA, 122 bp, Homo sapiens
actttttgattttttaataacagccattctgactgatgtgagatggtatctcgttgtagtttgatttgcatttctttaataatcagtgatgttgagtttttcttcatatgatcatcggccac

SEQ ID NO: 16685 - DNA, 71 bp, Homo sapiens
agcagcttagtttttgaatcggttgtggcggccgccggcgaggaatggcggtatttgtgagaggagccggt

SEQ ID NO: 16686 - DNA, 348 bp, Homo sapiens
  misc_feature 30: r=a or g
  misc_feature 31: n=a, g, c or t
  misc_feature 35: s=g or c
agagttgcagggcctgggaacaggccttgrntgastcgaggtagtgattcttagcctggggctggagagaaacagcaggcgcggggcgaaggagctgctagaacaatgctgaggcgggtgaggtgaggagcagcccctcgcggcagcccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggagtgctggctggtgttcc

SEQ ID NO: 16687 - DNA, 116 bp, Homo sapiens
aagctgccgctgtcgctgctgctcgttcgagtcgcagatccttgccagcacattacagaatatttttgttgaaccttcttgagaattcagagaaactgctgagtgaccactacacg

SEQ ID NO: 16688 - DNA, 119 bp, Homo sapiens
gaatgggagaatatatttacaaattacccctctgacaagggattaatagccagattatataaggagctcaaacaactctataggaaaaaaataaaataatcttatcaaaaagtgggcaa

SEQ ID NO: 16689 - DNA, 208 bp, Homo sapiens
  misc_feature 12: m=a or c
  misc_feature 13: w=a or t
  misc_feature 23: s=g or c
  misc_feature 24: s=g or c
  misc_feature 26: n=a, g, c or t
  misc_feature 27: n=a, g, c or t
agtagggctggmwcaggcggaassgnnggcccggggctgggcttcgtgtcctgcgttccgggagcgccaacccctccagcagaggggacgtggctggtggctggagaagctggatttgccctttgatggtggccctcttgatccccggcttgctgaagtcaaagtatcagtagcaaattcaaaaactacagaatcagctccagcggac

SEQ ID NO: 16690 - DNA, 149 bp, Homo sapiens
cttatttcacaaggccagtctaccagctctgagagtctttcttccgcttggtctattttgctattaatacttatgattgccttatgaaattctcgtagtgtgtttttcagctctatcaggtcagttacattcttttctatacggggtat

SEQ ID NO: 16691 - DNA, 161 bp, Homo sapiens
ctttccgcccggctccttcagaggcccggcgacctccagggctgggaagtcaaccgaggttcgggggcagcggcgagggctccgggcgagtaagggggatggtccatgctgaggcccaaatggggcgaactcgcgagagtctctggcgacctggatcagat

SEQ ID NO: 16692 - DNA, 181 bp, Homo sapiens
cattccactcgaatacattcccttctattccactcggaatgattccactgcattccattccattccattccattccattccattccattccattccattccattcctttccatttcgtttcattccattctattccgtaccattccattccattcctttccattctattccattccctgct

SEQ ID NO: 16693 - DNA, 238 bp, Homo sapiens
atctcagctcactgcaacttctgcctctcgggttgaagcgattctcctgcctcagcctccagagtagctgggattacaggcatgtgccaccacacccaactaattttgtatttttaatagagacagggttttgccatgttggtctggctggtctcgagctcctgacctcaggtgatccgcccacctcggcctcccaaaatgctgggattacaggtgtgagccaccgcgcccagcccag

SEQ ID NO: 16694 - DNA, 378 bp, Homo sapiens
  misc_feature 366: d=a or g or t
agcgtggtgttacgagaggaaagcgcagcgcagcgtacgaatgggaaggccaaacacggtcccggggagtctgagggaagctgcagggcgcctggaattggggtctcgagtgagccggtaaaaaccgcctcccgctgagcgtcccggaacaaatactgtctgaactgagccgtaagcaagaaacggtcaggagaagctggggcgatctgatgattagaacatttcagggactaccagagagaagtgcgtaattgctctaaggcaggtaggtaattggcctggaaacttgggaacgccccgccccccaccccgactttcagcaaaccaccgtgcccaggaaaaagagcgattgtggaagaccctgtdaagaagagacca

SEQ ID NO: 16695 - DNA, 207 bp, Homo sapiens
  misc_feature 183: k=g or t
  misc_feature 184: k=g or t
aaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcakktcagtagcatttgtcatccagcc

SEQ ID NO: 16696 - DNA, 143 bp, Homo sapiens
cttccgcgtctcctccctggccctggaggcttgtccagattgcgccgcattcccgctcatcgcacactgccgtttctaacattttccgtggctttctagatgacctgttgttcatgcacttcacttagtgccctcttggacta

SEQ ID NO: 16697 - DNA, 136 bp, Homo sapiens
  misc_feature 31: r=a or g
aattagctaggtgtggtggtgcatgcctgtratcccagccactagggaggctaaggcaggagaattgcttgaactctggcagcagaggttgcagtgagctgagattgtgccactgcactccagcctggtcgacgat

SEQ ID NO: 16698 - DNA, 312 bp, Homo sapiens
  misc_feature 309: y=c or t
tacaaggccgacaatgttcaatgctcctacagaatgtgtacacatactgaaactggcaatcttaacagttttcaggaaggatgcattttgctgctattcttgctttttcattattaattatgatgactttatctccattactaccaatttaatttgctgtggggtgttaatgccaccttatgtggcattccatatgtcctttggcactccaatgacagatacttcctttgcattggatatctttggggataggctttaagacccacaagttctatggtttctaggatgaaactccatactactccagtygca

SEQ ID NO: 16699 - DNA, 323 bp, Homo sapiens
  misc_feature 170: r=a or g
  misc_feature 220: k=g or t
atcactggtttgtgccttgttctgaattattttggggattatgacaaggcagaattttgtaatgaaatctgtaggctagacagtatcttgtatttgcaaactaatttaatttttccatttcaatttacaaaactggagggtctggccgggtgcggtggctcaagcctgtratcccagcactttgggaggccgagacaggtggatcacgaggtcaggagtkcgagaccagcctggccaagatggtgaaaccctgtctctactaaaaatacaaaaattagccgggcgcagtggtaggcacctgtagtcccagctacccgggagtc

SEQ ID NO: 16700 - DNA, 165 bp, Homo sapiens
  misc_feature 151: n=a, g, c or t
aggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagcggnctcttccccggaac

SEQ ID NO: 16701 - DNA, 162 bp, Homo sapiens
ctagaagtaaaaagtttcaaaaatcacttgagtacattttggaaaatggtgggtaaatgaatagtacttagagtcaagatgctcctaaagttgatttcacaaacttctggtatatcaccatgtttcctaaaagagaataagtaacaattgtggaaggaactt

SEQ ID NO: 16702 - DNA, 118 bp, Homo sapiens
agtagagacggggtttcaccgtgttagccaggatggtctccatctcctgacctcgtgatccgcccgcctcggcctcccaaagcgttgggattacaggagtgagccaccgcgcccggca

SEQ ID NO: 16703 - DNA, 118 bp, Homo sapiens
attattcaaaagatttatcaaagtagatgactgttgttatttaaccagtggcctatttctaataaatcagattaaaaagacaaaagtataaaagtaatgtgtgtctgcacgggtaggg

SEQ ID NO: 16704 - DNA, 92 bp, Homo sapiens
gccttcgcatggggaaacgggctggtgcagtggtgtcatcttggctcagtgcagcctcgacttcctgggatccagcgatcctcccgcttaac

SEQ ID NO: 16705 - DNA, 402 bp, Homo sapiens
  misc_feature 396: w=a or t
tttgctgaactttccaaattggcacatatgagtaaggtagcacacacacgcgttcacaccctcaccccgtgccatctcttgcaggtccccaggcttactgggaagctctgcctgacatcacaacatcacagcatgcattgaagtccagtttcatcaaaaatcacagctttatttttaaccgatgaacttggtatttggcttatccaaatactccaagtattaattcaaccagatctttctcattgcctcaaacaatcttattccaaactgaaactgtaattcatgtgccaaaaacattttgacttacagacatttgtctgtaggagattttggtggtttaataatgaaaaaatgagaacaggaatcagaaatatgaacagccttatgttcagatcwtaatca

SEQ ID NO: 16706 - DNA, 147 bp, Homo sapiens
aagcaacttttacatgtgataactgtgttgaatgctttcatgattttgcttttagtaacatacattgctgtcttcatcttggggaactaaaccaaccacaggcaaaaatcctttgagcattgattgccactcataaaggccaggttt

SEQ ID NO: 16707 - DNA, 259 bp, Homo sapiens
  misc_feature 210: r=a or g
  misc_feature 211: s=g or c
agtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggrstatgaaaatgatgaagatgtgaataaacagctggacaaaatgggcttc

SEQ ID NO: 16708 - DNA, 381 bp, Homo sapiens
  misc_feature 34: y=c or t
  misc_feature 44: y=c or t
  misc_feature 65: k=g or t
  misc_feature 90: y=c or t
  misc_feature 93: k=g or t
  misc_feature 121: k=g or t
  misc_feature 215: w=a or t
  misc_feature 216: w=a or t
tgggtgcattaaaaaaatacagctcattcagcayaaagtgaatytatgcataaatgccagaatakctagtgggtaaatctgacctgttaytakaaatagctggtttgaaagctaatactakggattggtaatgctctttcctcaaagcacaatacagatttatcatgcttttcctttggggtagatgaagtgctgacataacaattcattgcagwwatcagcctgttcaaatccagaaggacaaactacttcagaaacactttgcctctttaaaggcaatttttagagctgttgaactctggaactttgttcgaagtatttcctcgtttaagaaaccaccttaaataaatctatcttgtgaccttcaattctcatccccaa

SEQ ID NO: 16709 - DNA, 207 bp, Homo sapiens
  misc_feature 11: r=a or g
  misc_feature 12: r=a or g
  misc_feature 55: k=g or t
  misc_feature 56: k=g or t
aaaagtagttrrttttttgtgatagcttgagatataattcacatattatacaatkkgccatttaaagtatacaatttagtggtttttaatgtattcacagagctgtgcaaccatcaccgcattcaattttagaacattttcctcaccagcaaaaaaaaccctgtagcctgtagcggttaacctcttcccatttattcccaccagcca

SEQ ID NO: 16710 - DNA, 231 bp, Homo sapiens
gtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacca

SEQ ID NO: 16711 - DNA, 180 bp, Homo sapiens
tttatatttttagtagagatggggtttcgccatgatagccagggtggtcttgaaatcctgaccacaggtgtgagccactgtatctggccaaaaaaattttttattttttgtagagacagggtctcactatgttgcccaggctggtcttgaactcgtgacctcaaatgatcctcccgcccc

SEQ ID NO: 16712 - DNA, 69 bp, Homo sapiens
taaatagaacaccaaaaaaatcatttttcttttttttcttttctttctttttttttttttttttttttt

SEQ ID NO: 16713 - DNA, 213 bp, Homo sapiens
catccttccctgcaggactccctagagcaccatgggctgggtgccgaggatgccaagcacgcaaggtctcacagcagtgcacgacagaggcaggattctgcgtgatagttcttcaggttcacttcacacattagctgacacttaactgttctggaagctgggccaaggagtgctaacatggaaattgagtaactatagttttttgcccaagga

SEQ ID NO: 16714 - DNA, 60 bp, Homo sapiens
ctacatacttgcaggtagtccacaaattcggctctgaatttttttttttttttttttttt

SEQ ID NO: 16715 - DNA, 174 bp, Homo sapiens
tttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcatggcccac

SEQ ID NO: 16716 - DNA, 187 bp, Homo sapiens
aagatgaggaggtggcagagattcaggccagagttgtgggccgccgtcggcagcaagaacagagagagaggtggacagatctgagagagtgaggtagaaccaccaggaatcggggatttggctggatgtggaggggtgaaggaggggcctcaggctggctggcagtgccccttgccaagaaaggggg

SEQ ID NO: 16717 - DNA, 119 bp, Homo sapiens
ggatgtgagggcgatctggctgcgacatctgtcaccccattgatcgccagggttgattcggctgatctggctggctaggcgggtgtccccttcctccctcaccgctccatgtgcgcccc

SEQ ID NO: 16718 - DNA, 208 bp, Homo sapiens
  misc_feature 13: m=a or c
  misc_feature 14: r=a or g
  misc_feature 92: v=a or c or g
  misc_feature 93: v=a or c or g
  misc_feature 107: h=a or c or t
  misc_feature 109: h=a or c or t
  misc_feature 110: n=a, g, c or t
  misc_feature 156: w=a or t
  misc_feature 157: r=a or g
  misc_feature 184: k=g or t
  misc_feature 185: k=g or t
gagagtgtgtggmrtgggcggggggtctccgcggaggaggtggaggaggcggcggcggcggcggaagagggcggagggtagtgggatggggvvtcccgcggcagcghthnaaactccgggtgggcgtccatggtgctgctgcgctgacagggctgwragcagccggccttccgctctcaccagkkccgcgtcggaatagacggtcact

SEQ ID NO: 16719 - DNA, 327 bp, Homo sapiens
  misc_feature 13: s=g or c
  misc_feature 71: m=a or c
  misc_feature 72: s=g or c
  misc_feature 96: s=g or c
  misc_feature 106: r=a or g
  misc_feature 149: s=g or c
  misc_feature 153: k=g or t
  misc_feature 196: s=g or c
  misc_feature 219: y=c or t
  misc_feature 220: s=g or c
gaggcagagtgasgctccgagagctgggaggctgcgaacggggcagggatcaaggggcggggtccggcagmsagaaggaggcggggattggcagascgggtgggaratgtttggggatgggtaggggaggtgttgagaggttggagttsatakgagggggcgcggcttggaagggttgaatggcaaagggataggsagtggatggtgtggcttgggggyscgttcatgggcgtggtttggcggggtccagctgggcccccacttcggtactccccctccttcccaggtcctccagcccttctgcgactttccagaaatcgtagacag

SEQ ID NO: 16720 - DNA, 145 bp, Homo sapiens
gataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgaga

SEQ ID NO: 16721 - DNA, 436 bp, Homo sapiens
  misc_feature 33: s=g or c
  misc_feature 58: k=g or t
  misc_feature 166: s=g or c
  misc_feature 202: s=g or c
  misc_feature 237: y=c or t
  misc_feature 241: k=g or t
  misc_feature 258: y=c or t
  misc_feature 263: k=g or t
  misc_feature 298: r=a or g
  misc_feature 302: d=a or g or t
  misc_feature 345: w=a or t
  misc_feature 356: s=g or c
  misc_feature 362: k=g or t
  misc_feature 370: w=a or t
  misc_feature 371: k=g or t
  misc_feature 381: k=g or t
  misc_feature 388: w=a or t
  misc_feature 394: y=c or t
tcaccccatccctccacacacaaccaccacttsgaaattcttctgatttgatggttgkgttccctgttttcattttgagccaagcttaagggttgccagcaggtggcaaacctaattttacattccaagttatcagaaaatcctcacaggtgttttgtcatgcacstgcaaaaaaaaaaaattgtatggatggcagcagtascgctgaaattctccatgaaaattggattctctctyccckgaacttaaacaaatgcycattkgtaaactatatagctccacaactattctctaaagrggadtcagttatcatccccttaagtaaactttttttctgtggccgtwaggtaaatacsgtcctkggacttawkgagtacatgkgtttgtwaatgtycggctctgagcgggagagcatggcatgaatgggcacatgtga

SEQ ID NO: 16722 - DNA, 184 bp, Homo sapiens
accagatgtttggcttattccattttgatgaaacagagctgttgttttggaagtcattatttttctagaaatggcgaatcttttaaagaaaattacttaatggaaggttgtgggaaggtgtttttttgtgttttttttttggtttttgttttgtttttcctcttttaagggatagtagcaggat

SEQ ID NO: 16723 - DNA, 339 bp, Homo sapiens
ctccctagatgtgtggccttggccaaggtacttaactctctggggttaacagtccatacctacctcacaggattattatgagaattaactaagtgaataagtgtaaagtacttgaaacaggtctgctttacaagaagggcccaggtcaccttagcaatcacgtcgcttctgaccgaggctttcttgtgtaactgggcttctctgtctcctttaaactctcacattggtgttgagcttccctgtttgtgtatctgggcaccttccatctcccctgggctcccctcacctccgtgaagccaccagctccaggagggcacaaagcacagctcccacccacac

SEQ ID NO: 16724 - DNA, 181 bp, Homo sapiens
agttatactcagagatgagaaagacgacaatgggcaaattccgggagtccggggcagggagaaaggggaccttaaggatctccagccgtcccgccccgcccactcgagcagtccctacccgcctcccaagacgcctgggaagagcagtggaaccagggagagcacgaacagcaaagaggat

SEQ ID NO: 16725 - DNA, 162 bp, Homo sapiens
gaggaagtggagggtttgggtcccaggacaggaagcttggggctggagtcccagcatccggactgcaacaatggaagcttcaagcaccaggaaaagagacagagacagacagaggcacaggagagcaaaacagggtcggagatggaatgagaaacagaggct

SEQ ID NO: 16726 - DNA, 292 bp, Homo sapiens
cactaaattgggctaggtgtggctcatgcctgtaatcccagcactatgggaggctgaggtgagaggatcacttgagcccagaaggttgagaccagcctgggcaacatagtgagaccccatctctacaaaaagttttaaaaccaggtatggtggtgccctcctgtggtcccagctactcgggagtctgaggtgggaggaccacctgagcccaggagactgaggctgcagtaaggtgtgattgcactattgctctctagcctggaaaacagagtgagaccctatctcaaaaaaa

SEQ ID NO: 16727 - DNA, 204 bp, Homo sapiens
  misc_feature 12: y=c or t
aggaccgtggcyatggagtccggcgtggcagcggcaatccctggccaaaggtacttggggtcattttccgcggggggttacgtgcgggagcgtgtcctccacaaacggattttccccccttaagcggacttatttccatccggagtgacagaatttaattccaaaccgagagctttccagactgacgaatttttaccgggacag

SEQ ID NO: 16728 - DNA, 216 bp, Homo sapiens
  misc_feature 13: s=g or c
ataagagggagtstatggcgctggaggcccagcaaggccagtgtggtttagcacagatccttgctgtggacacagagttgggagtccttggcagacagacagcagattctgcagctctgtgagtgaccaggctcacctgggagagagggtgagaagaggacctggtttctagcatgtggaggtggggtgggggagaaggcagagcaagggagacta

SEQ ID NO: 16729 - DNA, 115 bp, Homo sapiens
tataaagattcaaaagagaaacaactaaatagttaattgttactaaccatagatatgtggttaaaactcaaagaaatgcaagaagttattatcacaggatagaaattaccccagt

SEQ ID NO: 16730 - DNA, 77 bp, Homo sapiens
acagcctctccaaacctgagtgggaagacactgagttccagtggattcaacacacagaagcgtggattgaagtgaga

SEQ ID NO: 16731 - DNA, 382 bp, Homo sapiens
  misc_feature 308: s=g or c
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgccctgcctagttttcctttgactccagcctcctcataaacttccctcacggcagcaccgccaggttcctcctcgggttccattcctcctcctgggacaatccactggtctgggtaccggctgctactcaccagcagcacstcgtcctcctggaacctctttagcctcagcttcaccggtaccagctccaacccctgtgttggctccatcatcaa

SEQ ID NO: 16732 - DNA, 285 bp, Homo sapiens
  misc_feature 58: b=c or g or t
  misc_feature 62: k=g or t
  misc_feature 100: k=g or t
  misc_feature 277: k=g or t
tgctctggttctagttcaggacacctccagtctgacctccaagccggcaaaacgagtbagakcagaatttctgttcaactttttcatttgggactaagtkctttacacttggctgtattctggagaactctgatacatgaaattgaattttaaattctcattttttccctaaattctaagaaaagtgcaggcagattgtttttcttccttaaatgtaagctgaacagcttaggggtcagccccttgggtcttttacctcctgggggagacttctcakagaggatc

SEQ ID NO: 16733 - DNA, 168 bp, Homo sapiens
tttccagggctgatcttgaacttaagcagtccttctaccttggcctcccaaagtgttgggattacaggcatgagccaccatgcttggcccatggaggattatattgaaagattgatagcataacagaataaaaggtgaaaatgcccttttaaatctcctgctctggcc

SEQ ID NO: 16734 - DNA, 84 bp, Homo sapiens
  misc_feature 37: k=g or t
aagactatactttcagggatcatttctatagtgtgtkactagagaagtttctctgaacgtgtagagcaccgaaaaccacgttgg

SEQ ID NO: 16735 - DNA, 425 bp, Homo sapiens
  misc_feature 284: k=g or t
agagaagccgctgtccttccaccaccagcaccggaccacctgctccaagaccagcctcctggggggaccacgcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgtkcgagatggatgcacagggccgggtgtggagccaagacttgatttgcttcttgttgagcagggctaccccacaggccatgtgcctagagtggccttaattgaatttttgttacaatcattgtagattcctgtacagttataa

SEQ ID NO: 16736 - DNA, 162 bp, Homo sapiens
  misc_feature 41: w=a or t
  misc_feature 151: w=a or t
aagtggggattggtgcgtgtgcggaaacggggacagaagtwaaggttcatcgcctataacgaagatgagttatatgcatcaaggtgacaggtgacggcatggttatggattaactcaccaaggaaatgagtgtggaaagaagaatgcagawatctgaggttc

SEQ ID NO: 16737 - DNA, 124 bp, Homo sapiens
  misc_feature 67: r=a or g
  misc_feature 95: y=c or t
  misc_feature 96: w=a or t
  misc_feature 111: v=a or c or g
  misc_feature 112: s=g or c
  misc_feature 121: k=g or t
cttacagaggtcgctcttgtccgaacggtcggcctctgctgcgcctgcgtggtcgggaggggaagtraggcggtttcctcggcgccttttccggywgcggcggcggcagavstgggaggakgta

SEQ ID NO: 16738 - DNA, 402 bp, Homo sapiens
cttggtctgtaaaatgagactagcaatacctgctctgttgtctcttgtgaggaggaaatgagaatgtgtgaaaagtgctagaatggagcctcatgggggaggctctcccaccccatgtcctgatttggacaaggaatcccacacacctcatccagatacacagaggctcatgactgagtctcttgacaaattattttttgagggtgcatacttttttgctgtgaatttccaaatgtttgcatttctaaggccacatttgtgacacagagatcagatcctttctgacacaatgtaactggcaggtcctaatgagctgggggcaccgggaagcattttaagtggtagcatttctggaaatattgagatgaggtcgggggaaagaagctttttcttcagggccca

SEQ ID NO: 16739 - DNA, 141 bp, Homo sapiens
  misc_feature 104: h=a or c or t
  misc_feature 117: d=a or g or t
  misc_feature 118: k=g or t
  misc_feature 123: b=c or g or t
gtttggagacggagcttcgctctgtcgcccaggctggagtgcagtggcacaatctcggctcactgcaacctccgtctcccgggttcaagcgattctcgtgccthagcctcccgagcdkctggbattacacaggcgcccaag

SEQ ID NO: 16740 - DNA, 140 bp, Homo sapiens
  misc_feature 111: y=c or t
ttttttcctggagcggctgggaaagaggagtctctcgaaattcagcaactgctaacagcgaggaggggttttgaaaggtaaaggccattagcttggaggcagaagacagayctccctgactgctgaattcccgccggcca

SEQ ID NO: 16741 - DNA, 119 bp, Homo sapiens
  misc_feature 45: m=a or c
  misc_feature 46: s=g or c
aatggggccttcttgagctggtgtgaaagggaggcggcgtggggmsgagagatacaggctccacactcacactctctggtgcagttgatcgttttcttaaaccaaattacccggggccc

SEQ ID NO: 16742 - DNA, 169 bp, Homo sapiens
gagtgcctcctggtccctgtctgccggcattcgcggctgcggggcccggagttgctggtaggaggagttggcggaagcacttggaactcctttataagtgtcagctgtgaggtaaaaactgttgatgagatcttgtgggttttgttttgggttcactaatttgggcggg

SEQ ID NO: 16743 - DNA, 116 bp, Homo sapiens
aatcttgtttgtttgagtgaatcggaaaggaggcgccggctgtggcggcggcgggagctgctcggaagctacacctcgcaagggctcccccctttccccaccccctcccccgacca

SEQ ID NO: 16744 - DNA, 116 bp, Homo sapiens
  misc_feature 85: r=a or g
gtttctgcgacgcgcgacctcggcgtccggacgcggggaacaccgggctgagggagtctgcagtcggctccgggaagccgcgcgrcgacgggggaggccttcactaaaggggacaa

SEQ ID NO: 16745 - DNA, 133 bp, Homo sapiens
tatttttctcctggaaactccaggtccattctgtttaaatccctaagaatgtcagaattaaaataacagggctatcccgtaattggaaatatttcttttttcaggatgctatagtcaatttagtaagtgacca

SEQ ID NO: 16746 - DNA, 135 bp, Homo sapiens
tttattaacaacaataacggccaggcatggtggctcatgcctgtaatcccagcactttgggaggctggggcaggaggatcacttgaggccaggagttcaagaccagcctggctaacatggtgaaaccccacctct

SEQ ID NO: 16747 - DNA, 163 bp, Homo sapiens
taattagatgaattacgctgagtgtcgccttatactctgtttaagaagtcagggtattgtgctctaaaaattagaaagacttccaaccaattagttacaatattcacatacattcatttcaaaaataaattttggacatctgtagcaagacactgtgctagct

SEQ ID NO: 16748 - DNA, 241 bp, Homo sapiens
cacttttcaaaatttagttaaaatttctagggatattttggcaaaacctgggagtgaggagtcccaattctcccatgtgaacttaggccgcacatttcgaggaagtaaattttcttcctctggcaaatgcagctagccagtggaccccttctctccctccaaacttcgcactccacaccttagagtctgcccaggtacagcccaattgtcagggcatactcaaagcagcttccatgactct

SEQ ID NO: 16749 - DNA, 143 bp, Homo sapiens
agagccgctatagctgccggcggtgtgcgactgagtcggtggcgaagacgggaacgcgacgatggcggagactctgcccgggtcgggcgactcgggccctggcacggcttctctcggcccgggcgttgcggagactgggaccc

SEQ ID NO: 16750 - DNA, 352 bp, Homo sapiens
  misc_feature 12: v=a or c or g
  misc_feature 53: y=c or t
  misc_feature 54: y=c or t
  misc_feature 313: y=c or t
cagatggctgcvtttttgagcattaatttgcagcgtatttcactttttctgcyyattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatytattgaaattgcttaatttgcacaccctgtacacacaga

SEQ ID NO: 16751 - DNA, 205 bp, Homo sapiens
ggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggc

SEQ ID NO: 16752 - DNA, 214 bp, Homo sapiens
gtagcgtttggcaaagttggtgcctgcgcgccccttctaggtttgcgctttgactgttttgtttttggcggaactaccaggcaggaagattgcacaagtaaggggcgttttcagtcgggtgtcaatttctctttctttctttctttttttaaaatttcggttcgtgtctgcttctccaagctttattttttttttaaaatacatcgcaccacca

SEQ ID NO: 16753 - DNA, 215 bp, Homo sapiens
  misc_feature 13: w=a or t
tgaaggtcaagcwaaatgaagctactgtaagaaattacctggagttggccacacagtggctcacgcctataatcccaacactttgggaggccgaggagggcggatcgcttgagtcaaggaatttgagaccagcctgagcaatagggagacctcatctctacaaaaaataaacaaaatcagccagacatggtgttgcacaactgtggtcccaaccg

SEQ ID NO: 16754 - DNA, 96 bp, Homo sapiens
  misc_feature 42: k=g or t
  misc_feature 43: r=a or g
  misc_feature 44: r=a or g
tgatcctgtgtcattacagcctttgttaccacataagataakrrgttgcatacatttaccatctactttgtaaagaattgccctggctgtgtaatt

SEQ ID NO: 16755 - DNA, 357 bp, Homo sapiens
  misc_feature 4: m=a or c
  misc_feature 204: w=a or t
  misc_feature 205: w=a or t
  misc_feature 330: n=a, g, c or t
agamataagacccagagacaaagtatagagaaacaacagtgggcccaggagactggcacttagcataccaaggacctgcaccagcactggtctccgagttccctcagtttttattgattattattttcattatctcagcacaaggaatgcggtaggagagcagggtgataataaggagaaggtcagcaaaaaaacatgtgagcwwaggaatctgtgtcatacttaagttcaaagggaggtactatgcctggatgtgcacgtaggccagatttatgtttccctccgcccaaacatctgtggagtaaagcataacaaggcagcattgctgcnaacatgtctcgcctcccgccatagggt

SEQ ID NO: 16756 - DNA, 441 bp, Homo sapiens
  misc_feature 7: m=a or c
  misc_feature 8: n=a, g, c or t
  misc_feature 9: r=a or g
agtcccmnratagttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaactggtctctgtaggtctttccgtaactaagccatatgtgatcatgttattggaggatggaaaagagcctggatgatggagaa

SEQ ID NO: 16757 - DNA, 143 bp, Homo sapiens
caactaggaagttggctcagaagcagccaccttttaaagagtgcgtaatagctcactagtcaagagaccttgcgccaacaatttaacgggactaaaacacgataccgaagccgcgggtaattatatttacgttagaggtgcga

SEQ ID NO: 16758 - DNA, 417 bp, Homo sapiens
tggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaagctgttatgtgcacagcgtggag

SEQ ID NO: 16759 - DNA, 310 bp, Homo sapiens
cattggaattttaaatgtatttgctctttcagggaacaaagaccccttcatgtccctgtctgttgctttataatggtactttcttaggaatgaattaagttcaaatgcagagaattgccagcatataaaacgcaaggatcagaaccctgagtttgaactcagcccctgtgtacagcctccgtgtggcctctgtttaattagatcgtgctgctatagcagttccttctagctcagttgctttgatgtagtacccaaattttggcctaaaagtgatttaattagtaataatttttaaagatataggatgtgg

SEQ ID NO: 16760 - DNA, 121 bp, Homo sapiens
agtttattgttgtttcttgtaaattttagaattgtattttccattactgtgaagaaaaatgccactgaaattttgatagggaatttattgaatctatagattacttagataataggacaac

SEQ ID NO: 16761 - DNA, 179 bp, Homo sapiens
taaatccatgagtccatagtaacacagtcagtatggaagttgttagagaatgatttatttttaaaactgctaagtcagcattttatctttgttatatgagctatactactgggtcaccaactagtttagtgaggtcatttctctgtaaaattgtgccaagtaaatgagatgagaaaggc

SEQ ID NO: 16762 - DNA, 143 bp, Homo sapiens
cagatttttaacagtcgttagatattatggatgtagtctgcttatttggatattttaattgactggatttgctttgtttcttttccatttacagacttaagagtttaacattctgttactttaattgatatcagcatgcggaa

SEQ ID NO: 16763 - DNA, 211 bp, Homo sapiens
agagaggtgagtggatatctatttcagatagttttcagcatgagtcattgatttcacagcacatccagatgatcaagagtggtgccaatcattgttaaagaaaatttgttttgtttttttaaatgaatagagttgactatgtggcaaacgaatatttctgtattgtttgcttcagcagtgctgaagagttggaattataaatataacacag

SEQ ID NO: 16764 - DNA, 144 bp, Homo sapiens
agtttgccagtatttttggggggattttttgcatcagtctttatcacgggtattgttctgtagtcctcttgttctgtcttctagtttttgtatcagagaaatgctggcttcatagaatgattctggaagtgttccctgcccctc

SEQ ID NO: 16765 - DNA, 221 bp, Homo sapiens
gttcaagaccagcgtggccaacatggtgaaaccccatctctactaaaaatagaaagattagccaggcatggtggcaggcacctgtaatcccagttactcaggaggctgaggcaggagaatcacttgaactcgggaggcagaggttgcagtgagccaagattgcactattgcactccagcctgggcgtcaagagcaaaactccgtctccaaaaaaaaaaaaa

SEQ ID NO: 16766 - DNA, 183 bp, Homo sapiens
attataaccttttttgttgttttttccttttacttcttttttttcttgtggaagccacaagacaaggaaaaagcagaaaatacagggacttcctattttttttttcagtgcttccctggaaatagcgttatgaaacagaacatcattttcctcacactgatctgaggaaagcttgcagtgacc

SEQ ID NO: 16767 - DNA, 450 bp, Homo sapiens
  misc_feature 299: n=a, g, c or t
  misc_feature 300: r=a or g
  misc_feature 301: b=c or g or t
  misc_feature 303: n=a, g, c or t
  misc_feature 318: v=a or c or g
  misc_feature 320: m=a or c
  misc_feature 322: r=a or g
  misc_feature 323: r=a or g
tgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttnrbgncctaatttaaaaagvcmarrcagaaatgtacgttccttcgctagctttagtctttctgttcccatttttataaatctgagcattgataatgttctatctaaatttgtacagtgtgatttttttttttagaataaatattttataaaa

SEQ ID NO: 16768 - DNA, 218 bp, Homo sapiens
  misc_feature 13: y=c or t
ctaaagaaaccayacattaagagcttagtgggctaggattgaaatactacaagagttgtgcttaaactttcagagagttgcttcttcagaagtggctttaatgaaaagttaaacatgggagctggttaggggaggtgggatagaggaagagagcagttagtttggttttcctctttagccagcccattgtgggctcctcttagcaatttatgggcaga

SEQ ID NO: 16769 - DNA, 137 bp, Homo sapiens
agtatctgtccacctgtgggtgcagccacattcttctctactcttcaaaaataagtcggaataacttccagtttacggagatataggacaaggcaagaagggtggaagaaggcataagagatcctcacgtggcagtt

SEQ ID NO: 16770 - DNA, 298 bp, Homo sapiens
  misc_feature 49: s=g or c
  misc_feature 52: m=a or c
  misc_feature 53: m=a or c
  misc_feature 120: s=g or c
  misc_feature 273: y=c or t
  misc_feature 274: m=a or c
atcgatgtgagcagaaatcattgactaatgagtagaatttacttgaatsagmmaattgttacccttgtgcataaagagagagatgtattatctattacttgctaaaagtaagagtcttasgaggaatgtcattacacagcttttaacagttttcttcaagtttgtcctgaaatagggtcacagttaatactattcagtagaagataggaccctagagcttcaatacagcgttctgtgttttctgtttgaattgaagccttaaaatggtttgaymaggattttctatatgcctccacaa

SEQ ID NO: 16771 - DNA, 86 bp, Homo sapiens
  misc_feature 32: d=a or g or t
ccagactggagtgtagtagcacaactatggcdaagtgcagccttgacctccctgggctcagatgattgttccattgcagcctccca

SEQ ID NO: 16772 - DNA, 357 bp, Homo sapiens
  misc_feature 12: s=g or c
  misc_feature 13: v=a or c or g
  misc_feature 14: r=a or g
  misc_feature 42: s=g or c
  misc_feature 75: r=a or g
  misc_feature 83: r=a or g
  misc_feature 85: s=g or c
  misc_feature 111: s=g or c
  misc_feature 337: m=a or c
acaacgaaggtsvrtgctcagcgcgactctgcagacccagtsccgcgacttcccctaaagccaggcgtgtatctrcgcgtgtrasgtgctctgccgcaaccctatgcagasagcaggtaacctatgcatgtggcacaaaattcaaaaaatacaaaaggatgtacgttgaaaagtaagtctttcctcttcctgccctgtctccccagaggtcaccatagttatattttcttttgtgtatttattatttttttattattatttttattttttcactctctcagcttgtcaagagacacagttaccattcttgtgcaggcctccagaaacaacatatgamcaactaagcaaacacggcga

SEQ ID NO: 16773 - DNA, 223 bp, Homo sapiens
atactttgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagatcaggaaaagaagacctacaccagcg

SEQ ID NO: 16774 - DNA, 165 bp, Homo sapiens
cccatagttggtgagggctctgaattgtgatattcatacaagttcaggaatagttaagttccaacattatcactcccacctgaaattaggatactgtaaaaaaaattatgatgctacacaatatgtttataaatctctgttttagtctatcaacatcgttgtttt

SEQ ID NO: 16775 - DNA, 143 bp, Homo sapiens
  misc_feature 12: y=c or t
tttttaatttcytaatctaattgaacaaatacacaagtatctgcaattgtattgttgtaatggttaaaataaaaatacatggtttttattcatttattgtcaaataccaaaatcttacttagaacattagtatgctgcacgtc

SEQ ID NO: 16776 - DNA, 139 bp, Homo sapiens
caaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtt

SEQ ID NO: 16777 - DNA, 104 bp, Homo sapiens
  misc_feature 44: s=g or c
  misc_feature 45: s=g or c
accaagatggctgaggagagggcggaagtgtccgcacgtcgggsstccgaggcttctctttctcccctggcggtccggctctcgatggtggcgtgacggggggg

SEQ ID NO: 16778 - DNA, 144 bp, Homo sapiens
cgtcattccaaaaccacacccttgcaaagctttgtactccgcaccccagatgatctccaggcagctcagatctctttcctgcctttgccctgcactgttccccggtacttcctcctttattgtagcactcagctccccagccga

SEQ ID NO: 16779 - DNA, 196 bp, Homo sapiens
  misc_feature 141: s=g or c
gaaaggagaggagatgatttgtacacaaatgtgacaatctcattagttgagtcactggttggctttgagatggatattactcacttggatggtcacaaggtacatatttcccgggataagatcaccaggccaggagcgaastatggaagaaaggggaagggctccccaactttgacaacaacaatatcaagggcgc

SEQ ID NO: 16780 - DNA, 145 bp, Homo sapiens
  misc_feature 117: w=a or t
gaatagagaccccggaggcgcgtcctagccctcatctggggaagcgcacctgcatacagacgggtgcaccggggaggaggcgatctgccgcgtgttcctgcaagcagaaaaggagtwaactagtgtcacatttgaagacgagcac

SEQ ID NO: 16781 - DNA, 274 bp, Homo sapiens
  misc_feature 80: k=g or t
tttggtcatctcatttctacaatgaaaggaatactctctgttacttgttttagaatgtagggtcccttgctatttatatkcttttggggttagtgcagttcttatttacacatcatttgcagaaataatggtaactaccatttgtgtatcagaacaattttcacatatctaatttttatagcaattaaggtaggtagaagtgtcttcatcctcttaacttgtataaggagattggttcgggtaatcaggtgatttactcactgtcacacggcct

SEQ ID NO: 16782 - DNA, 208 bp, Homo sapiens
  misc_feature 10: m=a or c
  misc_feature 11: k=g or t
  misc_feature 124: v=a or c or g
gcgttagggmkagtttaatggccccattggtgggatgcgtggccaataaagggcaagaataaggcggattccgccttcctcgtggctgactggatgcatccgctggtactgatttacgtgagtvtcagcatttagacgttccgagtttccaccgagccagagttgggtagagagttattaagatgactaggagactaatgcggggtgc

SEQ ID NO: 16783 - DNA, 338 bp, Homo sapiens
tttgattctgaatagatttttgagttgtgacttattatgacaacattaaatctttgatagttgtcagtgtcaaaagcaatcttaacctcatctggagcagtgtttctttaatgagccaagggattacctgaagattttgttaaaatgcggactctgattcaacagatctggatgggcctgagactctagcaagctcccaaatgatgctgatgctactggaacatagtccatattttgagtagcaagaattgagcattcactgagtttttaaaccgagcttaaagatgtatcctagggcccatcaaatgggaaggagagcatttttatagacagaggaa

SEQ ID NO: 16784 - DNA, 276 bp, Homo sapiens
atgaccctcatttggtttgttaaagcattgggtcaatgccacgggaatgtaacaggtaaatggtctttgccttataacacagggtatcccatccgtgtaagacaatgaatttttaaaaaggcaaaaccaaaccttttgtttacatcatttgccttaaatagttcttagtacacaaattcttccttgcttggggccattatggtgtgtggaagtagaaaaagataaactgtagcttacagaaatagaaaagcaattttttcctatgatagaggcgca

SEQ ID NO: 16785 - DNA, 112 bp, Homo sapiens
tctaaggcgagcgagaaaactagtgttaaggaactctgcaaaatgaccccgtaagttcgcaagaaggggcgcctaaggtaacacttaggacacagtaaattatgaggggcat

SEQ ID NO: 16786 - DNA, 196 bp, Homo sapiens
  misc_feature 11: b=c or g or t
  misc_feature 76: w=a or t
cttggtggatbgacccttttatcactatttagtgtccatggtaattttctttattctgaagtctactttgtctgtwattaatatagccactccagctttcctttgattgttagcatgatgtatttcttcctctttactttcaacctattttgttatattgaggcgactttcgtgtagacaacatataattgggccc

SEQ ID NO: 16787 - DNA, 125 bp, Homo sapiens
attgcgggtagccccggcggtggtggcggtggtagcggtggtggcggcggcagtggcggcaccgcctcctcctcacattcccggggtggcggggttagatgagcggccccagtagcggcgatgta

SEQ ID NO: 16788 - DNA, 240 bp, Homo sapiens
  misc_feature 232: s=g or c
  misc_feature 233: s=g or c
  misc_feature 236: n=a, g, c or t
gagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggtatgcggagggggcggcgcgtgassggnccag

SEQ ID NO: 16789 - DNA, 166 bp, Homo sapiens
  misc_feature 45: r=a or g
atttttttgagagcgggggaggagagacaagcaggggcggcagargctcaacgggatgctgactgggttttgcttttcgtcccagccttgtggggccgggacggaagaacccatcaaagcccttcctcccgccgcctctccggaatgaggtctcagcacccgctcg

SEQ ID NO: 16790 - DNA, 464 bp, Homo sapiens
  misc_feature 320: m=a or c
  misc_feature 321: r=a or g
  misc_feature 342: m=a or c
  misc_feature 346: n=a, g, c or t
  misc_feature 415: s=g or c
  misc_feature 416: m=a or c
  misc_feature 450: w=a or t
cttaaaagagataaattattgtattgatgttaaaagaatatagatgatgttccacagtaagtaaataaaatcagcatctaaaacaaacttgaattgtgatgatcaagaaaaaaaatgtttaccttgcaaagaaatacagatctgcccactgtcatgagacagtggcttcccattagctctgttttagatcatttctaaatttactagattgtaaaatctcattatgaaagcctagacagggtgatgtatgtggagttctgtttataattaacaccttatagaatgtaatgtttttaaccaatgaatttttaaacaaaagmraaagggattttcaactaatamaagnccctccctcacctcagaggtcaccttctcagggcgacctgccctggtgatgctatccagcattgcagtsmccaccccccaacctggcatgccccaacttccttwccttcttaacttct

SEQ ID NO: 16791 - DNA, 187 bp, Homo sapiens
tggttgtaggaatgaagtccatatttacttgtagactataaactgaagatgttcccagcttttagaggctaacagattccttggcttgtgtctcgcttccttcatcttcaaagtcagcaatggcagattaaatccttgtcatgctgcaactcttttttttgcttccctcttccactttttttttttt

SEQ ID NO: 16792 - DNA, 377 bp, Homo sapiens
  misc_feature 345: s=g or c
caagaatttcactccatgacacagaggaacattgaatgatagctcagaaatgttgatagctgaggtactgaaactaacaaaaggattttggttgtccttgattattctgtcctgtaatgaataaaatctacactaaaggacaggtaaggaaaacttatagcagaaaaaagactaaatgtaccaatcacagcagtacaaaccactccttggcagaagtgtgcttctaaaagaatggggcagtaatcaggtagctgaactactaggctactgtcactcccagtccatccccaaataaatagtgtggaagtgtaatagtgtagtagtatttgattcaacaaagaaagsctttcacccccattcaaggttaacactgccat

SEQ ID NO: 16793 - DNA, 328 bp, Homo sapiens
  misc_feature 43: r=a or g
  misc_feature 44: n=a, g, c or t
  misc_feature 46: n=a, g, c or t
attcggagacagtcgtgccagccggtgggccacccagcgaagrncncgcctttgcaaggttgctggacagatggaactggaagggcagccgtctgccgcccacgaacaccttctcaagcactttgagtgaccacggcttgcaagctggtggctggccccccgagtcccgggctctgaggcacggccgtcgacttaagcgttgcatcctgttacctggagaccctctgagctctcacctgctacttctgccgctgcttctgcacagagcccgggcgaggacccctccaggatgcaggtcccgaacagcaccggcccggacaacgcgacg

SEQ ID NO: 16794 - DNA, 303 bp, Homo sapiens
catgggttggaggacacagcattttattggctgcacgtgtttggaaaagcccctttgaatagcatgggtctgtgccacagtcgtagagaactacttccgcctgagtgttcacattaatctgacagcaagttatatattcagatatccattcaggagtagcatccatcccctcaggacctttggcattactagggtgttgcattaggtaatgtccaaagtttggttttaaggggtggggaatgggcctggcctctaggttctaaagttctagggtcaccctggcccccagtgtgagagcagtgt

SEQ ID NO: 16795 - DNA, 405 bp, Homo sapiens
  misc_feature 255: m=a or c
  misc_feature 291: r=a or g
  misc_feature 358: w=a or t
cataaagacgtttcaggtagctatgaactgcatcattcatcagtgcagttcaatgcatcagtcaatgcagttgaaggcatcagtcaatgcagttcaatcttacggtggtttcataagagtgtataaataacaattgtatctttactgtcccttctctgtgtttaggtacataaataccattgtgttacgattacccacagtagagtattcagtagtcacctgctgtacatgtttgtagcctaagagcaataggtmgtacataccgtatagccgaggtgtgtagtaggctargccatctgagtttatgtaagtacactctatgatgatctcacaactatgaaatcacctaacaacacawttcacaggatgtgtgcctggcattaagcagcacatgactatattgct

SEQ ID NO: 16796 - DNA, 166 bp, Homo sapiens
  misc_feature 52: s=g or c
  misc_feature 63: v=a or c or g
  misc_feature 98: s=g or c
atttacagagagccgagctctggagcctcagcgagcggaggaggaggcgcasggccgacggcvaggtactgcggtgagagccagcgggccagcgccasctcaacagccgccagaagtacacgaggaaccggcggcggcgtgtgcgtgtaggcccgtgtgcggcggc

SEQ ID NO: 16797 - DNA, 173 bp, Homo sapiens
tgtttgtagtgcatggtgccaaaatgtttagactcataggcattgggaaccattacatttcttttgtttttattatataagtgggtcaaaggtagaggatggattgaggataaaggagaactggaaggaaggtggttctgagagtatcttaatagtctaagcaagagagtctt

SEQ ID NO: 16798 - DNA, 227 bp, Homo sapiens
tgatgggtgctgctttgggtttaacttgagacaccaaagataggtaggtctgaagccgagagaatttatttatttatttatttttcttttgagacagagtcttgctctgacgtccaggctagagtgcagtgacgctatctcggctcactataacctccaccttgcaggttcaagcgattctcctgcctcagcctcctgagtagctgggaccacaagcgcctgcttgt

SEQ ID NO: 16799 - DNA, 247 bp, Homo sapiens
aaataactgggtctacaggtgcatgccaccatgctcagctaatttttttaattttttgtagagatggggtctcactatgttgcccagtctggggcaatcatagttttagtttcaagggttctttaatattctgtgactgttctttttttacagcatcatgttcttgtttcatagatataatgacttttcttatatttctcaggctagtttttccctcacaaaaaagttttctctccacctggtctct

SEQ ID NO: 16800 - DNA, 175 bp, Homo sapiens
ctcagacaccgagttaaagaaggaaggggtttattcggctggggggcatcggcaagactcctgtctcaagagccaagctccccgagtgagcaattcctgtcccttttaagggctcacaactctaagggggtgtgcgtgagaaggtcgtgatcgattgagcaagcaggggatgtaa

SEQ ID NO: 16801 - DNA, 200 bp, Homo sapiens
cctttctctgagtgcctggtggcattttgggtacgaggagagccaagcgtgtttgagctgtgccgccctggagtgtggagaggtcgaggacctgagatagggagtccggagtgtgctgttcttttgcactagagtgaccttgagaaagacactgattaatccgatctgctgccttagttcacccatctgtaaagcaggcg

SEQ ID NO: 16802 - DNA, 109 bp, Homo sapiens
  misc_feature 19: w=a or t
aaatgctgaactgctcttwggaagtcgccggtgctgttgtagttggagtctgttcacgggcctgagcttcgaggccaggctcccgggtgtcgttaatgttcggggcctg

SEQ ID NO: 16803 - DNA, 100 bp, Homo sapiens
atttacttctgagaaacttgttttgcagttggaaagatgtaagactgaagagggaagaaaggcactagatcatagagaaccttatgtgataagccaaact

SEQ ID NO: 16804 - DNA, 302 bp, Homo sapiens
acgtatactttcatggtttatactattttaaaattattttttattaaatggagccaaattttttaaaagtcatcttttccactaaattgacatcaccatgttaaatctaaatttccctactaagtctttattttattttactttaagttctaggatacatgtgcagaacatgcaggtttgttacataggtatacatgtgccatggtggtttgctgcacccatcaacccgtcatctaggttttaagccctgcatgcattaggtatttgtcctaatactctcccattccttgcccctcccaccc

SEQ ID NO: 16805 - DNA, 145 bp, Homo sapiens
ttttgagacagagtctcgcactcttgcccaggctgtagtgcagtggcacgatttcggctcactgcaagctctgcctcccggattctcgccattctcctgcctcagcctcccgagtagctgggactacaggcgccaacccccgcca

SEQ ID NO: 16806 - DNA, 242 bp, Homo sapiens
agattctggtatctagacaaaaaggatagctaagcagcagatgttcttatcctagctctgtgttttacaaacagcaaatgtaataaataaaaagatatattttctcttccagtgatccatagatttgctgtaatcattgtaggcatttaaagatgtaatcttgtaatctcatggtcaggaagtagggttgcttttagtacaaagctaccagagctggacatagaatgacttccacccctgcc

SEQ ID NO: 16807 - DNA, 208 bp, Homo sapiens
  misc_feature 29: s=g or c
  misc_feature 31: n=a, g, c or t
atggccctggaggcggcgggagggccgcsgnaggaaacgctgtcactgtggaaacggtaatgctgtcaggcgacgcgcaggaggcgggggccgaggccgggcggcccttcgcggaccctccgagctcatagtcttcaggctgtggaatcggagctgccaccgcccgagactccaaagcaaagcccagtttccggcgcggaagcgagga

SEQ ID NO: 16808 - DNA, 378 bp, Homo sapiens
acaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccatggcccttcccctgaggtcttttggcctagctctgtacaaccaggacacaggaa

SEQ ID NO: 16809 - DNA, 262 bp, Homo sapiens
catcctcacttttaattttatttatctatgtttcagagatgggatctcactctgttgcctaggctgcagtacagtggtgtgatcatggcttactacagcctcgaactcctaggctcaagggatcctcctgccttggcctctcaaagtgttggcattacaggcatgcaccaccatgctcagccagatttcaacttttaaatatttttgaaaaccataaatgtagcattaatataatcttttaagaaatttcatacagggcttg

SEQ ID NO: 16810 - DNA, 317 bp, Homo sapiens
atcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggtaagtaactttcttttgtttataatgtataaatgtgtacatgttggttgaataattaaatgatcttacattttagtgcggttcttgaaaatcatttttctaatggttattagactaataatgtgttagtccgttttcatgctgctgatgaggacatagcctgagac

SEQ ID NO: 16811 - DNA, 408 bp, Homo sapiens
  misc_feature 81: r=a or g
  misc_feature 84: r=a or g
gccaaaggagctggccggaggaaattgtaggcccggggccgcgggcatctcggcgggtataatctctggccgtcgtgacgraartgacggacctgtttttcacataccagcggttgtttccataaatgccagccatgggaaatctccctgtgtacagaaacctaaaggccggctcagctgcctccacttgtctcttttgtcacttgtggccacgaggccgtggtaaaacttgagaaaagcaaaagaatgagggaaatgcgctgtattggggtctctgcaggggcacggtaagggtaagggtccatttttaactggatggtggattcctgagatactgttttgttcctagttgacatgtatgttacatatattttttggaaaaggaaaagaaagtgggtgttcagtcac

SEQ ID NO: 16812 - DNA, 180 bp, Homo sapiens
agtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaa

SEQ ID NO: 16813 - DNA, 201 bp, Homo sapiens
ctttctttttgaggaagacgcggtcgtaagggctgaggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaa

SEQ ID NO: 16814 - DNA, 339 bp, Homo sapiens
  misc_feature 45: m=a or c
gcgtctttgcgtctgtctgtctgactgatggtcctcacacgcggmtccctgtgactgggcgcgaccccggcaagcgcggcttggagggcagacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgaccaggccgagagtttcaggtttcttgctatatggatcactgattgaataatagatggctttacctcgtctcacaggagccttgcgttccttttcaaatgtcaccaagcg

SEQ ID NO: 16815 - DNA, 361 bp, Homo sapiens
  misc_feature 46: b=c or g or t
  misc_feature 47: m=a or c
aaatattaaacaataatggtggctgggcatggtggctcacgcctgbmaatctcagcactttgggaccctgaggcaggtggatcacttaagcccaagagtttgagaccagcctggccaacatggtgaaatcccatctctactaaaaatacaaaaaattagcggggtgtggtttctaggcacctgtaatccaactactaggaaggctgaggcatgagaatagcttgaacccaggaggcagaggttgctgtgagctgaaattgcaccactgcactccagcctgggcaacagagtgatattccatctcaaaacaaaacaaaacaaaacaaaacaaaacaaaacaaaacaacaaaaccccaaacca

SEQ ID NO: 16816 - DNA, 181 bp, Homo sapiens
cacatatgatgtatgcaggtattggttaagtcacctaaatcttcttcaagccaaatattcttcattcctttcatttttacctcttatagtttccagactccttaacatcatggttggcctcctcttagaatatcattaaaacttggtatctcaactatggtctgacccatacatccccgtc

SEQ ID NO: 16817 - DNA, 234 bp, Homo sapiens
agcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctc

SEQ ID NO: 16818 - DNA, 142 bp, Homo sapiens
gggtaggaaaatgctttataattactaaaatgtgtctacggtcatactatcctgaatgcaccctatctcgtctaaattctaaaacgccccacaaaaatatttttactttgtttgtactatttgcttagcttttccccgcaaa

SEQ ID NO: 16819 - DNA, 209 bp, Homo sapiens
gtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatc

SEQ ID NO: 16820 - DNA, 343 bp, Homo sapiens
  misc_feature 31: w=a or t
  misc_feature 126: r=a or g
  misc_feature 327: r=a or g
actttaggaactccttatatacttggttttwcttaccttgaaacctgtatgtatatgctccttatgcatatgtttatgtcttaaatatattttaaaggaaacaaacgatcccgtttcgtgcaagartaggaggaggattgcttgagcccaggagttcaaggctgcagcaagctttgattgcgccactgcactccagccttggcgacagagcaagaccctgtctcaaaaacaaacaaacaaacaaaaaaaaaggtgcaagcaagccaagtatccactgatagatgaatggataaatacaaagtggtatatacgtactatgaccttgaraaggaaggaaattctg

SEQ ID NO: 16821 - DNA, 177 bp, Homo sapiens
gaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgtt

SEQ ID NO: 16822 - DNA, 170 bp, Homo sapiens
caaaaaaattagctgggcctggtggtacgtgcctgtaatcccagctactcaggaagctgaggcaggagaatcacttgaactcgggaggcagaggttacggtgagccgagatcgcgccattgcactccagcctgagcaacaagagtgagactccatctcaaaaaaaaaaaa

SEQ ID NO: 16823 - DNA, 92 bp, Homo sapiens
caatttaatatagcatctgattgaaagcatttgaagttagattactaaatatagtaaaactatatttagttaaataaagttagcctgtcact

SEQ ID NO: 16824 - DNA, 135 bp, Homo sapiens
tactttaagttctaggatacatgtgcacaacatgcaggtttgtttgcatatgtatacatgtgccatgtttgtttgctgcacccattaattcatcatttacattaggtgtttctcctaatgctattcctcccccaa

SEQ ID NO: 16825 - DNA, 109 bp, Homo sapiens
  misc_feature 93: n=a, g, c or t
tgtcaccaggcaaaacagggcagtcctcttgctctaaatgttggaaagcaaacattgtggcaggtttggctgaaatgagggggaaggagagtncttcagtggggaggat

SEQ ID NO: 16826 - DNA, 218 bp, Homo sapiens
  misc_feature 91: w=a or t
  misc_feature 92: w=a or t
tggaaacagagcaagatcaatgaaggctaatggcaagaataagaaaaagagttgagatttaaccaatagcggacataaaggatcatgacawwatcaaattataaaagcatacttgaaataggtggagctttttcttttgaaaatatatattcacaattttaatattttaatttattttttactatttaaccctgtacttggcaatgctcaggcagctt

SEQ ID NO: 16827 - DNA, 268 bp, Homo sapiens
agcactacgatacctagacagttgatttgataactaagatggctaatagatagggagcatttacagcatggatacacaggacaaagggatggtttatacataacctgggtaggatggagcaggacagtgtgagattacatcacactacacagaactgtgtgcaatttaaaaggtttgaattgtttatttttggaattttcgatttaatattttcagaccatagttgactaggtaattgaaacctcagaaagcgaaactgcggatgagg

SEQ ID NO: 16828 - DNA, 162 bp, Homo sapiens
actactaaaaggaaccatggtatcatttcctactagaaagaaccatggagcagggggtggaattcatttgcccagcttccctcataaaattatacctgatcataaccaaagagttgatgagagaagttttttatttaaagaattagtctacctaggcagggc

SEQ ID NO: 16829 - DNA, 226 bp, Homo sapiens
  misc_feature 4: m=a or c
  misc_feature 5: m=a or c
  misc_feature 11: m=a or c
  misc_feature 12: m=a or c
ttgmmaggagmmagggtgataggcagggttaaccacaaagtagcatgggggacatttttgggatgatgaaatcgtttgacattttgattacagcggtggccacacgactatacatgtttgtcgaaattcacagaactgtacactagagggtacgttttactatatattaattatactgtaattttgaaaatggaaaaattattcaaataagtctatgaataccaga

SEQ ID NO: 16830 - DNA, 330 bp, Homo sapiens
  misc_feature 4: w=a or t
  misc_feature 144: m=a or c
  misc_feature 250: n=a, g, c or t
cggwgaaaccccgtctctactaaaaatacaaacaacaacaaaaaattagccgggcatcgtggcacgcacctatagtcccagctgctcaggaggttgaggcaggagacttggcttgaccccgggaggcagaggttgtagtgagcmgagatcacgctactgcactccaacctgggtgacagagcgagaccgtgtctcaaaaaaacaaaacaaaacaaaacaaaaagtctgggagcggtggctcacgcctgtnatcccagcactttcggaggccaaggcaggaggatcacctgaggtcaggagttcgagaccaacctgaccaatatggagaaa

SEQ ID NO: 16831 - DNA, 159 bp, Homo sapiens
  misc_feature 132: h=a or c or t
tcaaagctgaggacagggtgtgagcgccacatctctgaaagcacaggagacactgtgctataaatcctttggggagcgatgttttgaatttagtgagatttaccagggatgtagattaaggtgatgtgatthaaaagatgccattcatagagagcccta

SEQ ID NO: 16832 - DNA, 212 bp, Homo sapiens
  misc_feature 47: m=a or c
  misc_feature 61: d=a or g or t
  misc_feature 139: y=c or t
ccctcatccctagaaatagcagctgttatctacttttttttgtttgmtttttgagacagtdttgctctgtctcctaggctggagtggaatggcgtgatctcagctcactgcaacctccgcctcccaggtacaagttatyctcatgcctcagcctcccaagtagcttggatcacaggcatctgccaccacgcccggctaattttttttttttt

SEQ ID NO: 16833 - DNA, 213 bp, Homo sapiens
aattgtgattataatttacttagcagatatttctggaacttctctacgtgtcagttattgttttggccattgaaactacagcagtggataaaaatccctgttctcatagagtttatattctgggtaggaaaaaacaaacaaattataataagaaaatactgcatttagatgatctgttaaatgttcctcggttaacattttaatagctacacc

SEQ ID NO: 16834 - DNA, 173 bp, Homo sapiens
  misc_feature 122: y=c or t
caccagctaacattttcctactaaattgaaataccacctttgtggtaagttaaattctcttttactaaatgattatataattatttgcagagaattaacatttgtatgaggttaggactttyccatccaattacacagtacacttttacatttcttttaggggaggggacgtt

SEQ ID NO: 16835 - DNA, 84 bp, Homo sapiens
gtgcagtaggcttgtcaaggagaggatcctccctggcctctccttgggcagaggaggtggtccataaagctgctctggagcgat

SEQ ID NO: 16836 - DNA, 175 bp, Homo sapiens
  misc_feature 121: m=a or c
  misc_feature 123: m=a or c
tttgtattttagtagagacgaggtttcaccacgttgcccaaggtggtctcaagctcctgagctcagatgatccacctacctcggcatcccaaagtgctgggattacaggcatgagccaccmamaccaggcctagaatcttttatgagaagtctagggttaggatgatctgcctgc

SEQ ID NO: 16837 - DNA, 176 bp, Homo sapiens
agaagaaagattggatgtacttgggcctcaggaacaaccagaactaagtatatggatgtcagcacaaaataaaagatgaagatattttaaaggctcatatctggtaagcaattaagaagtcaaatgttgaccaaaacaggagttcaaatccactgttttttttttttttttttttt

SEQ ID NO: 16838 - DNA, 398 bp, Homo sapiens
  misc_feature 21: n=a, g, c or t
  misc_feature 40: d=a or g or t
  misc_feature 326: n=a, g, c or t
atctgagctgtgctttgagtnaagtaatttgacagcagtdagtgatcagtttgaaggccattttaatagtttggcaggcaataataagaggctaccttattatggagactgaaaactagaaatcagtggttgatactttggaggattgacaggtttgacaactgagaggtgcctgggaagaggttggttcctgttgctgaggagtaccagcaagttttgaagggtggcaatgggaaggatatgatgtgacaaactggactgctaatgggctgttcgagtgaagatgtctgtcatacctttacagatgcaggtctggagctcagganggaggtcagagctgaacttgacatcatcaatatagaactaatcattgaagccatagtatggcatcattggga

SEQ ID NO: 16839 - DNA, 379 bp, Homo sapiens
ctattatattcttaaatatatctgaagacttgaagacctgaatataataactgaattataaaaattacctttttggtttttatggtttccaaagtatctcttttttctatggttagcttttgcatttgctcatcttagtatttgttttctgtgctgttgatgttctcaattgtttgattattctttttctcttctacctcaagctggtcatcttttttttattttgctccctctggtgttgggcgtcccttgatgacagcaggaatcctaatctgtgagccagctttacaaaccagacaggcctgtgctcccgggtgctctgaccctggtggtgggacaggaagttggttgtatacatgtacttttctctgtggccggg

SEQ ID NO: 16840 - DNA, 156 bp, Homo sapiens
cttccaactgcagctactcaaacagaagagctttgcagaggcagaggccttctggcccggccctgccgctgccattgtgcagtcaggccagcacaggagtcaatatggttccttggctgatttgctctgggcctcaaaagctgctttttttttttt

SEQ ID NO: 16841 - DNA, 148 bp, Homo sapiens
ggcatggtggcgggcgcctgtagtcccagctacaggagaatggcaagaatccggaaggcaaagctggagcttgcagtgagctgagattgagccactgcactccagcctggtgacagagtgacactcctatcttcaaaaaaaaaaaaaa

SEQ ID NO: 16842 - DNA, 154 bp, Homo sapiens
cattctagattgcaaatttaaggaagagaagctgttaagatgtgtctagtaccatactttatatatgcttggctcagttagatacattcattacttaatttgttgttgtaagaggtagttctattaccatttcacagatgagtagagtgaggtc

SEQ ID NO: 16843 - DNA, 84 bp, Homo sapiens
actccgcgccccaacatccgccccggcgtgggccagaggcgaagaagaaagaagataaatggcccggagaagcaacaggaaacc

SEQ ID NO: 16844 - DNA, 178 bp, Homo sapiens
  misc_feature 108: s=g or c
  misc_feature 139: k=g or t
  misc_feature 156: v=a or c or g
attggtagggatggggtttcgccatgttggccaggatggtcttgatctcttgacttcgtgatctgcccacctcggcctcccaaagtgctgggattacaggcgtgagcsaccaggcccagccaacatcttttcatatgtktcttggtcatttgagtvtcctgttttgtgaagctgcctt

SEQ ID NO: 16845 - DNA, 159 bp, Homo sapiens
  misc_feature 94: k=g or t
cctcttttgtaaattaaaaaattagcagggcatggtggcgtgtgtctgtagtcccagctactctggaggctgaggtcagaggatcacctgagtktaggaaggtcaaggctgcagagagctgtgattgtgccacagattcccaccagtgcaaccccacat

SEQ ID NO: 16846 - DNA, 176 bp, Homo sapiens
tagggattttacacacattctcttttttttcttttttgagatggagtctcgctctgtcacccaggctggagtgcagtggtgcaatctcaactcactgcaacttccgcctcccgggttcacgccattctcctgcctcagcctcctgagtagctgggactacaggcacccgccacccc

SEQ ID NO: 16847 - DNA, 171 bp, Homo sapiens
ttgtgttatagccaataaattattgctgaatataatgttgtgaagctttccccctacgttttcatctaggaattttataattttaggtcttatgtttatgtctttaattcatttgaattagcttttgtataaggtgtaagagaaggtccaacttcattttctctgcgtgtc

SEQ ID NO: 16848 - DNA, 143 bp, Homo sapiens
tctcaaagtgttgcatgtgaaattcaaatgtgaaaatacaaatggcaacacattataaactgtaaagagcaatatgaatgtcatgtgcccttaggcacaatgaagtagcttttattggaatagagtgtaatgcttaatgccca

SEQ ID NO: 16849 - DNA, 97 bp, Homo sapiens
cccaggagatagaggaggctgcaatgagctgagatggtgccactgctctccagtctgggcaacagtgagactcctcactctcaaaaaaaaaaaaaaa

SEQ ID NO: 16850 - DNA, 150 bp, Homo sapiens
taaacatgatttacagaaaaggaaataacaaatggtgtcttcgcatatgaaaactcataagagaaatggaaattgaaagtacaatgggattttttttaacttaccagtttgaaaaaataggaagtttgaaaatatgctatgtggccaaga

SEQ ID NO: 16851 - DNA, 315 bp, Homo sapiens
agtcgtcgggcagccgacgccggcgagacggcagggcgtcggagcggaggcaaacccagcgcgaacgagggaagacgttaccttgttcatcccattccccatggtggctgaaggcgaacgctagcgccccggccgtgtggtcgcaggcgcactatgcattgtccagagagaggctgcccagttgaatacctgagttctcaaggccatgcagaacagcctgaccatgaggatgggcccctgtggtatacgacctcaactcttcaaaggtcacaatttccagccttccaagcagtcttctaattatgaacgtggtgt

SEQ ID NO: 16852 - DNA, 123 bp, Homo sapiens
gacttcctaaaccagatcctctggggctggaacctggcactctgcatttgtaatgagggctttctggtgcacacctaattttgtgcatctttgccctaaatcctggattagtgccccatcaca

SEQ ID NO: 16853 - DNA, 192 bp, Homo sapiens
cctctaagtctatgctcaaatctcaccgtctcatgggacagaacataccctgtgtacccccagcatttcctaaacctctaggcctgctgttttctgtagcctttcttactttctagcatactacatcatccacttatttattacagttgtgcattctcattctctcttctccttttcctccctctcctcccg

SEQ ID NO: 16854 - DNA, 178 bp, Homo sapiens
atgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccaccca

SEQ ID NO: 16855 - DNA, 313 bp, Homo sapiens
aaagataactgaaaatgtggaagtggctttggaactggataacgtatggaggttggaagagtttggagggctaagaagatgataggaagacagggcaagtttggaacttactaaagactgattaagtggctctgataaaaatgctgatagaagaatggacaacaaagcccaagctgacgaggaatttactgggaactctggagcaaagttcacccttgttacaccttagcaaagaacttgactgcattgtgtccatgttctaggactttgtgaaaggctgatcttaagagtgatgacctagactaactggcaa

SEQ ID NO: 16856 - DNA, 295 bp, Homo sapiens
ctaatagaaatagaatttggaaatatctatctgagacatttttaaatctgaggaatccgtaaaatggtggctcttgggtatccagccctcaggatctccatttacctgttaaagtgaggatttggtgcctttcttctttagttgggccatcaagaaaacttcagaaatcaggcattctgtcttcctatacaataaatattttcagatcatattttcagataagagtcttcagcttccctcagctattcaacccaatgcatggaaagcctcagttgaataaacttttccacctgga

SEQ ID NO: 16857 - DNA, 93 bp, Homo sapiens
ataatattatagatcaaatcaagttgggtataacctgataggaaataatctattttaagaactgtaattaatgtttaaccatgtaaccccccc

SEQ ID NO: 16858 - DNA, 190 bp, Homo sapiens
caagaaaaaaaaacaaaaacaaaaacactatagctgaggtgggcagatcacttgaggtcaggagttcgaggcacatgccaacatgcctggctaatttttgtatatatattttttagtagagatggggttttgccatgttggctaggctggcctcgaactcctgacctcaagtgatctgcccacctcagct

SEQ ID NO: 16859 - DNA, 348 bp, Homo sapiens
aagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggagtaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgttgcgtacagttaatgagacgcaca

SEQ ID NO: 16860 - DNA, 186 bp, Homo sapiens
aataaaaagggaaggcaggaggtgttagcgagcatctggtccagggctgcatctgccatgaaatcttgtgatttataagacccagcaaaggctttcgagtcacacttgaaagaaatgctgggacaggggatttcctgctgcaatgcctgggttccagcccaattagggaagactttaggaggaaca

SEQ ID NO: 16861 - DNA, 256 bp, Homo sapiens
  misc_feature 233: k=g or t
tttactagctggacagggattgaacacatttattggacaccaagaggaatttcccttctccagaaaaatttaaataggttaaaagtctggaaaggtgacagatttgggtgacttctgaggaaaaccaagagccccgagttctgggtatgataatggcttcagctaaatttttaatactgagcatattttattacctaatcagctagataggtaacaaaaacaacatgcatgtkattatattttactagccacagac

SEQ ID NO: 16862 - DNA, 202 bp, Homo sapiens
  misc_feature 70: s=g or c
  misc_feature 72: s=g or c
  misc_feature 128: k=g or t
  misc_feature 163: s=g or c
cattgcattaaatacttctagtaggcactgtatgcctagcattggtgattaacattgttgagccgtagtscsggagaaaatcaactctgctgtacatacatacacaacacacttttgccttctgtatktgtagacctaagtgaagaaacttgattctttaccsaatctaaagtgcagaattagtattttatctgaaggaagg

SEQ ID NO: 16863 - DNA, 265 bp, Homo sapiens
taataggagaaaaataacaagaaagtcttcaaactcttagattaaaattaagcagcagccttataaataatcaatgagtcaaagaggaagtctcaagggaaatctaaaaatattttgaactgaacgaaaatgaaaatatggtttatcaaaatttgtgggatatagcttaaagcagtgcttagagagaactttgtggcattaaaagcttatttagaaagaaaagtattcaatcaataatttaagccttcacttatgaaatgagagt

SEQ ID NO: 16864 - DNA, 201 bp, Homo sapiens
ggcattgtggtgtgtgcctacagtcccagatactttggaggctgaggtgggaggaacactggagcctgggagtttgaggttacagtgagctgtgattgcgctattatactcccgcctgagtgacagagcaagactctgtcaaaaaacaaaacaaaacaaaaaaacaaaattgccatagcaacccaacctttagcagccacc

SEQ ID NO: 16865 - DNA, 280 bp, Homo sapiens
  misc_feature 41: h=a or c or t
ttgggaggtcaaggcgggtggatcgcctgaggtcaggagthcaagaccagcctcgccaacatggtgaaaccctgtctctactaaaaatacaaaataagtcaggcatggtggtgcacacctgtagtcacagctcctcggggggctgaggcgggagaattgcttgagcccgggaggcggaggctgcagtgagctgagatcgtgccactgcacttcagcctgggcaacagagcgagacctctgtctcaaaaaaaaagaaaagtagaatttcagccggggcgac

SEQ ID NO: 16866 - DNA, 104 bp, Homo sapiens
ggatgtgagggcgatctggctgcgacatctgtcaccccattgatcgccagggttgattcggctgatctggctggctaggcgggtgtccccttcctccctcacgt

SEQ ID NO: 16867 - DNA, 221 bp, Homo sapiens
ggcgtgatgtggtgaaacccagtctctactaaaaatacacaaattagctgggcatggtggtgcatgcctgtagtcccagctactcgggaggctgaggcaggacaattgcttgaatccaggaggcagaggttgcagtgagccaagattgcgccactgcactccagcctgggtaacagagtgagactccatctcaaaaaacaacaacaattaacaacaacaaa

SEQ ID NO: 16868 - DNA, 179 bp, Homo sapiens
aagacaaaggggcaggataaggagtgtgagccatctccagtgataggccacggcgtatgcctccgaggacggggtcctgaccgaggccatgatggacacccgcgtgcaagatgctgtccagcagcaccagcagatgatgcgctggctgaagagggggaggcctgggcccgaggacgagc

SEQ ID NO: 16869 - DNA, 379 bp, Homo sapiens
  misc_feature 145: w=a or t
tcataagttatcactgaaagtaaccccaaagaggaagttccaaatatttaaaatagtggcagcattattgtaataagtacatagccttctatgtggccactgtgggaggcaagatggatttgtatgtataaacaataatgcagtwgttttaggtatctcacattttttaaacattatgcagttatttattgttaatattacgctgactattatatatccctgtagacatactgttttatttttgcttcaaaaaaatcagttaaagaaattaagaaaacggatggtcttttatatttatctacatttcatttccagtgttcttcactttttttgtagatctgagttttaatatgataccattttcttttagccagagcac

SEQ ID NO: 16870 - DNA, 280 bp, Homo sapiens
ttgctattcttgtattgtgattcacagagcgccttacagagattctggatccaaaggcttggctagagggcctccctggctgagccagccttccaggccaagcatcctccccagagggccacccagattgagaagggccaaagaggggctggacttgggctggggccctggagtgtgtggagaatcgagaagtgcagtggtcgtgggctactcctttgtcttcacttagctgagctcccagggggtccctctgccccccagctgccaacacttttttttt

SEQ ID NO: 16871 - DNA, 308 bp, Homo sapiens
ttttgaaagaatactacattctaattacatctgctcctcatttaacttttctttttcttttttttgagatggagtcttgctctgttgcccaggctggagtgcagtggcgcgatctgggctcactgtaacctccgcctcccgggttcaaacgattctcccacctcagcctcccaagtagctcggattacaagtgcgtaccaccacgcctggctaattttttgtattttagtagagatggggtttcaccatgttgcccaggctagtgtcgaactcctgagctcaggtaatccacccacctcagcctccca

SEQ ID NO: 16872 - DNA, 226 bp, Homo sapiens
aattattgtgtctctgtgtgggagagaactggctgaagaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagagttcagaaggaacagctggctgccaat

SEQ ID NO: 16873 - DNA, 208 bp, Homo sapiens
ctctgtgctattgaatattgaatatcccattgtgtgtgacgttccccttcctgtatccaagtgttcttattgttcaattcccacctatgagtgagaacatgtggtatatggttttttgtcctggcgatagtttgctgagaatgatggtttccagcttcatccacgtccctacaaaggacatgaactcatcattttttatggctgcata

SEQ ID NO: 16874 - DNA, 100 bp, Homo sapiens
tatccttctcaacctttctgcaaaatttgacacaattgggcacctctctcaaagcttcctttagccctcaggactgtgtcatccaacccccaccagccct

SEQ ID NO: 16875 - DNA, 122 bp, Homo sapiens
attgtaacacacattctacgcctagcctggctttcttgctctccctcatctcattgtttcagcggaggccaaatctgaagtcctttccagggagtggctctgttcatcttattcgccacccc

SEQ ID NO: 16876 - DNA, 184 bp, Homo sapiens
agaagtcggaccggaagtggaagtggtccccgaaggctatttcgccgctggcgtcaggactattttcacgttttaatgccgagaggtctctgtgacgattttggttggttgcaattagggattctgtgaagtcagtaatagaggagttgtctgtggaattagtgatggtggtttcggggcaacc

SEQ ID NO: 16877 - DNA, 111 bp, Homo sapiens
cacatcattcagttataaatatttatttaatattgtaccaggtacttttctagagctgagattacagtgggaacgggaccaagtaccatcatggagctgagacagacatct

SEQ ID NO: 16878 - DNA, 152 bp, Homo sapiens
aaggtttgctccctgagcgtacccaggtgctacagcatcagcttcccttgccgcttcctgcggctgaagggatggtccgaccaaagcctcctgccctggggcagccgatgccactgcatgctttttcctgcgcttgggcttcacggcgccac

SEQ ID NO: 16879 - DNA, 170 bp, Homo sapiens
  misc_feature 26: k=g or t
  misc_feature 27: r=a or g
  misc_feature 28: s=g or c
  misc_feature 34: s=g or c
agagtggtacaggctgaagcggaggkrsgaggasactgtttcaagattcctgcgccactccttcgttgttatagaagttggactaaataaaagggtaatcacaagcgtacagataacaggcaggcaggaatgtgaaaatcagagagaagagagatgtgcaccagaagcga

SEQ ID NO: 16880 - DNA, 113 bp, Homo sapiens
  misc_feature 32: s=g or c
  misc_feature 33: s=g or c
ccaggcatggtggcatgcgcctgtagtctcasstcctcaggggactgaggtgagaggaccgcttgaacccaggaggcggaggctgcagtgagctgagatcacaccactgcact

SEQ ID NO: 16881 - DNA, 162 bp, Homo sapiens
  misc_feature 123: r=a or g
agcaaagtccaggcccctctgctgcagcgcccgcgcgtccagaggccctgccagacacgcgcgaggttcgaggctgagatggatcttgaggcggcaaagaacggaacagcctggcgccccacragcgcggagggcgactttgaactgggcatcagcagcaaa

SEQ ID NO: 16882 - DNA, 139 bp, Homo sapiens
  misc_feature 103: k=g or t
  misc_feature 114: w=a or t
  misc_feature 115: w=a or t
  misc_feature 121: d=a or g or t
tgaaagctaaaggacagagaaagtaactttttcagtgttctgtgagaaaatacttattaatgcatcattctatacccagcaaatatatctttcttttagcatkaagatgaagtwwaatcadttctcagccaccatccca

SEQ ID NO: 16883 - DNA, 272 bp, Homo sapiens
  misc_feature 94: s=g or c
  misc_feature 122: m=a or c
tgacttcgtgtagtttgttgctttaaaaaatttgtccagaattgttttctgcagaagcatggtctgttaggagcttacaggccataggagaagsggttgtttcctgaatttaatcttttgcmtgtattcatttagggcttgggagagtcccaagataattcagtcactgtcagattaatcatttcggcagaacaaacaatattgttatgattatttaatccttaaaattgtgatctccagagtttgttatcagaataacccagaccaaggct

SEQ ID NO: 16884 - DNA, 129 bp, Homo sapiens
  misc_feature 18: d=a or g or t
tcaatttcagagcctgtdattgttctattcagagattcagatccttcctggtttagtcttgggaggatgtatgtgtcgaggaatttatccatttcttctagattttctagtttaatttgtgtagggcgt

SEQ ID NO: 16885 - DNA, 67 bp, Homo sapiens
gatggggtcttgccatgtggtccaggctagtcacaaactcttggcctcaagtgatcctccctcctca

SEQ ID NO: 16886 - DNA, 124 bp, Homo sapiens
cagactggattgcaaaatgtaatgatagtcatataaagccactgatatttaggaaccacccagtctcatgaaataactaaacatggcataatgtttatacaaccaaaattgttttccccattgc

SEQ ID NO: 16887 - DNA, 79 bp, Homo sapiens
  misc_feature 60: n=a, g, c or t
  misc_feature 63: y=c or t
caaagaggccttagagcgagcagagcagctctgctatgagtgtgtgtgtgtgtgtgtgtngtytctttttttttttttt

SEQ ID NO: 16888 - DNA, 137 bp, Homo sapiens
cgattctcctgcctcagcctcccaagtagctgggattataggtgcttgccaccacgcccaactgatttttgtatttttagtagagatggggttccaccatgttggccaggctggtctcgaacccctgagctcaggct

SEQ ID NO: 16889 - DNA, 119 bp, Homo sapiens
aacaaagagctgactgatatttgaagaagtgttttcatctatccaagaaaaatatgatgtctccatcccaagcctcactcttattcttaaatgtatgtatttttatttgtgaagaagcc

SEQ ID NO: 16890 - DNA, 181 bp, Homo sapiens
tatataactacaataacaacagttggtagttctctaaaatatttaattatggtaaatcagaaaaggccctttaatttttgcatctgttgaatgaattgctttaggatctcttctgtggttgtttctctttatactgaatgctgtcaatattattgagcacttactgtgccgaaccacatgc

SEQ ID NO: 16891 - DNA, 127 bp, Homo sapiens
ggtgtctttttagtataatgatttactctcctttgggtagatacccagtagtgggattgctggatcgaatggtttttataattttctattttaccacagtttctctctgcatttttcctctttgacc

SEQ ID NO: 16892 - DNA, 186 bp, Homo sapiens
ttaatcctcgcttatgttggaaaatatgaaaagtataaattaggcgggcgtggtggctcacgcctgtaatcccagcactttgggaggccgaggcaggcggatcacgaggtcaggagatcgagaccatcctggctagcacggtgaaaccccgtctctactaaaaatacaaaaaattggccgggcgaa

SEQ ID NO: 16893 - DNA, 163 bp, Homo sapiens
tttagggccgggcgtggtggcttacgcctgtagtcctagcactttgggaggccgaggcgggtggatcacgaggtcagggggtcgagaccagcctggccaacatggtgaaactctgtctctactaaaaatacaaaaattagctgggcatggtggtgggcgctct

SEQ ID NO: 16894 - DNA, 141 bp, Homo sapiens
  misc_feature 15: k=g or t
atattgaagacgaaktccgggagatgtggaagagctggcctggagatagcaaagaggtccaggttatggctgagagatacaagatgctgatcccattcagcaaccccagggtgcttcccgggcccttctcatacacggtgg

SEQ ID NO: 16895 - DNA, 198 bp, Homo sapiens
caaatactcagcaatacattctgcacatattattattattattatcattgagacggagttccctctgtcacccaggctggagtgcagtggcacaatctctgctcactgcaagctccatctcccggcttcatgccatttttctgcttcagcctcccgagtagctgggactacaggcgcccgccatcacacccggctccg

SEQ ID NO: 16896 - DNA, 129 bp, Homo sapiens
ggattatccagcccaacacgcccctggttctaggctgggaaaccgcgctcatgggttaggtctctgggtttcatcttgggagggcttcgttattgaggagaattttatatctccgctttgctgggcgtc

SEQ ID NO: 16897 - DNA, 145 bp, Homo sapiens
tactggctctgctgcgcgaagtggagatgaactggtacctaaagctctgcgacctgtccagcgagcacaccaccgtctgcaccacaggcatgccgcacagtttggttctacctcatttgcctgctgtaggagtccccaggacaca

SEQ ID NO: 16898 - DNA, 65 bp, Homo sapiens
  misc_feature 49: s=g or c
ccaaaacaaatagatacggtgtttgattacaaaatgatgtccccaaccsttgagtagattttttt

SEQ ID NO: 16899 - DNA, 271 bp, Homo sapiens
aaaaaagcggaaatgcacccatcccatctgaacaggatatggccaagattaaaaatggaacatcagaaagaagaggctgtgctggaatttggaggccattcaaaaatccagcccagcaagtctaatggttagtcacaactgaatctttcagaagaggaaagagcagacactaggcacagaacaaagagcaaatgaaacaggaactgtggaataacactgtgttcccaaagaaaacataactgccatagatcacagaatgaaagccccagtt

SEQ ID NO: 16900 - DNA, 77 bp, Homo sapiens
  misc_feature 22: k=g or t
agggatcccaataacgtgtatkaggcttcttagagttgatgctgatgctctatttctcttaattctttttttttttt

SEQ ID NO: 16901 - DNA, 198 bp, Homo sapiens
tatttctttattgatattttttatttggtaagatattgttatactttcctttagttcttttgaacatggtttcctttggctcctattacatatttaaaatcactgatttacagtctttctctgtaagtccaatgtctgggcttcctctgggatagtttctactgtctgtttcccccaatccccatatggacctgccac

SEQ ID NO: 16902 - DNA, 140 bp, Homo sapiens
tttaacatatttgggtccaacttcaataatgtaataattaatacattaaaagcatttaacttcctttctagaaaaatgcacaggctaaggcatagacaaaacaaagagaaatgctgagaaatttgccactggagacggat

SEQ ID NO: 16903 - DNA, 251 bp, Homo sapiens
aaaaacaaaacaaaacaaaacaacttgagatttgatacaattgaatctgctttactttctgctgaattgcttcgtcaggtagatttctgtaccagggtgctgcagtgagatatatgcaaccataacttgtatagttatatgatgtctcagattcaagtcacacattggtgacaattcatgggattttttttctaactcacttaaaatgtgctccgtattttaggtcgatttggtcagacaacgccaccact

SEQ ID NO: 16904 - DNA, 117 bp, Homo sapiens
acaaaaatagtaggagattgcaatacctcactttcaatcattgttagcaccaccaggcagaagattagtaaggaaacagctgacttgaacaacactatagacctaacagacacgtac

SEQ ID NO: 16905 - DNA, 143 bp, Homo sapiens
cgccggggcgtggcgcatgatccttgcctgccaacgcaccgggcgtaggcccggcatgcatccggtcagggtcaacgccatgcccagcaacaggggaagcgcagtcctcacttcagcttccgcagcttgaacgccaccagcac

SEQ ID NO: 16906 - DNA, 123 bp, Homo sapiens
ccatatactctcctatcctcaatgcctccctccacaactcctccataacccattattctgttctagatctcaaatatgctttctttactattcctttgcacctttcattccagcctctcttca

SEQ ID NO: 16907 - DNA, 238 bp, Homo sapiens
cacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctaacaacccccc

SEQ ID NO: 16908 - DNA, 200 bp, Homo sapiens
agttataaataataccagttttttgtacagacacaataactgcctaagatttggatggaaatgtggggaggggaaacaaaaccaaacccagaaaaaaacaaacacaccacagcccctgaacttcactggtagaatttaaataagacaatcctatgaacaagttaacagttaaagcattattcttaccacaccctcctgcc

SEQ ID NO: 16909 - DNA, 183 bp, Homo sapiens
  misc_feature 13: b=c or g or t
  misc_feature 26: w=a or t
  misc_feature 37: v=a or c or g
  misc_feature 134: w=a or t
  misc_feature 135: w=a or t
ggaaatgaaagtbagagattgggggwagggttacgcvtacaaagacattctttggaaactagtagaggtaagtgttgcaactctattaggttcttgactctgaaatttgtattccttcctaagaattttgtgtwwttattctgttgaagcatatgcttcttaagtattttttttttttaaaca

SEQ ID NO: 16910 - DNA, 213 bp, Homo sapiens
  misc_feature 17: w=a or t
  misc_feature 18: k=g or t
  misc_feature 203: r=a or g
cccagatatgtccattwkaaagtgaattttgtaaaaatactggctgggcacggtagctcatgcctgtaatcccagcactttgggaggccgagtcgggtggatcacctgatgtccgggagttcgagaccagcctggccaacgtggtgaaaccccatctctaccaaaaatacaaaattagctaggcatgggggcacatgcctgtratctcagcta

SEQ ID NO: 16911 - DNA, 88 bp, Homo sapiens
  misc_feature 32: k=g or t
  misc_feature 45: k=g or t
aaaccaatgtcataaagcttttctcctatgtkttcttctggagtkttatggttttaggcctttttttgttttttttctggtttttttt

SEQ ID NO: 16912 - DNA, 296 bp, Homo sapiens
  misc_feature 30: r=a or g
  misc_feature 31: w=a or t
  misc_feature 125: y=c or t
tgtaaataaatgaacatggctgggtctcgrwatgacttcatttatggaaacgggcaaaggttcacatttggtccttgggctgtaatctgccaactcctgttgtgaaagattcctggatttgagtytgcctgatgtgtcctgatgattagattgaggttatgtgtgttggaagaagattcccaaagaggggatgtgcccttctcagagcatcacttaattgcttgcttaaggtggtgttaactgtaaagttaaaagctgctattttttctttgtaattaagaatatttcaggggaac

SEQ ID NO: 16913 - DNA, 66 bp, Homo sapiens
ggagtgtggaattcttctcgggaggcagtgctgggtcctttccaccatggcacctaagaaagcaaa

SEQ ID NO: 16914 - DNA, 140 bp, Homo sapiens
ttttaaactccacacaagagtagcccacagaaacgcatttacatagctgtgttcatttttgtgtacctgttccagtcatccttcatatgcacacaggacatacttgaagattgaccctatacactcagccagaaagcaag

SEQ ID NO: 16915 - DNA, 225 bp, Homo sapiens
tacactcagtgctgtacgatcatcaccgccaggtacttccagatctttttcatcatcccaaactgaaactgattaggggcaattttaagtagtttctgcatctactattgtgtagcttgctttttgggcaacactcttttttttcatcagtgaaagagatcttaacgggtgaagagaagacattgaaacacaagtgctagttacgtttaaatgcaggatggacct

SEQ ID NO: 16916 - DNA, 100 bp, Homo sapiens
  misc_feature 34: w=a or t
ccttaacacattggaagggggaatcacaatagcwcattgtccccagcagaaaataactcctgtccttgaaaacagtagcatagtcctctgtcaagccggt

SEQ ID NO: 16917 - DNA, 209 bp, Homo sapiens
taaaagtgagcaagaggaagaaagaaccagttagaaggaaaatgaaggctcatgcaagatcagccttcaaatctgacaggcacagagagtccattgaaggattaaaggtgaccttctttgatgacacgttcctgttctcctacaccttgtgacttgcttctgcctctgcaggggcagtgtgacagggtgtaggagaacaggaacgtgtc

SEQ ID NO: 16918 - DNA, 107 bp, Homo sapiens
aaaagctttttttttctctaaaagctagtgtcatagtattgacttctagctcatcgggcagatagccccttttactcaatagcatcttcttagttcactaacgcccc

SEQ ID NO: 16919 - DNA, 139 bp, Homo sapiens
ggttttctctaacattgtgaagtttatattgtctgttggaagatatatcaatcttagcaatcactctctttgcctcttgaaataatctcatcattttatgtctactagacttgttttgcagtgacttctcagcccacaa

SEQ ID NO: 16920 - DNA, 146 bp, Homo sapiens
acatagaaattctaccctccagcccagctccaccctcaactagctgtatagcagctggcagtttccctgactgccctgggtctgtttcctcatcaacaaatagacagaagctcaaactaaagtaatattatgtctttcccagccgt

SEQ ID NO: 16921 - DNA, 190 bp, Homo sapiens
tttgtttttgtttgaggccgagtctcactctgtcacctgggctggagtgcagtggcatgatctcggctcactgcaacttccgcctcccgggttcaagtgattctcctgcctcagcctcccgagtagctgggactacgggcgcctgccaccacgcctggctaatttttgtatttttagtagagacgggacc

SEQ ID NO: 16922 - DNA, 227 bp, Homo sapiens
  misc_feature 205: y=c or t
tacttcttggttcctttctaattctatgaatgtatgtctttgaaatctcagtaaaggaaccaaatatttgttattgcagataaacaatacaaactttagttgtatagttaagtgcttttacttgatggtttttttttttaacaaactatttttttaagagcaattttaggttcacagaaaaattaagcagcaagtacggagagtycccatgtatccctgtccccatc

SEQ ID NO: 16923 - DNA, 168 bp, Homo sapiens
  misc_feature 47: m=a or c
gcctgggcgacagagcgactccatctcaaaaaaacaaaaaaaaacamaaaaaaacagctgtgtggattcctccggggcacgctgggcctccggagtctggagtgggggctaggggctgcctggggaggggctggaagggaagcagcagacaatgggctgggctgcacc

SEQ ID NO: 16924 - DNA, 132 bp, Homo sapiens
agactccagcttcattcacgttgctgctaaggacatgatctcattcttctttatggtgtgtgtgattctatgatgtatgtgtaccacattttctttatctagtctaccataaagacacacacacctgcatgt

SEQ ID NO: 16925 - DNA, 155 bp, Homo sapiens
tattttaattagaaaaaagctttttacttgtttagttatctctttttttttgttttcgtttttggtttttttttgagatgcagtctcgctctgttgctaggctagagtgcagtggcatgatctcagctcactgcaacctccgcctcccgggtaaa

SEQ ID NO: 16926 - DNA, 134 bp, Homo sapiens
agcaaacagttccaggacaccacgtgactccagggcattttttgccctctcagaaccctaccattcaccatcaaactgctgctgccgtagtcccccctcctcctccaccaccacctgctccaggaccgcacctt

SEQ ID NO: 16927 - DNA, 136 bp, Homo sapiens
ggagtgggtggggcggagtgggagggacgcctagagatggcaggaggaagacctgggcgctcttaaccacccccaacgcccttgtctgcatgtctttttctctgtctcctccttttctgtttcttctcccagacct

SEQ ID NO: 16928 - DNA, 194 bp, Homo sapiens
  misc_feature 12: s=g or c
aggattggggascacgttttgcgtcttgctgtgcgtgaggaagcggggatccaggtcaaggctatggaaaggtcagggaagggtgtcagtgcgcccgtcctgcagggagtccagatccgagagttccagaagcaaaaacaaaaaagttcgggtaccgcggctcacacctgtaatcccagctcttagggagatct

SEQ ID NO: 16929 - DNA, 155 bp, Homo sapiens
  misc_feature 52: s=g or c
aggcccggaaacggatcgcgttgggtgaaggtgacggcgtcgagcgtgagtsaccctctgtgtagattaaacctgcgctccctgtttcccatttccacagccgatgtccagggtcgatacggcccttaaaatccccgtacactccaccccagcgt

SEQ ID NO: 16930 - DNA, 170 bp, Homo sapiens
cacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcgt

SEQ ID NO: 16931 - DNA, 196 bp, Homo sapiens
tagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccttc

SEQ ID NO: 16932 - DNA, 129 bp, Homo sapiens
tagtcctaaatttaatttcctgggcactgccccagagtctgtgagacaagtgccatttgttctctccccttcatagtcaggctctctcgggaatggttcgtgctgcttgctctgctttctgtgcccgct

SEQ ID NO: 16933 - DNA, 163 bp, Homo sapiens
caaagttctcggtctttgaggccaaacgcggtggctcacgcctgtaatcccagcactttgggaggccgaggtgggcagatcacctgagatcgggagttgagaccggcctggccagcatggtgaaacccagtctctactaaaaatacaaaaattggccggacct

SEQ ID NO: 16934 - DNA, 79 bp, Homo sapiens
cctcgtgatctgcccacctcagcctcccaaagtgctgggattataggtgtgagccactgtgcctggcccacactttttt

SEQ ID NO: 16935 - DNA, 410 bp, Homo sapiens
  misc_feature 31: n=a, g, c or t
gcggaggccgtggccgcgggtagttgaggangaaccgagatttacgcttggtaaggcaagttgcgagctgtccggcgccggtcgagttcctgccgccgtcgtcgtcaggcaggggagaagggggcctcaacccctctagtgacagctgtttgctacctaatagggcttttcatcccaccgggccccagggccttcgttaggagcccagcaggctcaacttcttgctgtggttctggaaaagggagtgaccacctggctcaacacctctctctgtgatgtgtttgggagttttgggaaatgagacggctccgagggaagagcttgagggagcggcgtcgcactcgttcgaccttcccgggcctgggctttgtttctaggcattttaggttaacgctctacatcttaactga

SEQ ID NO: 16936 - DNA, 163 bp, Homo sapiens
  misc_feature 63: y=c or t
  misc_feature 64: s=g or c
ggctaattttttcttttcctttttttttgagatggagtcttgctctgtcacccaggctggagyscagtggcatgatctcggctcactgcaagctccacctcctgggttcacgccattctcctgactcagcctcccaagtaactgggactataggcgcccacca

SEQ ID NO: 16937 - DNA, 155 bp, Homo sapiens
  misc_feature 94: b=c or g or t
tggtgtgatctcggctcactcaacctccgcctcccgagttcaagtgattctcctgcctcagcctccccagtagctgggactacaggcgcacgcbaccatgcccagctaattttttgtatggggtttcaccatgttggccaggctggtctcgacct

SEQ ID NO: 16938 - DNA, 253 bp, Homo sapiens
  misc_feature 47: s=g or c
  misc_feature 48: k=g or t
  misc_feature 50: m=a or c
  misc_feature 104: s=g or c
ttgagcagtgctgctcccaacccgccagtcgcggtctccggcgccaskamgccgctgccgctgtcactatggcccattacaaagccgccgactcgaagcgtgasagttccggaggtacttggagaagtcgggggtgctggacacgctgaccaaggcatcacttaggagctgctactccagaaaatccagaaatagagctgcttcgcctagaactggccgaaatgaaagagaagtatgaagctattgtagaaga

SEQ ID NO: 16939 - DNA, 254 bp, Homo sapiens
caaattttggggagacacaaacatttagaccgtagtaaatagcatttgtcacaaatgcagaagttgcaaacctttcatcaatgttagattgacttcagaatgcaagataatccttatgttctgaaccaattattagtcaaataattgctgagatcattgatacaatgaaatcactattagcttctatggtctctgactcagtcccaaatgtcttctataaaagaagtctctaaaaaatagaatttggaaagcca

SEQ ID NO: 16940 - DNA, 166 bp, Homo sapiens
ccgggttcacgccattcttctgcctcagcctcccaagtagctggggctacaggcgcccgccaccactcctggctaattttttgtatttttagtagagacggggtttcactgtgttagccaggatggtttcgatctcctgacctcgtgatccgcctgcctctgccaa

SEQ ID NO: 16941 - DNA, 232 bp, Homo sapiens
ataataatatactctgaatagaagtataacttttctcattaaaatttctcaccttttgggcccctcattctgggatatttgcctaaaaccagattgattcctatggggtgtttgtgaaatgggttctctagaattttttgaaagccaaggtgtaaatctagtgactaattagctgggtgttgtggcgcacacccggtaatcccagctactcgggaggctgaggcaggagggc

SEQ ID NO: 16942 - DNA, 283 bp, Homo sapiens
  misc_feature 36: k=g or t
  misc_feature 37: k=g or t
  misc_feature 160: k=g or t
agtgtcactttgatacattacacttaaatcaacackkctcaattcacctctcataaatctcaacaaatgtgagtgttaactatttttaaggcaacttattctgaggcttatctagatggtgagatccctgcaggtgaggccccgttttgttctttgtgtktctgcaggtccacagaatacacattacatagaatggaccttcacagaacacacagcctcaggtttcttccatttgaagcatgatgagaaatgatcagcgagtacaggaatcccaccccgcgag

SEQ ID NO: 16943 - DNA, 115 bp, Homo sapiens
atcttgtttgtttgagtgaatcggaaaggaggcgccggctgtggcggcggcgggagctgctcggaagctacacctcgcaagggctcccccctttccccaccccctcccccgaccc

SEQ ID NO: 16944 - DNA, 91 bp, Homo sapiens
aagtgtacagttcagtggcattaagcacactcacattgttgtgcacccatcaccacctcccatctctcaaattttctcatcaccccccgac

SEQ ID NO: 16945 - DNA, 291 bp, Homo sapiens
  misc_feature 50: n=a, g, c or t
  misc_feature 84: r=a or g
aggagagggtgggcagagggtggctgtgtggtcggcggccagcggaggcnttcccagccagccgcccggcggggaacgtgcttracctctgggtggttgctgctcccaagggtggggctccagagagtgtggcgcgatcgccaagctccctggcagcggccctggagagactgaggggacaggaggaggggggcgccccattggtgtgtagccccgcgcagtcgccggctctccttttccggactctggggatctcttgctgcaactgacaaggtattgatgtcaagcaaa

SEQ ID NO: 16946 - DNA, 205 bp, Homo sapiens
gctgattccgcctcctagagagggccacttgctgtcctggactcgcgccgtgatgggcagtctgaggaaacattatccttgagccgggggagcccatcccttttctttctttaaggggtgtggtggtggggagaataaggattcaagtgagaatatcgacttcagaagttaaacacaatggactgggaggtctcatgagatgggt

SEQ ID NO: 16947 - DNA, 206 bp, Homo sapiens
atataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgaca

SEQ ID NO: 16948 - DNA, 263 bp, Homo sapiens
atgactttcctaattcaaaataaatctagacccagcaactgttctctgtcaggggtctcttcgcaccttggcttctggtctttattgactcctgggaccaagaagtccccagacatttagctgagtttctacctagattagaaggttggcctcccagaatggagacagggatccagagctacgtatgataagtcccggaaatgctgagtcttttccaaaatgtacccttgttcccatctaggggtgtgagatgagagacacat

SEQ ID NO: 16949 - DNA, 185 bp, Homo sapiens
tagctttcatcagattttcaaatagttcttgtctctcccttcctctcatagaattcgttttcattgcaataaagacaaagaaacatccttatctttttaacttagaatattaaagcagctattttcctttcagaggaccagtacactgaatctttttagatgcaatcaggaaatcattggggtgc

SEQ ID NO: 16950 - DNA, 387 bp, Homo sapiens
  misc_feature 321: y=c or t
acgtttatagacccaacctgaaagacgtagagaaattgccaagtgtaggcagaatgtgaaagccctttgttttcaaattggatccctttttcgattgtactcttttaagtttcagcaatctgggtgcattataaagacctatttatagacacggaaaactgaatcaaaaagttttaaaagttctatcccattggggataatggatcttagcttaggaaaaatggagtcatttttccctcatgaattgagaataaggattttatttcttttctttcaattctaataaaattctcaacaggtttgtgtgtgtctatgtgtgtygtgtgtatcgggttggtggcagactgaaaaactgacataaaatttttacatgatgacaggaaaacc

SEQ ID NO: 16951 - DNA, 168 bp, Homo sapiens
ctctatgatgttcacactgcaatgaaattgcctgagtgaatttctcaggccatatccccatggttaagccacgcatgactgtacatatatctatagatatgagaggggatttattaggggaattggctcacatgattgtagaggctaagatgtcccacagcaggccct

SEQ ID NO: 16952 - DNA, 128 bp, Homo sapiens
  misc_feature 25: k=g or t
gtttggtgccctggtcgcgtgtctkccgaactctgctgcttcgccccggcaagagcacttccttccgcggctgctaaaactggtgcgcgggttcccaacttcgcagaagagcttcatcggccccccta

SEQ ID NO: 16953 - DNA, 181 bp, Homo sapiens
gacttggcttggcttcccctgaaagcagcggctgtggggagttgattcggaagtgaagggccctgggcgacccggcgagtagaggcaacaccaacactcctccttagcgaggggtctccccgccgcggtggctgcccggccccaaggacaggagggatttgtgcactgactcctgaccgcc

SEQ ID NO: 16954 - DNA, 135 bp, Homo sapiens
ctgcagaaagggtacactcgccagcagttttgccatgagagtacaccgaacaaaggagaccgggtcatttataacctgatgcgtccaccctgctgctatgcccggtttccattggctggaacaggacctcacgaa

SEQ ID NO: 16955 - DNA, 99 bp, Homo sapiens
  misc_feature 22: r=a or g
  misc_feature 51: r=a or g
  misc_feature 53: m=a or c
  misc_feature 97: r=a or g
cagcaggtgactcatggcagaraagaaaagggagaaagaacggtgaggcartmaaccacatgcaatctgagaacactgactttgcaatgaaagggaraa

SEQ ID NO: 16956 - DNA, 156 bp, Homo sapiens
caaatgctttaaactcccagacccaggcctttataaaaagcagttttgacaacactagtgctgagatccagttcttaagaggtcatttggaaagagctggtgatgaaattcacgtgttaaaaagggatttgaaaatggtcacagcccaaaccctgc

SEQ ID NO: 16957 - DNA, 126 bp, Homo sapiens
gtactatattcttactgtattcagtttggaagaggaaaatgtgttttcttgaatgaggaatgtccccaaggtggagttcaggctgttttcctctcagcttgagctctgggatgaaatagggcccct

SEQ ID NO: 16958 - DNA, 228 bp, Homo sapiens
aatatatatatcagctgggtgtggtggctcacacctgtaattccagcactctggtaggctgaggctggcggatcacctgaggccaggagtttgaggccggcctggccaacatggtgaaaccccgtctgtactagaaatgcaaaaattagctgggcgtggtggcatgcacctgtggtcccagctgctcgggaggctgaggcaggggagtcgcttgaacccgggaggcat

SEQ ID NO: 16959 - DNA, 322 bp, Homo sapiens
cctaatcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcagtattcgggtgggagtgacccgattttccaggtgcgtccgtcacccctttctttgactcggaaagggaactccctgaccccttgcgcttcccaggtgaggcaatgcctcgccctgcttcggcttgcgcacacccactggccccc

SEQ ID NO: 16960 - DNA, 348 bp, Homo sapiens
  misc_feature 327: k=g or t
attttaccccttcattatctcagtagtgcatgaccagaatataacacctctcaatccattttcttttgttttttaataagaaaaaaaataataattttaggccgggcgctgtggcttacatctgtgatcccggagctttgggaggccgaggcgggtggatcacttgaggtcaggagttccagaccagcctgggcaacatggtgaaaccctgtctctattgaaagtataaaaattggttgggcacggtggtgtgcatctgtgatcccagctactcagtgggctggggtaggaggatcacttggacccgggaggcatgaggttgcagtkaaccgagaccacaccattgca

SEQ ID NO: 16961 - DNA, 206 bp, Homo sapiens
gaaaattttaatcttgcctaattcttaatgtaatcagtaaaaatataataatattgtatctgacagagagggcaattattcaaattttaaaagacattcacatcatgagtagttgagataaataactatcctgaaaaaccactgaccataatgagttattgttagcaagatttatattgtacttttgaagttcttctagaggcaac

SEQ ID NO: 16962 - DNA, 150 bp, Homo sapiens
  misc_feature 75: v=a or c or g
attcagggcagccttccagggcctggcatgtgtgtgctcagcatcacgggcagctagcaaagaccagtgcaacgvaggaggcttagcttagtacgcgttcggcaggacgggtgtgcaggctgcactgcccttgagtcgtccaggcccccc

SEQ ID NO: 16963 - DNA, 209 bp, Homo sapiens
acataaaatatatactaaacaataattatagttaaaagcttgacatgttttctctcatttaagtttcacaataagctcattatgtcagtgctattactagttctaatttttttcttctaaaacaaaacgggctacatgtgcagaatgtacaggtttgttacatgggtatatgtgtgccacggtggtttgcggcacctattgacccaatg

SEQ ID NO: 16964 - DNA, 101 bp, Homo sapiens
  misc_feature 51: b=c or g or t
agaataatctgcagctaggggaaggccaggctgggtctcagggtgagagtbacagaaggatatgaaataatcggggaagaggcaagttacagcggggcccc

SEQ ID NO: 16965 - DNA, 159 bp, Homo sapiens
  misc_feature 11: n=a, g, c or t
  misc_feature 12: n=a, g, c or t
ctttttgtttnngttttggttttgagacagggtctcactccgacacccaggttggagtgcagtggtgcaatcatggctcactgtagcctggacctcccaggctcaagagattctcccacctcagcctcccgagtagctgggactacaggcacccaccac

SEQ ID NO: 16966 - DNA, 171 bp, Homo sapiens
actaaaaaaatacaaaaattagccaggcatggaggtacgtgcctgtaatcccagctacttgggaggctgaggcagggagaattgcttgaacccaggagatggaggttgcagtgaactgaggtcttgccattgcacttcagcctgggcaacagagtgggactctgtctcaaa

SEQ ID NO: 16967 - DNA, 258 bp, Homo sapiens
  misc_feature 109: n=a, g, c or t
  misc_feature 227: k=g or t
  misc_feature 230: k=g or t
  misc_feature 246: k=g or t
gagggggagaaggaagcagggggtgggtggtggcgagggagaacgattcccgcagtctccctggggccgaacgcgaacagggaagccctccccgcccccacgacgcatnagttgctcaccccaaagggaacagtgattccgggaagggaaggctcctcctgctctagctctgaatccagaggaggtgctgttttttctggatttaaaaagaaagcagaaagagaatkttkggaaggagggtgcttkacgacaccgaga

SEQ ID NO: 16968 - DNA, 194 bp, Homo sapiens
  misc_feature 129: b=c or g or t
tctcatttccccttcgccgaggagagaagggggggaggagagagaagagaccgaagaaagagagaaaaattcctcacagaaatctctttcagggggtgtgggggggaggaagagggaaaaaaaagagcbgggcgccccctgctccctccctcccttctctccctctctttttctcccttcctcacccgcctcta

SEQ ID NO: 16969 - DNA, 162 bp, Homo sapiens
caccattctgactggcatgagatggtatctcattgtggttttgatttgcatttctctaacgatcagtgatgttgagctttttttcatatgtttgttggctgcataaatgtcctcttttgagaagtgtctgtttatgtcctttgcctactttttgatggggtt

SEQ ID NO: 16970 - DNA, 128 bp, Homo sapiens
cttaaagaatgaaaaagatggaaaaattaatgaatttgaagacagaaaatattagacctgataaatcaaaaaggtgactccttaggaatatagattaaaaattaagtgattgtcaagtttcatcaaga

SEQ ID NO: 16971 - DNA, 150 bp, Homo sapiens
aaagactactttttatttgagaccgagtttcgctcttgttgcccaggatggagtacaatggcatgattttggctcactgcagcctccgcctcccgggttcaagcgattctcctgcttcagcctcccaagtagctgggattacagatgccc

SEQ ID NO: 16972 - DNA, 70 bp, Homo sapiens
catcttttgttcactcttagtttgtaacactcatttatactgtgtctttctgtaattcaccaccccccct

SEQ ID NO: 16973 - DNA, 297 bp, Homo sapiens
ctgggctgggctgtgcttgttgcccctgtggccaacacacgcgcacctttcacctgaaagccaggatccgcagaacgttccccgaggaggtcgttgtttggcactatgatttgtctcttcctaaaaaggtgatagagttacactggagagagcagcatccaggtgcagcagggatgggcctggggctcacgggcaggggctctgtgtccggctggggcctggggtcctgcgctgcacctgtgtgtcagaagcactcagtaaatctttgctgatgaaggatgagaggatagaggacta

SEQ ID NO: 16974 - DNA, 130 bp, Homo sapiens
ccataacagaaatgaattgaagaagaggagcggtgggtaagagcttattccgcggagtggggcagtaactgggcaggtttcatagaaatggcacctacttcggggttgctatgaaagttaaatgagataa

SEQ ID NO: 16975 - DNA, 83 bp, Homo sapiens
aatggtatttctgcctctagatctttgaggaataacctcattgtcttccacaatagttgaactagtttacatttccaccaacc

SEQ ID NO: 16976 - DNA, 124 bp, Homo sapiens
agtaaatttcagccaggtgttagactcattctccagactgactaaggctgcaaagggcaatagtaagaatagggactctacaggtatcatcataaagaagtaacaagcatctgtcaacagccca

SEQ ID NO: 16977 - DNA, 185 bp, Homo sapiens
gagggcagggagagctgctgcccggccgagcctctgctcccacggtctcaggcctccccgccctgatgagtctccgctcccaacacaagggccacgtggtctgagatggcccctgcagctgggcaaaaggtccctccagaccacgtggcccttgtgttgggagcggagactcatcagggcgggga

SEQ ID NO: 16978 - DNA, 253 bp, Homo sapiens
tatgtgtgtccttatttgtttattgaaagatgtgaagggcaagtgggattggcacacagaacaagacggtgccgcctgctggccacagcaaagccacctcccccggtcgccgctgtcctgggcaaggcctggtccctgcagaaccggacacggcctgccagagccagtgtgtgtggcaggacaggggacacctgcagaggcttggcctgtggatgctgctccttactgggatggagggagaagacgcggttct

SEQ ID NO: 16979 - DNA, 157 bp, Homo sapiens
atgagaggttctgacttgttttttaagctttatttttttaaaaaacaagtatgtgtacatttgtcactataatggtcaaagttcattcttgtgatagttgaaatcattaaatattctgccttgtgaacacatgcagttaaatgataaaccccataac

SEQ ID NO: 16980 - DNA, 249 bp, Homo sapiens
  misc_feature 142: s=g or c
  misc_feature 143: y=c or t
  misc_feature 182: m=a or c
  misc_feature 247: s=g or c
  misc_feature 249: s=g or c
taggtgcatcaccatgcccggctaattttttgtatttttagtagagatggggtttcactgtgttagccaggatggtctcgatctcctgacctcgtgatccgcccaccttggcctcccaaagtgctgggattacaggcgtgasyacagcgcctggccaatttttttttttttttttaagagamagaggtcttgctttgttgccttggctggtctcaaaacacctgggttcaagtgatcctcccacctsgs

SEQ ID NO: 16981 - DNA, 136 bp, Homo sapiens
  misc_feature 22: y=c or t
  misc_feature 127: w=a or t
ataaatttgagtgtttaatatyatttagctccttagtttggagaacactatgcagataagtgaaagatatattgtgtaagattttgcagtagagttgagatgctgtggagattgaaaaaaaaaagawagacccaaa

SEQ ID NO: 16982 - DNA, 57 bp, Homo sapiens
gttgggtgttctatatttttatatgccaaatctgacgactctgtctgtggattcttt

SEQ ID NO: 16983 - DNA, 227 bp, Homo sapiens
  misc_feature 42: v=a or c or g
  misc_feature 45: k=g or t
actattaaataattttttcctgtttgggggtcttactgtctvttktttacaagtgtattcaggcctttctctgtgatagttgtttcagtctcctcaaaattgatcccccttcttcctactatacttaatgtcttctttctgttgactctttttgggaataaggagcaacaggcttctgtctcccctcatcctcagcctcccgttcaacttgtttattctcccagaat

SEQ ID NO: 16984 - DNA, 67 bp, Homo sapiens
gcacgatctcgggtcactgaaacctctgcctcccgggttcaagcaattctcctgcctcaacctccaa

SEQ ID NO: 16985 - DNA, 142 bp, Homo sapiens
agtctaactctgttgtccaggctggagtgcaatggcgcgatcttggcccactgcaacattcgcttcctgggttcaagtgattcttctgtctcagcctccccagtgactgggattacaggtgcccgctaccacgcccggctaa

SEQ ID NO: 16986 - DNA, 200 bp, Homo sapiens
aggaatccgagacaaggctaggcaatatggtgaaatcccgtctctacaaaaaatccaaaaattagcctggctcggtgttgtgcctgtagtcccagctactcgagaggctgaggtgggagaatcacttgagcccaggaggtggaggttgcaattgccactgcactgcagcctgggtgaaagagtgagaccctgtctcaaaa

SEQ ID NO: 16987 - DNA, 200 bp, Homo sapiens
  misc_feature 187: w=a or t
  misc_feature 188: y=c or t
aggaatccgagacaaggctaggcaatatggtgaaatcccgtctctacaaaaaatccaaaaattagcctggctcggtgttgtgcctgtagtcccagctactcgagaggctgaggtgggagaatcacttgagcccaggaggtggaggttgcaattgccactgcactgcagcctgggtgaaagagtgagwycctgtctcaaaa

SEQ ID NO: 16988 - DNA, 214 bp, Homo sapiens
  misc_feature 176: b=c or g or t
caaaaattacaaaaaatagtcaggcatgatggtgggcacctgtaatctcagctactcaggaagctatggtgggaagatcacttgaacctgggaggcggaggctgcagtgagccaagattgcaccactgaactccagcctgggcgacagagtaagactcttcgcccaggctggagtbcagtggtgcaatcttggttcactgcaacctctgcctcc

SEQ ID NO: 16989 - DNA, 223 bp, Homo sapiens
  misc_feature 2: d=a or g or t
tdatctgtaaaatgaagataatgttagaaactacctcagagaaatgtttcaagagttaattggattaaacacagtgcttggcactcattaagtgctatttcaatgtggtatattttattactttgaattttacaaataaaagtgagaatagtagctaaattcttaggttctaaaaaaactaacctttctaattccatcagcaataatgaacacatggggcact

SEQ ID NO: 16990 - DNA, 134 bp, Homo sapiens
  misc_feature 18: w=a or t
ccattttggagatttgtwaagtttaaacaaacaaaaaaggaaacaaaaaattggggatgtagttgtataattgttaatgtatttttcaattatactttccacttccaagaataattatctcaacagcaggtgca

SEQ ID NO: 16991 - DNA, 209 bp, Homo sapiens
  misc_feature 15: r=a or g
  misc_feature 29: w=a or t
tctcagtgtgtttgrctcatacgtgggcwatactttattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatac

SEQ ID NO: 16992 - DNA, 138 bp, Homo sapiens
accgtagtcctagcctcctataaggcccaggaagagggcagaggggccagaaggactccatggcccaaagaccctcctccctgcaggcactgtgggaacagacacagagatggagaagcagggacatgctgagaggac

SEQ ID NO: 16993 - DNA, 62 bp, Homo sapiens
  misc_feature 35: r=a or g
ctcccgtgctgatcagtagtgggatcgcgcctgtraatagccactgcactccagcctgatac

SEQ ID NO: 16994 - DNA, 220 bp, Homo sapiens
  misc_feature 141: w=a or t
  misc_feature 142: w=a or t
  misc_feature 154: r=a or g
gctgtactacaaagagatagaatcaaactgctttttttcgacatactggtttttctttctgtttttcttctctttcttctatttcttgtggatattatggctaataacacaagaaatagaagaaagagaagaaaaacagawwgaaaaaccagtrtgtataaaaaagcaaaaatgattactgataatatcacaacccagaagtaaccacctttaaaaagca

SEQ ID NO: 16995 - DNA, 184 bp, Homo sapiens
gaaatgaaagcccggaaaccccggaactagaactggtatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgc

SEQ ID NO: 16996 - DNA, 96 bp, Homo sapiens
tactttgtgatttatagaaaaaaaagcatttctaaaacgtgttctagaagtgtctgtgggccgggtgccatggcttatgcttgtaatccccaggca

SEQ ID NO: 16997 - DNA, 202 bp, Homo sapiens
attaaagtgtctcttttaggccgggtgtggtggctcgcgcctgtgatcccaacactttgggaggctgaggcaggtgaatcatgagatcaggagttcgagaccagcctgaacaacatgatgaaacccgtctctactaaaaatacaaaaaaatttagcggggtttggtggcacacacctgtggtcccagctatttgggaggcat

SEQ ID NO: 16998 - DNA, 260 bp, Homo sapiens
caataaaagataaagaataatgacagatgtctctatataaatgatgtaatgatgcttttgtactagtatagttaacctgttggttatcttcaaatttaattctgtatttacagtaaaaaattaaggtgaccttctgggatttgagaggtagcatgaggttagtgggtaaacttcatcttcttaagtataaaatgactttacttaaaagttgatcaaaaacttttggttttggattaagtataattagaataatctatgaa

SEQ ID NO: 16999 - DNA, 145 bp, Homo sapiens
acttggaggactcgggactcccccgcaggtcagcgcccggcgcatctggtgttttcgctgccgaggataggacgacgagcgcaatcgggagctccgccgcccggattcctgcttccctggggcccggaggctgctgcgtacccca

SEQ ID NO: 17000 - DNA, 65 bp, Homo sapiens
gacggggtttcctcgtgttagccaggatggtctcgatctcctgaccttgtaatccgcccaccgca

SEQ ID NO: 17001 - DNA, 223 bp, Homo sapiens
tgcatttgcatttccctaaagactaatgatgctgagcatatttttatgtgtttaattacctaccatctgcgtttcttacttggtgaagagtttttacaaatcttttgtttatttttctaggttgtctctcttattgctgggttatagcatggctttatgcattctaggtaaaaataatttttagatatatgttttccaaatacttctcattggcttggcttcc

SEQ ID NO: 17002 - DNA, 161 bp, Homo sapiens
tatatggtcctgacgctctggggaggcgacggcgggaagttaacctcatgatggtgagcatgaggcatggaaatgccactgctccacttttttttaaggtagtgtgttgaagttaatttcacattcagttctcattttctgcctatttattactctacccc

SEQ ID NO: 17003 - DNA, 110 bp, Homo sapiens
agctttaaaaatgcaagggaacttgcagtgagccgagatcgcaccactgcacttcagcctgggtgacagagcgagactctgtctcaaaaaaaaaaaaaaaaaaaaaattt

SEQ ID NO: 17004 - DNA, 273 bp, Homo sapiens
  misc_feature 113: m=a or c
  misc_feature 114: s=g or c
  misc_feature 134: k=g or t
  misc_feature 137: k=g or t
gacagagccagaaactctgtctcaaagaaaaaaaaaagaaagaaaagaaaaaagaaaagaaaaggaggccagaaacatgttctgcaatgagcatgtactctctaaaaatgagmsgggatttttttgttgttgtkgtkgttgttgagatggagtctctctctgtcacccaggtcagagtgcggtgatgatctcggttcactgcaacctccgcctctggggttcaagcgattctcctgcttcagtctcctgagtagctgggactataggcaccca

SEQ ID NO: 17005 - DNA, 119 bp, Homo sapiens
ttagcctcaaatgtttacctagaatcagcctgtggagcacaggttaagaatcttacccagggtggggagcagtggctatgcctgtaattccagcactttggggggccgatgggggtagg

SEQ ID NO: 17006 - DNA, 97 bp, Homo sapiens
aaggttagcctgcagcagagccgcagcagcaacagccaccaaagcgggggctgaaagggaagagaacttagatttgacctgtgcaaggacctcagcc

SEQ ID NO: 17007 - DNA, 250 bp, Homo sapiens
  misc_feature 191: k=g or t
atcacttgaggtcaggagttcaagaccagcctggccaacatgataaaaccctgtctctactaaaaatacaaaaattagccaggcgtggtggcatatgggagactgagatataagaatcgcttgaacctgggaggcagaagttgcagtgagccgagctcatgccactgcactccagcctgggagacagagtkatactctgtctcaaaaaaaaaaaaattgaaaattatttaaatatttggggctgggcacc

SEQ ID NO: 17008 - DNA, 184 bp, Homo sapiens
agagaggtgcagagctgacttgcgttttgaatcatgtcatttactccttggaacaatgtgtgaattgtcacattttataaggggaaactgaggctccaaagtgaataggcacttgccagatgacacatctagcaggagctgagatctgaaacctacactttgtgactctaggatccatgctcat

SEQ ID NO: 17009 - DNA, 218 bp, Homo sapiens
acctcttagaccaagttcttgacacagaatatgggactcatcacggttaatagtaatgtattgtatatttcaaaattgctaaaagaatagttttttttggtttcattttgttttttgttttgttttgttttgtttgagacagagtcttgctctgtcatccaggctggagtacggtagtgtgatctcggctcactgcaacctccacctcccaggtcccc

SEQ ID NO: 17010 - DNA, 115 bp, Homo sapiens
  misc_feature 8: h=a or c or t
  misc_feature 38: y=c or t
  misc_feature 77: w=a or t
tgtgtgthtgtaaacaactaaaagacccagctaatctygagcaatacacaaatgagccatctttgcgaatgccagtwgcttgctaataactttctaaaattgttctccggcccat

SEQ ID NO: 17011 - DNA, 152 bp, Homo sapiens
aagccaccaatgcttactgtttgcaccctctgaagccacattctgagctgtacttggtccccttttagccatggctggagataaagcaaccagaatgcagagtgccatgtcttgaggctgcacagagtagtgggtccctgaacctggaccaa

SEQ ID NO: 17012 - DNA, 384 bp, Homo sapiens
  misc_feature 308: k=g or t
tgtagcttcttaactctaagagtgggtcatgtctccagacgaggcagcaaagacacctaattgagaggagaaatatgctaggaaggaaagggagagagggcatattaatccttcccctcagagggcttgggcttgatcttccaaaactcatccaagaaatctgagttgttagaaaccatatttagaataaactaccatcagcaaagggaaggaaggtaacttgcattcctaagcagggcttctgaacagctgtataagctacatctgtctgtctgtccagcctcttcccatggatttgtatttgagtkgaattagccaaaagctatccttttccacataagacacaagtgattttcagcttgtaggctcttgagaaacaggagt

SEQ ID NO: 17013 - DNA, 148 bp, Homo sapiens
  misc_feature 13: w=a or t
  misc_feature 17: m=a or c
  misc_feature 73: m=a or c
  misc_feature 136: m=a or c
  misc_feature 147: m=a or c
ttttttttttttwaggmagagtctcactctgtcacccagactggagtacactagtgcaatctcggcttactgmagcctccacctcccagggttcaagcaattctcctgtttcagcctcccgagtaactgggattamaggcgcctgcma

SEQ ID NO: 17014 - DNA, 220 bp, Homo sapiens
aacgagtgaacaaacaattgcagtcatgtctggtggtgatgattctaggaaggatatgaagagtattagcagagattggggaggtcagacaaggccttactgaggaggtgagatttgaacagacctgaagaaagtcaagggagcaagtcacatgaagattcagaggaagtatggaaggaacatcaagtgcaaaggacctgagatgggagaatgaacaggg

SEQ ID NO: 17015 - DNA, 87 bp, Homo sapiens
caaagataaaaagatactacttgaataagaagaaaaataaagagagttgtgtttcaagctttccctcttcccttcttcccaccccaa

SEQ ID NO: 17016 - DNA, 208 bp, Homo sapiens
  misc_feature 79: m=a or c
  misc_feature 80: m=a or c
  misc_feature 165: s=g or c
  misc_feature 166: r=a or g
agcggcgcccggtcccgggtccacagccgcactcactccgccgcgctctccgccaccgccaccactgcggccaccgccmmtgaaacgcctcccgctcctagtggttttttccactttgttgaattgttcctatactcaaaattgcaccaagacaccttgtctccsraatgcaaaatgtgaaatacgcaatggaattgaagcctgcaaa

SEQ ID NO: 17017 - DNA, 212 bp, Homo sapiens
ttaaggatatgaaatagaaatatgactgttaacagctatgaacaatctttgattagatcttagatcatatggaataaaataaaacatacgtaaagaggtttttttttcctttgagacagagtctcgctttgtcgcccaggctggagtgcagtggcactatctcggctcactgcaagctccgcctcctgggtccaagtgattcttacgccaca

SEQ ID NO: 17018 - DNA, 63 bp, Homo sapiens
aatgaaatggaatttttaaatgttgccaatttctatatttatgattttttttttttttttttt

SEQ ID NO: 17019 - DNA, 216 bp, Homo sapiens
  misc_feature 175: w=a or t
  misc_feature 179: y=c or t
  misc_feature 183: w=a or t
  misc_feature 198: y=c or t
  misc_feature 208: k=g or t
ggctgaggcaggagaatcgcttgaacccgggaagcagaggttgcagtaagtggagattgcgccattgaactccagcctgggcgacagggcaagactccgtctcaaaaaaaaaagtctgatgcccctaagtttgggtatacattagaagcaccatggtgtttgtaaatgctttgtwattycttwattgtagagacagtytcactatgtkgcccaggc

SEQ ID NO: 17020 - DNA, 96 bp, Homo sapiens
aggctgaggtatgagaatcgcttgagcctgggaggcagaggctgcagtgagccaagatcacgccactgcattccagcctgggtgacagagggagtg

SEQ ID NO: 17021 - DNA, 128 bp, Homo sapiens
tcaatttcagagcctgttattgttctattcagagattcagatccttcctggtttagtcttgggaggatgtatgtgtcgaggaatttatccatttcttctagattttctagtttatttgtgtagggcgt

SEQ ID NO: 17022 - DNA, 126 bp, Homo sapiens
gtcttgattctcccagcttcccatttgcctggtttcttctctcctcctttgggaaatgttcaccttctcttccctcttgaaactgggccccacaggtcccaaagaagacaccctatggccacccta

SEQ ID NO: 17023 - DNA, 75 bp, Homo sapiens
ccaaaacaaatagatacggtgtttgattacaaaatgatgtccccaacccttgagtagattttttttttttttttt

SEQ ID NO: 17024 - DNA, 187 bp, Homo sapiens
acagtgagggtaactcaaacccattgagggtatgtaatttattagtggtcaaagacttagaaagatgtagaaatcagacacaaactcacattcttgagctctgagcctcaagcactttccaccatactgcacttctctcccaacctttttcttgttgagttggattttttttttttttttttttttt

SEQ ID NO: 17025 - DNA, 113 bp, Homo sapiens
cagacagataaagagatatgttctgcttagcaccctgaacaaagataagtttgaagggacatggtggaagaaagggaaaggccacaagaaggagagagagagagagagagaga

SEQ ID NO: 17026 - DNA, 196 bp, Homo sapiens
tagtctgattgcctttttgaaagtagttttggtgaagttacagaaggaagaaaaagatagttttagaatgaataagaggttaggaagtaaatgtaggttgtgcccacccttggaaggtgtttggcaatgaaggaaaggacttttccctcaagggaagaaaaggtggagagaaaggttcgtttggaatagggaggta

SEQ ID NO: 17027 - DNA, 189 bp, Homo sapiens
tcttggataaaacagactttaaactgacaaagatcaaaagagacaaagaagtccattacataatggtaaagggatcaattcaacaagaagagctaactatcctaaatgtatatgcacccaatacaggagcacccacattcataaagcaagtccttagagacctacaaagagacttacactcccacacaa

SEQ ID NO: 17028 - DNA, 78 bp, Homo sapiens
aaagactatactttcagggatcatttctatagtgtgttactagagaagtttctctgaacgtgtagagcaccgaaaacc

SEQ ID NO: 17029 - DNA, 149 bp, Homo sapiens
ttggttgctttttagctgtggatcggtccgtttcatcaagtctgtcagatgcaagagatgccttagtgaatgctgtagtggactcattgtctgcatatggctcaactgtctcaaatttacagcactctgcattgatggcgcccagctcc

SEQ ID NO: 17030 - DNA, 413 bp, Homo sapiens
  misc_feature 399: w=a or t
ccattcttttacattttgtctattgctgcttttatgctacgatgacagatttgagtagttgtgattgagaccatgtggcctacaaaccctaaaatatttatttagtactatcgggtcctatacagaaagtttgcttacccctggtttacaatagtgtaatataactgaattccctacttgtaggcttcaatctggcctttcctacattgatgttttattttatttttatttatttatgagacagagtctcactctgtcacccaggctggagtgcagtggcgtggtctcagctcactacaacctctgcctcctgggttcaagcgattctcctgcctcagcctcctgagtagctgagactgcaggcacccgccaccatgctggctaattttttgtattttwgtagagacgagatt

SEQ ID NO: 17031 - DNA, 218 bp, Homo sapiens
  misc_feature 119: n=a, g, c or t
tcacagccaaaagcctgggactctttgtgaaggtcctcctcacctctatctttctttctctctctctcaaactttccttaaagttctcattgcctttgcactgcttctgtgaacagtcnttgtctcctccccacctttggtgggaagtgcggggcagtcctggtcaagacactcatgccctggcaatgtggctgccagagaatgttgttgctaaccca

SEQ ID NO: 17032 - DNA, 154 bp, Homo sapiens
agttttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggct

SEQ ID NO: 17033 - DNA, 143 bp, Homo sapiens
  misc_feature 2: s=g or c
  misc_feature 3: k=g or t
cskcatacattatctcatttaatccttatttataatccttacttataatcctactttgaagcagaaattactgtccccattttacagataaagcatttctggctcagagagatgaatttgtctaacattgtacagcagacact

SEQ ID NO: 17034 - DNA, 151 bp, Homo sapiens
aagaccggggacctggacgcagcggagagaggtgccgccgcccgccccgtccagtcgccgcgcgcaggcactgcagtcagcggtgaactgacttcatcccaatccctcagcccccaccaggaccagtctggagtccctcccctgccccaca

SEQ ID NO: 17035 - DNA, 136 bp, Homo sapiens
  misc_feature 124: d=a or g or t
  misc_feature 125: k=g or t
aagcggattatgtggagtgaaagttacaccgtggcggattgacttctaaggactcttggtacatgaggaagaaacccggaaggggaagaggaaagcaaaggcgtcaggaatggttcttcctcadkgtctattgaca

SEQ ID NO: 17036 - DNA, 278 bp, Homo sapiens
  misc_feature 34: y=c or t
  misc_feature 98: y=c or t
  misc_feature 262: r=a or g
tacatatgactagaggtctctgcatttttttttyccattttttgagatggagttttgctctcgttgcccgggctggagtgcaatggcgcgaacccgaytcactgcagcttccgcctcccaggttcaagtgattctcctgcctcggcctcctaagtagttgggattacaggcatgtgctaccatgcctggctgatttttgtatttttagtggagatggggtttctccatgttggtcaggccggtcttgaactcccgacctcaratgatccgcaccaccc

SEQ ID NO: 17037 - DNA, 83 bp, Homo sapiens
cggaggttgcagtgagccgagatcacgccattgcactccagcctggtgacagagcaagactctgtctcaaaaaaaaaaaaaaa

SEQ ID NO: 17038 - DNA, 240 bp, Homo sapiens
cgatctcagctcactgcaggctcgcctcccaggttcatgccattctcctgcctcagcctccctagtagctggagctacaggcgcccaccaccatgcccggccattttttttgtatttttagtagagatggggtttcacggtgttagccaggatggtctcgatctcctgatctcatgatctgcccgcctcagcctcccaaagtgctgggattacaggcgtgaaccaccatgcccggccgcc

SEQ ID NO: 17039 - DNA, 266 bp, Homo sapiens
agagggaggggcacagggggctgaggagtgctgggtcgggcttccagctccctacaacgcagaccagtactggagttcgtggtgctggaagaccgccgcccgactctgggccccgggtaggaaacgtaagtgccaggaagttagcagagtggttctttggctggcgcctgaacctcgccagtcttcgtcgcccctcccctgccaacgcctaccccgcttcgaccggagggtgcgctgtccctctggtcactgtgatcaccgtccaa

SEQ ID NO: 17040 - DNA, 205 bp, Homo sapiens
aagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggtgtgcacccgtc

SEQ ID NO: 17041 - DNA, 164 bp, Homo sapiens
  misc_feature 17: r=a or g
  misc_feature 67: y=c or t
  misc_feature 68: k=g or t
  misc_feature 118: k=g or t
  misc_feature 126: s=g or c
agtcggtccctagcgcrgctgcggggcggagagctgcggctggcccagcgcgcccacctgaggaggykgcggggtccgcaggcgtcgcgggacgaggagatcggagccgggatactckgcgcagcscaatggcccccattggcctcaaagctgttgtcggagtt

SEQ ID NO: 17042 - DNA, 181 bp, Homo sapiens
caagtagtgcctccagagaaccttataagaatcaacctgaaaaaacctgtgtccggaaaagggatcctgaaagagggccaaatctcctacgccagatggttctgaggtagtaaatattattgcagatataaaacagaaagccattctttttgaggctttagaactgtttattcaccccgac

SEQ ID NO: 17043 - DNA, 176 bp, Homo sapiens
tttttaattgagaaaatactttctttcatgcgcgtccatgtgaagagaccaccaaacaggctttgtgtgagcaataaagcttttaatcacctgggtgcaggcgagctgagtccgaaaagagagtcagccaagggagataggggtgggtggggccgttttataagatttgggtagga

SEQ ID NO: 17044 - DNA, 149 bp, Homo sapiens
agatagatctgcagatgcttcgtcccagtcagggaggccgtctcggcatttccaggttcttaacgctcttgatttttaccctctaggactcattgcgtacacgccctcaccgccgcccagtttcggttcctaacaaaagcacgttcccc

SEQ ID NO: 17045 - DNA, 254 bp, Homo sapiens
tggattcacagagaatatttaagggatgttcatactaacaagagttattgtcagctgacaggaaggaggacttcagggtgggtgaggccaggcctcaggaaattccagaaagtcttaaaagtatcttgtctattctctttccttgacattagaatgattaaggctccctcaagtgtctgagtaaaaagagctaaaatgtgataaaagtctgttacagaagagtattttggtatcagaattcgtgtgtgtgtgta

SEQ ID NO: 17046 - DNA, 73 bp, Homo sapiens
ttgaaatggccttgaggtaattttgtgagtgttaccatgaatagtcaaaagagtctaaatatacctgctagag

SEQ ID NO: 17047 - DNA, 135 bp, Homo sapiens
  misc_feature 36: n=a, g, c or t
cccaaagtgctgggattacaggctgagccaccgtgnccggcccctgtctctatttctgttgatacccttaaacctaacgccggggatggggttatcaactaacgtgaagagtaaggggccgggcacggtggctca

SEQ ID NO: 17048 - DNA, 122 bp, Homo sapiens
tgcatttgtagccataaggttcctcacattcaagacttatctttcttcttggactttttatcccgtattccatcagctggcttttgactcctaaattttcaacttcattctctccaccggct

SEQ ID NO: 17049 - DNA, 113 bp, Homo sapiens
  misc_feature 13: r=a or g
  misc_feature 72: d=a or g or t
  misc_feature 107: s=g or c
  misc_feature 108: k=g or t
ccaggcatggtgrcatgcgcctgtagtctcagctcctcaggggactgaggtgagatgaccgcttgaacccadgaggcggaggctgcagtgagctgagatcacaccaskgcact

SEQ ID NO: 17050 - DNA, 169 bp, Homo sapiens
ttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcccc

SEQ ID NO: 17051 - DNA, 150 bp, Homo sapiens
ataattaaaatgaaaatgctttgaaatgatttgaatcagccagcgcggtggctcatgcctgtaatcccagcactttgggaggccaaggtgggcggtcacctgaggtcaggagtttgagaccagcctgggcaacatggtgaaaccccctca

SEQ ID NO: 17052 - DNA, 86 bp, Homo sapiens
ttccagaatagcctcacctctttctatttcccccaagtcctgtgaaaagcaatactcagtgattttgagcataatttttttttttt

SEQ ID NO: 17053 - DNA, 413 bp, Homo sapiens
  misc_feature 401: w=a or t
acaaaaacgtgttcttagttgacaatggaatggtaaacatgactctcagaactgttgtactgagttcataacttatttaggtgacagtaggtcaatatagatggtgccagcttgacacccttgtgtcatagggtccctttgcccagcactctgtttttaaattcagaataattgggaagtggtgggtgcaaaccagcactgccttctctgcagacctaccaaggtgttatgcaagcttattggcgggcgcctgtagtcccagccactaggtagactgaggcaggagaattgcttgaacccagggggtggaggttgcagtgagccaaggttgggctgcttcactccagcctgggtgacagagtgagactttgcctcaaaaacaaaaacaaaaaacacaaatwatagatgcatgt

SEQ ID NO: 17054 - DNA, 90 bp, Homo sapiens
caaaaacaaaaccaaaccaaacccaaaaattagccaggcatgctggtatacacctgtagtcccagctacttggaaggctgaggtaggagg

SEQ ID NO: 17055 - DNA, 218 bp, Homo sapiens
caacaaaatcatggagcttatcatttgaaaggcatttttgacttttcataggtgtgtagcaagcaaagtggtccttttgaaaaatgcaagtcacatcatgtcacttttctgcttggcctttgcctacttctcgaatggttctcctagcacattctaactggtcattattcattgtgtttcagccattctggccttcaacctatttctcaaacacccgc

SEQ ID NO: 17056 - DNA, 161 bp, Homo sapiens
  misc_feature 97: k=g or t
aattccttgattccttgatccttggtcccgccatgggagcctgagcgccccctattcccccctggcccccagcccccggggccttgagggggaagakgcagcggtctgggacggagcagggggcgaccagactcaagaacccccccctcaacatccccccc

SEQ ID NO: 17057 - DNA, 218 bp, Homo sapiens
aatgagattcctcaggcttcccttgtgaggctgcctgggttctgccgctggatggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtaccccaa

SEQ ID NO: 17058 - DNA, 118 bp, Homo sapiens
gtgaacaaaggtctctggttttcctaggcagaggaccctgtggccttccacagtgtttgtgtccctgggtacttgagattagggagtggtgatgactcttaacgagcatgctgccttc

SEQ ID NO: 17059 - DNA, 325 bp, Homo sapiens
  misc_feature 158: s=g or c
  misc_feature 271: b=c or g or t
aaagtatactgcaattagaaaaccaatatcctttacaatatgtgaaagtcttacttaattatatcttccaagaactttattttgatgtcaagctctactttatagcattaaatgctattggaatactatcttatttttaattttttttttagcgtaasatttttttatttttttatttaacttttaagtttgggggtacatatgcatatttgtaatacaggtagacttgtgtcataggggtttgtggtacagattatttcatcagccagtbattaagggtagtacccattagtaatgttttctgatcctctccctcctccaccct

SEQ ID NO: 17060 - DNA, 191 bp, Homo sapiens
  misc_feature 6: w=a or t
  misc_feature 11: y=c or t
  misc_feature 26: h=a or c or t
ggtctwctatytgagaagtgtctgthcatgtgctttgcccactttttaatgggattgtttgttttttgctcattgacttatttaagttccttatagattctggataataggcctttgccagatgcctagttagtgagtattttctcccattctgtagggtgtctgtttacttctttgatagtttctcttgc

SEQ ID NO: 17061 - DNA, 215 bp, Homo sapiens
ttttgttttttgtaaaagctatccttggtgtgaagtggtatcagttgtgatcaggtcccatttcttgaccctggtgagattttatgaggtcttttggacagttctctcagattttaatcaaagtttaaattgttgacagttgagcatagtggtttaatagcttcactatccatagagtccaaaatgatatgaagtttatatttaatcaatgaatt

SEQ ID NO: 17062 - DNA, 281 bp, Homo sapiens
  misc_feature 4: v=a or c or g
  misc_feature 8: k=g or t
ctcvtatkatattcaaagtaaaatgtatattagagaagtaggtataagaaaatcttcatttagggccaggcacagtggctcatgcctgtaatcccagcactttgggaggcagaggtgggtggatcacctgaggtcaggagttccagactggtctggccagcatggtgaaaccccgcctccactaaaaacacaaaaattatctgggtgtggtggctcacacctgtaatcccggcactttgggaggctgaggcaggaggactgcttgaggccaggagtttgac

SEQ ID NO: 17063 - DNA, 158 bp, Homo sapiens
agcgccgcgtcccctctctccccgcgctgaggctgcggaccgggcccggcgggattagcagcggttcaagctctacgttcgtgacatcaaacctcctgttgggccatttccgagaactcccatcagtttctgtatagtgtaaaagtttcaggggcggt

SEQ ID NO: 17064 - DNA, 79 bp, Homo sapiens
tgggatgttggactaacacacaggcactcctagtcaccaagtagtttgctgttcacagtgggttttttttttttttttt

SEQ ID NO: 17065 - DNA, 293 bp, Homo sapiens
  misc_feature 283: b=c or g or t
ccagtttattttgtgtataacatccaaatctgaaatgatctcatttgtttatttgttacttgtttattgtccatctcttttcctgtgaaaatacagccttcatgaggacagggaccttgtcggtcttgttcatctctgtatccacagcatctagcactgtgccctggtgcaaagtaggtcatcagtaaaattctgttcaataaattttgtttggtacgtatgtggtcaatgaatgaataaaagaatgagtgggtggactttctagggttgggaagtggcagabctggggtcat

SEQ ID NO: 17066 - DNA, 191 bp, Homo sapiens
taaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagc

SEQ ID NO: 17067 - DNA, 308 bp, Homo sapiens
  misc_feature 199: d=a or g or t
  misc_feature 200: r=a or g
gatttgtggtctcagatgcacccatggatctgtgtgttcaaagcatggttctggcaactgaggagcattttgtaatatgcaggtgcggtggctcacccctgtaatcccagcgccttgggaggctaaggcgagaggactgctggagcccaggagttcgagaccatcctgggcaacatagccagaccctgtccctacaaadraataaaaaaattatcccggcgtggtggcgggcacctgtagtcccagctactcgggaggctgaggcaggagaattgcttgaacctgggaagcggaggttgcagcgagca

SEQ ID NO: 17068 - DNA, 321 bp, Homo sapiens
gagatcagagatggtaatatcgcttcctttcttcatagagctatgagaattaattttaagaaataaatctacatatgtctttgaacgtcttggtgccacgtactattaaaaagcccaagatcctgcttagattttaaatcattttttatctgtaatgtctataaaggatgaattattcatttaaaaaataatacaaacttaattttcagtgtgatatttagggaacttgaatattcccaaacgacagactattcaggacccaactgattggttactttccctgataaatagtaaagatatgctaagcttgtaaacttacta

SEQ ID NO: 17069 - DNA, 69 bp, Homo sapiens
gatcctcccaccttggtctcccagagtgctgggattactgacatgagccacagaataatctttgtgtgt

SEQ ID NO: 17070 - DNA, 110 bp, Homo sapiens
tggtacggagtttctttcttcttgcccaggctggagtacagtggcgtgatcttggctcactgcaacttccacctcccaggctcaagcgattcttctgcctcagcctccca

SEQ ID NO: 17071 - DNA, 142 bp, Homo sapiens
acacatcacagcaagaaggaggtgatgccacaccggtggctgccagctcctcatcaggaccctccctggactctaccctgtgtctcttcctttggctggttctaattaatgcttggacaatgaaaactcttctccccaacac

SEQ ID NO: 17072 - DNA, 116 bp, Homo sapiens
  misc_feature 25: y=c or t
  misc_feature 92: w=a or t
ataatttttttcatagtttcttttycagattttatcaaggttagcttcataaaattagctagaaatgtccccttttcttattctctggatawatttgtataagtttggaattattt

SEQ ID NO: 17073 - DNA, 104 bp, Homo sapiens
ttagtagagacaaggtgttacccaggatggtctcgatctcctgaccttgtgatccgcctgccttggcctcccaaagtgctaggattacaggcgtgagcacgcgc

SEQ ID NO: 17074 - DNA, 107 bp, Homo sapiens
tagtcccagaggataagcaatacctatttctgactgagtctcccagcccagacccagggacccttggccccaagctcagctctaagaaccgccccaacccctgccac

SEQ ID NO: 17075 - DNA, 218 bp, Homo sapiens
tatctatctatttgcaataggattaaagatagtagagcaggtggtaatagctgtagagtgtcaggcttcatagttgtgcagtccagaattggatgctctgaggataagcctaggagtgctgcatattatgtgaaaattgcctcaaagttttagcattatatgcatttatctaaatggtattcagatcacgatcagaaataggaatcctgactccccct

SEQ ID NO: 17076 - DNA, 179 bp, Homo sapiens
taatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccc

SEQ ID NO: 17077 - DNA, 181 bp, Homo sapiens
  misc_feature 48: n=a, g, c or t
caatcttggctcaccccaacctctgcctcccaggttcaagcgattctnctgcctcagccacccaagtagctggatcacaggcatgcaccattatgccgtctaattttgtatttttagtagagatgaagtttctccatgttggtcaggctggtctcgaactcccgacctcaggtgatccgcc

SEQ ID NO: 17078 - DNA, 101 bp, Homo sapiens
tgcgccaccatgcccggctaattttgtgtttttggtagagacgggggtttctccatgttggtcaggctggtcttgaactcccgaactcaggccctacccac

SEQ ID NO: 17079 - DNA, 75 bp, Homo sapiens
  misc_feature 54: s=g or c
  misc_feature 55: s=g or c
atggagacataaaagcttagcttaaatgttcattttgttttattgtgtggtatsstacatgctatgattttactt

SEQ ID NO: 17080 - DNA, 198 bp, Homo sapiens
  misc_feature 107: s=g or c
  misc_feature 110: d=a or g or t
  misc_feature 116: m=a or c
  misc_feature 118: v=a or c or g
  misc_feature 121: y=c or t
  misc_feature 134: y=c or t
  misc_feature 154: k=g or t
  misc_feature 160: y=c or t
tgagcctgggaagcggaggctgcagtgggtcaagatcatgccactgcactccagcctgggtgacagggcaagatcctatctgattaaaaaaaaaaataggctgggascadtggctmavgcytgtaatctcagcyctttaggaggctgaggagaktggatytcctgacctcgtgatccactctcctcagcctcctaaag

SEQ ID NO: 17081 - DNA, 150 bp, Homo sapiens
  misc_feature 113: m=a or c
  misc_feature 115: n=a, g, c or t
actttggaaggagaataagtctatgaaatgcattaaactcagcagggaaagtcctaaggagtagtttctccaggggccacagaagaccctttgggtctctatgagaggccccmanggcaacacagggcagagaggtctttccggtgaggg

SEQ ID NO: 17082 - DNA, 93 bp, Homo sapiens
  misc_feature 17: s=g or c
  misc_feature 18: s=g or c
  misc_feature 34: s=g or c
actgcaagctccgcctsscgggttcacgccattstcctgcctcagcctcccaagtagctgggactacaggtgcccacgaccatgcccggcctg

SEQ ID NO: 17083 - DNA, 167 bp, Homo sapiens
  misc_feature 128: k=g or t
tatatctgtaagattcatccatgtcgctggatgtagttatagtttgtacattctcattgctatttcccatttcatttcatgaatatcccactctttattcattcccctgttaacagtcattttggttkgttcaccgtttggggcttctatgaatagtgctagtctgt

SEQ ID NO: 17084 - DNA, 142 bp, Homo sapiens
atatggacgtcctttgaacctttggttgtgttggtcagctgtggccagaaagtgaaccataaacagtaaatcacaagaggcctgtaaggaaaggcccagataggtcatcttcacgtctggctacagctgaccaacacaacca

SEQ ID NO: 17085 - DNA, 167 bp, Homo sapiens
cctgggtggcaagagcaatactctgtctcaaaaacagataaaaaagctgagtgagaaggggtgaggatctgggcaggtctgcgttctgtgttggctggaagcctgctggcggtgctttgactaaacaattcttgatacttctaagatggacttgaggccgggcgcgc

SEQ ID NO: 17086 - DNA, 76 bp, Homo sapiens
ggctgcaatgagccgagatcgcaccactgcactccagtctggcaacagggttaactccatctcaaaaaaaaaaaaa

SEQ ID NO: 17087 - DNA, 59 bp, Homo sapiens
  misc_feature 28: s=g or c
  misc_feature 29: s=g or c
taattcctaacattttaatcactaaatssttcaagttcttcaagtttgcctttgggacc

SEQ ID NO: 17088 - DNA, 250 bp, Homo sapiens
  misc_feature 60: s=g or c
  misc_feature 61: s=g or c
agtgcagtggtgcaatcttggctcattgcaacctccacctcccaggttcaagcgattctsstgcctcagcctcccgagtagctgggattacaggcatgtgccaacacgcctggctaatttttgtatttttagtagagacggggtttcaccatgttggtcaggctggtcttgaacttctgacctcgtgacctgcctgcctcagcctcccaaagtgctgggattacaggtgtgagccaccatgcctggcttg

SEQ ID NO: 17089 - DNA, 225 bp, Homo sapiens
gtctctctctattgcccaggctggagtatgctggcatgatttcggctcactgcaacctccacctctcagcttcaagtgattctcccacctcagcctccagagtagctgggactacaggcatgtgccagcatgcctagctaatttttgtatttttagcagagacaaggttttgccatgttggccaggctggtctcgaacttctgacctcaggtgatccacgcccct

SEQ ID NO: 17090 - DNA, 259 bp, Homo sapiens
tgaggattaaatgtaaagcacccaaaacaggtcatagtgtatggtaaatgctcaaaaaatgttagctcgtacttattgccactttacaaatgtctagacatttctctttacttttaggtgataagggtttacaaactttaaatgccatattccatcaatttgaagatgcacatttattagcactgatggtatgttaaatacattgattctaaagatagaaaaatttattgttcaaaaaaccatttatgtcaaagcctaa

SEQ ID NO: 17091 - DNA, 304 bp, Homo sapiens
  misc_feature 288: b=c or g or t
tgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtbtgttgttctgtttgcc

SEQ ID NO: 17092 - DNA, 62 bp, Homo sapiens
  misc_feature 37: v=a or c or g
tctccagcctgggcgacagagcgagactccatctcavaaaagaaaattaaaaaaaaaaaaaa

SEQ ID NO: 17093 - DNA, 218 bp, Homo sapiens
gttttatttatttttttgtttctgtttttttgttttgttttttttttaatttaattttattattattatactttaagttttagggtacatgtgcacaatgtgcaggtttgttacatatgtatacatgtgccatgttgttgtgctgcacccattaactcgtcatttagcattaggtatatctcctaatgctatccctcccccatcccccgaccccactt

SEQ ID NO: 17094 - DNA, 77 bp, Homo sapiens
ggctgcaatgagccgagatcgcaccactgcactccagtctggcaacagggttaactccatctcaaaaaaaaaaaaaa

SEQ ID NO: 17095 - DNA, 233 bp, Homo sapiens
tctcggctcactgcaacctctgtctcccagattcaagcaattctcttgcctcagcctcccaagtagctaggattacaagtgcctgccgccatgcccaactaatttttgtatttttagtagagacagggtttcaccatgttggccaggctggtcttgaactcctgatctcaggtgatccgcccgcctcggcatcccaaaatgctgggattacaggcatgagccaccgcgtccga

SEQ ID NO: 17096 - DNA, 195 bp, Homo sapiens
  misc_feature 13: w=a or t
agctttttaaatwactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttt

SEQ ID NO: 17097 - DNA, 208 bp, Homo sapiens
  misc_feature 6: r=a or g
  misc_feature 46: w=a or t
  misc_feature 101: k=g or t
ggagtrccttgaggccaactttgaaaaaggatatatcttttttttwcttttttttattattatactttaagttttagggtacatgtgcacattgtgcaggktagttacatatgtatacatgtgccatgctggtgtgctgcacccattaactggtcatttagcattaggtatatgtccccatgctagccctccctccatccccccacta

SEQ ID NO: 17098 - DNA, 423 bp, Homo sapiens
  misc_feature 13: w=a or t
  misc_feature 14: w=a or t
  misc_feature 221: b=c or g or t
  misc_feature 403: w=a or t
  misc_feature 419: y=c or t
ctgataatgtctwwtgctgatgcagaagctgcttagtttaattaggtcccatctatttatttatttttgttttgttgcatttgattttgggttcttggtcatgaactctttgcctaagtcaatgtctacaagagtttttcccatgttcttctagaatttttatggtttcaggtcttagatttaagtatttgatccatcttgcattgatttttgtgtaagtbaagaggcaaggatccagcttcattctacatgtggcttgccaattatcctagcaccatttgttgaatagcatgtcctttacccactttatgcttttgtttgctttgtcaaagattagttggctttaagtatttggttttatttctgggttctctattttgtccctctggtctatttgcctttwtatgtctatgtcccaycggc

SEQ ID NO: 17099 - DNA, 166 bp, Homo sapiens
  misc_feature 38: w=a or t
tatatctgtaagattcatccatgtcgctggatgtagtwatagtttgtacattctcattgctatttcccatttcatttcatgaatatcccactctttattcattcccctgttaacagtcatttggtttgttcaccgtttggggcttctatgaatagtgctagtctgt

SEQ ID NO: 17100 - DNA, 192 bp, Homo sapiens
  misc_feature 70: r=a or g
gttgtatcagatggagatgaggaacttcttgggaactggagctaaaggtcactcttgctatgctttagcraagaaactgttggcattttgcccctgccctagagatatgtagaattttcaacttgagagagatgatttagggtatccggtggaagaaatttctttctttctttttttttttttttttttttt

SEQ ID NO: 17101 - DNA, 80 bp, Homo sapiens
  misc_feature 23: h=a or c or t
  misc_feature 25: m=a or c
aaagcgtcgtctgtggcggcaghamgacatctggcgaccctcgtcccgccaggttttggggtcgcgcaaacgagcgagca

SEQ ID NO: 17102 - DNA, 64 bp, Homo sapiens
caccaagatcgcaccactgtactccaggatgggcaccagagtgagaccttgtctcaaaaaaaaa

SEQ ID NO: 17103 - DNA, 159 bp, Homo sapiens
  misc_feature 126: v=a or c or g
actggtggcgcgcgcggggacttaaagtagatcatggaggacacccaggctattgactgggatgttgaagaagaggaggagacagagcaatccagtgaatccttgaggtgtaacgtggagccagtvgggcggctacatatctttagtggtgcccatgga

SEQ ID NO: 17104 - DNA, 370 bp, Homo sapiens
  misc_feature 9: w=a or t
gctgtaggwtttttgtagatattctttatgaagttgagggttttcttatattcctagctggctgagaggtttgtttttaatcacaaatagatgttggctttttttgtcaaacggcttttctgcatgtattgatatgatcatgaccttactcctttagtgtgataatgtaatggactgtatgaactgatttgttgaaccagccttgcatacctgaaataaatgccacctgactgtggtgtatagttttttgttatatattgttatattagattttctaatattctgttgagaatttttacagctatgttcatgagagatactaatctgtagttgtcctttcttgtaacatctttacctaattttgttatca

SEQ ID NO: 17105 - DNA, 189 bp, Homo sapiens
  misc_feature 6: w=a or t
tgcgawcttgactcactgcaagctccacttcccaggttcacaccattctcctgtctcagcctcccgagtagctgggaccacaggcacctgccaccatgcccggctaattttttgtatttttagtagatatggggtttcactgtgttagccaggatggtctcgatctctagacctcgtgatccgcccacc

SEQ ID NO: 17106 - DNA, 208 bp, Homo sapiens
  misc_feature 32: m=a or c
  misc_feature 33: w=a or t
  misc_feature 97: r=a or g
  misc_feature 98: r=a or g
tcatatcttagttgcttcctcctcctcttcamwggtgaccattatcctgatttccatcaccataaattagtgttgcctgcttttgaactttatatgrrtggaattacatactaatgtacccccccctcctttttttttagatggtgtcattgcactgcagcctggacaacaagagtgaaacgccatctaaaaaaaaaggagggggggt

SEQ ID NO: 17107 - DNA, 341 bp, Homo sapiens
tggcttcccagagtgctgggattataggaagtgggggccaccgtgccctgcctcaaaatggtctttttatctttgatttttagaagttggcaagatgtatccaggactgtttctttcccctgtttatcctgcttggggtttgttgaactttttgtgtctgtaagttaacattttccaccaaattctggaagtttttggccattgtatggacctggccaatgcacgcccttccctctccactcctgtgacggccattgtccacacgcagggtcactggctcttggccctcaggtctctgaggcttggctcatttttcttcaacctctgcattttgctttttt

SEQ ID NO: 17108 - DNA, 163 bp, Homo sapiens
taattttattattattatactttaagttttagggtacatgtgcacaacgtgcaggttagttacatatgtatacatgtgccatgctggtgtgctgcacccattaactcgtcatttagcattaggtatatctcctaatgctatgcctcccccctccccccacccc

SEQ ID NO: 17109 - DNA, 257 bp, Homo sapiens
tagaatggaatggaacgaaatggaatggaatggaatggaatggaatggaatggaatggaatggaatggaatcgttccgagtggaataggagggaatgtattcgagtggaatggaaaggaatggaatcaacaagagtggaatggaagggaatggaatggaatggaatcgttccgagtggaataggagggaatgtattcgaatggaatggaatggaatcgttccgagtggaataggagggaatgtattcgagtggccat

SEQ ID NO: 17110 - DNA, 127 bp, Homo sapiens
taagaaacatgccttttgggaggctgaggcaggagaatggtgtgtgcacccgggagccagagcttgcagtgagctcagattgtgccactgcactccagcctgactccatctcaaaaaaaaaaaaaaa

SEQ ID NO: 17111 - DNA, 208 bp, Homo sapiens
ttctcctgcctcagcctcttgagtagctgggactacaggcacgtgccaccatgtccagctaatttttgtatttttagtagagactgggtttcaccatgttggccaggttggtctccatctcttgacctcgtgatccacccacctcggcctcccaaagtgctgggattacaggtgtgagccaccacgcccagccctgtttttttttttt

SEQ ID NO: 17112 - DNA, 126 bp, Homo sapiens
  misc_feature 104: d=a or g or t
cattatgatgagtatgtgcagtgatactattcatgtacagtctgagcttatgctcaggggtgtgtgtgtatatgtgtatgcatgtgtgcacgtgagtgtgtgtdtctttttccagttcctgccacc

SEQ ID NO: 17113 - DNA, 108 bp, Homo sapiens
gggaggctgagacaggaaaatcgcttgaacccgggaggcagaggttgcagtgagcagagatcacgccactggagagggcgagactccgtctcaaaaaaaaaaaaaaaa

SEQ ID NO: 17114 - DNA, 102 bp, Homo sapiens
ctcttaagagcttcagtgtttttatctttgccttttgagaagtgcctttacaaaatgtggtttaaaattgagcctacaaacaaaaacacagaaccgattgca

SEQ ID NO: 17115 - DNA, 55 bp, Homo sapiens
tcccaaattaaatgtaactgaaaaaaacagggctaacagattctttttttttttt

SEQ ID NO: 17116 - DNA, 140 bp, Homo sapiens
caggaggctgaggcaggagaatctcttggacccaggaggcagaggttgcagcgaaccgagatcgcaccactgcactctagcctgggtgacagtgcgagactccgtctcagaaacaaacaaacaaacaaaaaacagcccaa

SEQ ID NO: 17117 - DNA, 159 bp, Homo sapiens
  misc_feature 140: h=a or c or t
ccatcacacccggctaattttttgtatttttagtagagacggggtttcactgtgttagccaggatggtctcgatctcctgtcctcgtgatccgcccggcctgccttggcctcccaaagggctgggattacaggcgtgachaccgcgcccggccccatca

SEQ ID NO: 17118 - DNA, 174 bp, Homo sapiens
cactctctgtgcaattgctaaaatctactcaggtgcattccaaccagcagctgctctctaccagtctcttcaagtgtcgctatgagcaaatataaataatcttcccatgcaaagaaggaaaaaatcaaatttcagacagctgaggtggcttcagattgggattcaggtaccaga

SEQ ID NO: 17119 - DNA, 262 bp, Homo sapiens
  misc_feature 12: s=g or c
  misc_feature 120: n=a, g, c or t
caggctggagtscagtagtgcactccggctcactgcaggcttgacctcctggggctcaagccgtcctcccaccccagcctccgtagtagctgggactacaggtgtgtgccaccacatctngctaatttttgtatttttagtagagatgaggtttcagtatgttggtcaggctggtcttgaacccctgacctcaggtgatctgcctgcctcggcctcccaaagtactgggattacaaggatgagccaccgtgcctggtcctac

SEQ ID NO: 17120 - DNA, 150 bp, Homo sapiens
atttttttattatactctaagttttagggtacatgtgcacattgtgcaggttagttacatatgtatacatgtgccatgctggtgcgctgcacccactaatgtgtcatctagcattaggtatatctcccaatgctatccctcccccctccc

SEQ ID NO: 17121 - DNA, 127 bp, Homo sapiens
aaagattcagtaaatattaggaatgcaggaggtgtactagttagggttctccagagaaacagaaccaatagggtatgtgtgtgtgtgtgtgtgaggggtgtgtgatgtgtgtgtgtcatcctggctt

SEQ ID NO: 17122 - DNA, 68 bp, Homo sapiens
ctgagtggctgagatgtcaggcatgtgccaccaagcctggcaattttttttttttttttttttttttt

SEQ ID NO: 17123 - DNA, 161 bp, Homo sapiens
ttagtcccagctactcccaagtctgcattagatggcctttgagacagggtcttgctctgtcaccctggctggtgtgcagtggtgtaatcttggctcactgcagcctcaacctccttggctcaagcaatcttcctgtcttagcctcctgagtagctgggact

SEQ ID NO: 17124 - DNA, 214 bp, Homo sapiens
cctagattcattgtatgtgatctcttttatttattttttggtaacttttagcatcttctcttcataatattcataagtttcaggagggttatccttggaaagggattttgtttacaatcattgttctagacattattagataattttaatccagtaacttcatttttcaattctgggtaaattttcttgtatcatttgataatttcggcctgtg

SEQ ID NO: 17125 - DNA, 109 bp, Homo sapiens
atgtcaatcagacactgactagagtaataatatgtttacatgtaatactgaaaatgactcatgcactggacacacacagtacaatgcagcaatatcttttttttttttt

SEQ ID NO: 17126 - DNA, 174 bp, Homo sapiens
aaaaaaatcccgggggagcaaaatggacgaaaggcgacccccaggcaggggcgctgggtgccttgggaatccgaggaatcccttctctttgccagtcggaggggactagagggagccgaaggggccggagatgggccgagcgctgccccccgggggtcctcggcgccggccaca

SEQ ID NO: 17127 - DNA, 187 bp, Homo sapiens
  misc_feature 22: k=g or t
ctgggtccgctcccctggagtkctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagcagagctgga

SEQ ID NO: 17128 - DNA, 218 bp, Homo sapiens
tctatggaggctgcacatggtcactgcaagaaatgtcaaaatccccagaacagatatgatccataccttgtaaaatgttctgtatcccacataaaacaatcctcaagatgatcaattttgcaaagtaagcgtgacaccagtcttttgtctttctttcagttctcattccacttttgacttatttgtggaaagttataattagattctgcctggcctta

SEQ ID NO: 17129 - DNA, 99 bp, Homo sapiens
gagaacccataaataaactctggcatatatgatcaaataatttgtgacaagggccaaaaccattcagtggtgaaagaacatactttcaacaaatgacat

SEQ ID NO: 17130 - DNA, 137 bp, Homo sapiens
caacaattccatttttgattatctatcccagagaaattaaaccaccagtatttaagaaactttcatactcgagaagatacactttctgtgtgtttaagaaactcctaatgtgttttacttcccgtccctcccaccca

SEQ ID NO: 17131 - DNA, 133 bp, Homo sapiens
ttatttatttatttattattgctttttatttttgagacagggtctcactctcttgcccaggctggagggcaatggtgccaccatggctgtctgcaacctcagcctcctgggctcaagcaatcctcccacctcc

SEQ ID NO: 17132 - DNA, 117 bp, Homo sapiens
gtcacacaaaaatcacaagttaaatgaaaagcaaaaaaaaaattccacaaaaaaatctgtaagtggcaccatattaacagactaataaaagatccaaaacttacctttttttttttt

SEQ ID NO: 17133 - DNA, 64 bp, Homo sapiens
actttgtaacttttaagtggtcggaacacgccccgcgctgctgggtcccgccagacacgccgcc

SEQ ID NO: 17134 - DNA, 253 bp, Homo sapiens
ggagtggaatggaatggaatggaatggaaacatcccgaatggaatggaatgtaatggagtctaagggaattgaatagaatcaatccgaatgtaatggaatggaatgaaatggaatggaatggaatggaatggaatcaacccgagtgcaatggaatggattcgaatggaatggaatggaatggaatggattcaacaagaatggaatggaaaggaatggaatcaacccgagtgtaatggcatggactggaagcgc

SEQ ID NO: 17135 - DNA, 225 bp, Homo sapiens
ccgagtgcaatggaatggaatggaatggaatggaatggagtgaaataaactcgagtggaatggaatggaatggaatagaatggaatggaatggaaaggaatggaagagaatggaatggaatcaactcgagtggaaaggaatggaatggaatggaaaggaatggaatgcaatggaatgcagtgttatggaatggaacgaaatggaatgaaatggattcaacccaaa

SEQ ID NO: 17136 - DNA, 94 bp, Homo sapiens
cactccatccccagcgaaaagaaacccttacttattggcagtcaagaggggtaaactttagcagtgtcctctctttccttaaaaaaaaaaaaaa

SEQ ID NO: 17137 - DNA, 127 bp, Homo sapiens
  misc_feature 8: y=c or t
  misc_feature 9: y=c or t
ttttttgyytgtttgtttgtttgtttgtttgtttgttttttaaagggaggaaggtatatcattctagaataaaatgactgttgttgctgggcggctacccgggctccttccgccctcggcttctccc

SEQ ID NO: 17138 - DNA, 196 bp, Homo sapiens
tataaatagctttattctgatattaatcagattcccaactttactgagaattaaggactagggtactttaaagaaatgcaaatagcaattgaagaacctctgctgcaggtggtggccctggctagactgaattacactagaaatcagccagaaggaagcgtccttgggatcccagatcactctttttttttttttt

SEQ ID NO: 17139 - DNA, 52 bp, Homo sapiens
ggagcttttgggctgagactattgggttttctttctttttttttttaaattt

SEQ ID NO: 17140 - DNA, 186 bp, Homo sapiens
ctataggcacgcactaccatgcctggctaattttttattttggtagagatgaggtttcaccatgttggccaggctggtctcgaactcctgacttcaggtgatccacctgccaaagtgctgggattacaggttgagacaccgcacccggccaacatggtgaaacctcatctctaccaaaaaaaaaaa

SEQ ID NO: 17141 - DNA, 170 bp, Homo sapiens
acctccccctcccgggttcaagctattctcctgcctcagcctcccaagtagctgggattacaggcatgcaccaccatgcctggctaattttgtatttttagtagagatggggtttctccatgttggtcaggctggtctcgtactcctgacctcagatgatctgcccacct

SEQ ID NO: 17142 - DNA, 174 bp, Homo sapiens
ttcttataggttctggatattaggcctttgtcagatgcatagttggtgaatattttctcccattctgtaggttgtctgtttactctattgctagtttcttttgctgtacagacgctctttagtttaattatgtctcacttgtcaatttttgttgcaattgtttctggggactaa

SEQ ID NO: 17143 - DNA, 116 bp, Homo sapiens
  misc_feature 95: k=g or t
agccggttattcttaataattctctggccacctgttctagagtgtaacacatctcaccacctgaagcttttcttttctttctttgtttctttctkttttttttttttttttttttt

SEQ ID NO: 17144 - DNA, 412 bp, Homo sapiens
attgtgtctagaaactttctttatgttacagtttagagtatgacagttggaacacacaagcaaatattatgagtttggctagctaacctgactcccacgagcaatcatccctgctaatttcctatacataatgtttttaatcagtgtagacctagagtagctggttgcctaatcctaggaagtatgttttattcctttaagctttcttcatagcaggcaagacacatgccagtttagaatggtggccctaccacttactacctatgtgatcttgagcaatttacttgacctttcttagccttactgtgctcatccataaaatagagatagtaacactcagcctgcagagttgtaagaattagagaaaatatgccagtcaagtgcccagtgtcattagagccttgacaccact

SEQ ID NO: 17145 - DNA, 254 bp, Homo sapiens
aatttagattgattccatgtctttgctattgtgaatagtgccctgatgaacatacgcatgcatgtgcctttatagcagaagtaattatattcctttgggtatataacccataataagattgctgggtcaaatggtaattctggtttaagttctttgagaaatggccacactgctttccacaatggctgagctagtttacactcctaccagcattgtataagtgttcccttttctccacaaccttgcccccacta

SEQ ID NO: 17146 - DNA, 175 bp, Homo sapiens
gaattaagtccccagcatgttgtctacccttattttgttttccctatatttgatcttcagagcactttatcccagagtaggtctatgaaaaatcgaagcaaattatatttggcttaggaatgggtgggacttttttctaaacacctaaagcagtgtttttttttttttttttttt

SEQ ID NO: 17147 - DNA, 166 bp, Homo sapiens
catttgatatgattcttggtatgacacgttcagttgaaacatggacattttcatactatgttaagagactctggatcttgtttaatccttctctttaaacttctgacactcaagtaagactcctttgacatttctgtggagggaaaaggagaagggagatggcact

SEQ ID NO: 17148 - DNA, 205 bp, Homo sapiens
ccccatctgtatgtcaccatcatcaaagaccaaaggtagataaacccacaaagatggggaaaaaacagagcagaaaagctgaaaattctaaaaatccgagtgcctctccccctcgaaaggaatgcagctcctcaccagcaatggaacaaagctggacagagaatgactttgacgaattgagacaagaaggcttcagacgatcaaa

SEQ ID NO: 17149 - DNA, 127 bp, Homo sapiens
cggatatatgctgttatggaaagctatgtggattttctttcttatacattatattttatatacatattaaaaagctagacacatatattttttcccctctcttatggtgctgagtgcctgttttttt

SEQ ID NO: 17150 - DNA, 111 bp, Homo sapiens
attctggttgaactaaatatttccctcctctcactctcatataaaacccattgagggctgggcgcggtggctcacgcctgtggtcccagcactttgggaggctgaggtggg

SEQ ID NO: 17151 - DNA, 104 bp, Homo sapiens
tattttattttatttttcgagacggagtctcactattgtcgcccaagctgaagtgcaattgcaggatgtcagctcactgcaacctctgcatcctgggctcaaga

SEQ ID NO: 17152 - DNA, 186 bp, Homo sapiens
aataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaag

SEQ ID NO: 17153 - DNA, 52 bp, Homo sapiens
aattcgcacaagaccctaccttctaaaaaaaaaaaaatgaaaaaaataaaaa

SEQ ID NO: 17154 - DNA, 210 bp, Homo sapiens
tgccattgcattccagcctgggtgacagagtgagatcctgtctcaaacaaacaaactaaacaaattacaaaataaaataaaattaaattaaaattaaatatgctaattattcagtgttgaagaatattagtaaatcagttcattatttcgaaacctgataacgtgaaaaataagcatatttaattttaatttaattttattttattttgt

SEQ ID NO: 17155 - DNA, 296 bp, Homo sapiens
  misc_feature 10: w=a or t
  misc_feature 66: w=a or t
  misc_feature 215: w=a or t
  misc_feature 239: w=a or t
  misc_feature 240: k=g or t
  misc_feature 244: m=a or c
catggctctwggagttgtgtactaggagaagcaggcctcctgacctaccccctgctcagagcagtwcttttctcatatgagcattcagagaatctcttggaggcctcatgaaaacagattgctgattagtttctgattcagcaatctagcttggtccagggtaggggctgataaattgcatttcaaagaagttccctggtgctgctgttgctgtwgctaatctggcgatcacacttccwkagtmactgctttagaacacaacctctgatccagcccataccagagaccctgcttga

SEQ ID NO: 17156 - DNA, 308 bp, Homo sapiens
cagaagaagttgtctagcacctgcatgtagacatgaaaactaatagtattgcttttatgaaattgttgttgttgtttgagacagggtcttgctctgttgcccaggctggagagcagtggtgcagtcacagctcactacagcctcagcctcctgggctcaggtgatctcccacctcagcctcctgagtggctggggctacaggtgtgtgccaccatgcctgcctaatttttgtatttttttgtagagatggggttttgccatgttgctcaggctgtaatgaaatgatttgtttttttaaatatgccctg

SEQ ID NO: 17157 - DNA, 219 bp, Homo sapiens
attatggaaccaaaaaaaataagaaaaaagaaaaaagcccacatagccaaagcaagactaagcaaaaagaacaaatctggaggcatcacactactggacttcaaactataaggctatagtcaccaaaacaggatggtactggtataataataggcacataggccaagggaacagaatagagaacccagagataatcctaaatacttacagccaactgat

SEQ ID NO: 17158 - DNA, 141 bp, Homo sapiens
ccatgtaggccaggctggtcttgaactcctgacctcaagtgatctacctgctctggcttccaaagtgctgggattacaggcatgagccactatgtctggctaaaacctataaacatttcttagagaaatgctgttccccgg

SEQ ID NO: 17159 - DNA, 332 bp, Homo sapiens
  misc_feature 29: k=g or t
  misc_feature 280: m=a or c
tgcgcgactccgagctggccaaagaagtkcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctgtmcagggagatctgaattggggtgaagagcagatctcagaacaaggaggagaat

SEQ ID NO: 17160 - DNA, 272 bp, Homo sapiens
ttagtaggttgtatgtgtccagaaatgtatctgtttcttctatattatcaaatgtgttggtgtgtagttgtttatagtagtctcttgtgatcctttgtatttctgtggtatcagatgtaatgtctctcctttcatctctgatctgatttctttggctcttctctctttttttacttagtctagctaaagacttgttattgtcttttcaaaaacaactctttgttttgctctttttaatgtttttgtctctatttcatttatttcttctctgt

SEQ ID NO: 17161 - DNA, 100 bp, Homo sapiens
tctcctaggtattaagccccacttgcattaactatgtatcctgatgctcttcctccccccgccaaagtgacaggtcccagtgtgtgttgttcccctccct

SEQ ID NO: 17162 - DNA, 200 bp, Homo sapiens
cctggccaacatggtaaaactccgtttctactaaaaatacaaaaattagttgggtgtggtggtgggcgcctgtaacccagctactcaggaggctgagacaggagaatcgcttgaacccgggaggcagaggttgcagtgagccgagatcgagccattgcactccagcctgggcgacaagagtgaaactccacctcaaaaaa

SEQ ID NO: 17163 - DNA, 212 bp, Homo sapiens
cctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccacctt

SEQ ID NO: 17164 - DNA, 118 bp, Homo sapiens
  misc_feature 59: k=g or t
cgggtagtggtggaagcaggtttggaaaatgtgattagttttgtaagcgtttttgagtktgaagtgccactggggaaggcttttggaaatttatttccagagttcaagactgagctgc

SEQ ID NO: 17165 - DNA, 168 bp, Homo sapiens
  misc_feature 31: r=a or g
  misc_feature 113: y=c or t
gattggccgggcgtggtggtgcacacctgtrgtcccagctactcaggaggctgagggaggagaatcgcttgaacctgggaggcataggttgcggtgagccgagatcgcaccaytgcactcaagcatgggtgacagggcaagcaagactccatctcaaaaaaaaaaaaa

SEQ ID NO: 17166 - DNA, 160 bp, Homo sapiens
gctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctga

SEQ ID NO: 17167 - DNA, 230 bp, Homo sapiens
  misc_feature 127: w=a or t
  misc_feature 128: w=a or t
attaaaaaaaaatctgctaattcaaccacaacagggtaatgtttcagaaaaagccacttctaaaactcaggataaaaataggtggcatatgctaaatagtaaagaactggcatagcatcagagaagwwaaggagctagtgctttttaagtacatttcataatgcaaaggcaccacttacgtgttattttctacccatttgtttcacacaaaaaagggcagagcagttatt

SEQ ID NO: 17168 - DNA, 160 bp, Homo sapiens
  misc_feature 13: m=a or c
  misc_feature 14: r=a or g
tactattttttamrttgccaaataaaaattgtatacatttgtggtgcacaacatgatgttttgaaatctgtatgcactgtggaatggctaactcaagctaattaatatatgcattacctcacctacttatcctctttttgcggtgagaatactttttttt

SEQ ID NO: 17169 - DNA, 157 bp, Homo sapiens
ttttttttaaagacttgctctgtcacccaggctgtagtgtgcagtggcacgatctctgcacacgatcactgcaagctctgcctcccaggttcatgccattctcctgcctcagcctccagagtagctggtactacaggcgcccgccaccacacccggc

SEQ ID NO: 17170 - DNA, 300 bp, Homo sapiens
cctatttcttaagcatctatatacttctaagggacgacagaatttcacactcattttatagatgtgtttctccaatagccaattcctaggtcataacattacagctacatttcctttgctgaattttattatcatctttctgtgtagacagatcatgaaataaaggtgtttgttcctattcactacagaatattttcctctgccctagttaagaagtatcaatttcagtcataaggcaacacattcttattgtgtgggggctctagggtttgtgtacacttttttttttttttttttttt

SEQ ID NO: 17171 - DNA, 283 bp, Homo sapiens
  misc_feature 87: m=a or c
  misc_feature 88: m=a or c
ttacagaatctccccttatatgcagttatttgtcaatgtcctagtcttgattgttcggctcttagaaaggggaaatgaagaaaatgmmggtgggaaaaaaggagctctggccttttaagtcccctggaaatcacttcaactggaggaagcagggttttcaaaagtgtggggatgtgtaactacaatggctgcctgactctttgtctacacttctgtgataagaagccgcagtgaacaaaacacagatcctttatggctggaggacagggtccttttttttttt

SEQ ID NO: 17172 - DNA, 301 bp, Homo sapiens
agccaaagcaaatcacctgcccaggctcgatatcagtgaggcaagaaaattgaggttatggaggttaagggaaagcagaggaagtgtagtgaatatttgctgcatgataatttaagcttccataggacgctggctgataatcacaaatccaaaaatcttgttttttattattaagttctagggtacatgtgcacaacatgcaggtttgttacatatgtatacatgtgccatgttggtgtgctgcacccattaactctacatttacattaggtatatctcctaatgctatccctcccccctt

SEQ ID NO: 17173 - DNA, 153 bp, Homo sapiens
  misc_feature 12: m=a or c
atggaagggacmattcatgaaaagtcaacatgagaggattacctagactttcatcatgtagtcaagacaggacatactctaatttgttcattatgtatctacagtggccctaaatgaaatgctcaattttttttttttttttttttttttttt

SEQ ID NO: 17174 - DNA, 120 bp, Homo sapiens
  misc_feature 11: r=a or g
  misc_feature 20: m=a or c
  misc_feature 22: m=a or c
aaagcactgaratgaatgtmamatagtaatgttatctgatgttaccatttgatcaatgagggaattaaggccagagaaatgaagcagtttgcctaagattagtgagagtagagacgggag

SEQ ID NO: 17175 - DNA, 218 bp, Homo sapiens
  misc_feature 13: s=g or c
agaaaagccagtstgtactggccaggctgaacatggggtggagaaggagaagccatcaggaggacggtcattctgggtaaggctggaggaagggctgtaagggtggtaggaggcagccacctcctcagaaatgcccccagccaccaaggcctcgctgtgcttgttctagccctcagaggagttcagccctgggaacggctcatgtgtgagaggactgt

SEQ ID NO: 17176 - DNA, 139 bp, Homo sapiens
  misc_feature 61: s=g or c
aaccgcgcaggctgagccccaggcaggaagcagcccacttggtggggttggggtatgagtscttcctcgcgggggctcggtgggtcctgagtattctttggccggatttgctgatccgtctgctccaggtgagctggga

SEQ ID NO: 17177 - DNA, 423 bp, Homo sapiens
  misc_feature 84: s=g or c
  misc_feature 85: m=a or c
  misc_feature 322: m=a or c
  misc_feature 342: m=a or c
  misc_feature 351: y=c or t
  misc_feature 366: m=a or c
aggaagtggggtcaggctctgtgcctttgataaaactcatgccagcctcaaaaaaaaacgcatgatgtgtcgctatatgggggsmccctatggttggaggtcttacaaatccaatggggccagtgtattaaatatggcccttttcccatagagttggtcatcatgatgtttaccatgtttcagattcaaggtatctgatctcaccagggtcacatggccaaatatgtaactctcattaaaagattgagttatatagtcagtatggggaaatctctattcactctggtgaactgtgacatattttatttatcatttctaattmtatatatttaacggtgtacmacatgatgytttgatatgcatatmcatagtgaaatgattattacagtcaagcaaattaacatatccgtcacctcactcagt

SEQ ID NO: 17178 - DNA, 141 bp, Homo sapiens
caaattcagtaaataagctgctttatgtcttgagaaatttaactggcagaataaatggaaagaagtcagtaaaaagggagcagttgaacaagcatggtgtctcacaccaataaccccagcactttgggaggccgaggccat

SEQ ID NO: 17179 - DNA, 171 bp, Homo sapiens
ccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaa

SEQ ID NO: 17180 - DNA, 147 bp, Homo sapiens
catacattttttattatttaaaattaatttattggctggactggtggcccacgccggtaatcccagcactttgggaggccaaagtgggtggatcaattgaagttaggagttcgagaccagcctggccaagctgatgaaaccctatct

SEQ ID NO: 17181 - DNA, 185 bp, Homo sapiens
  misc_feature 33: k=g or t
ttttctcttagcatttttttttgtgtgtgtgtktagtgtggttctgctgttgacaaatttttttttcagtgtttgcttgttttctaaagttcatttttaggctaacactgaagtaggataatgaattacaagttggcagttactattgcttcttcaaaccaatcattccattgtcccctggcttt

SEQ ID NO: 17182 - DNA, 142 bp, Homo sapiens
tgcggctcaactgggaattagactatgagatgaggaaactgcattttgctagattttcttttcttttgttttgttttattttgtttcgagaaagaatcacttgaacccaggaggcggaggttgcaatgagccgagatcgcgc

SEQ ID NO: 17183 - DNA, 139 bp, Homo sapiens
caaaaggccacttattgtatgattctgtttatatgaaatgtcgacaatagttaaatagtgtaaaattatatcacgtaaatactaacagttggtattgctacattaattttagacaaaataaaccataagccagaaagcg

SEQ ID NO: 17184 - DNA, 235 bp, Homo sapiens
  misc_feature 231: b=c or g or t
tgtgattacaggtgtgagccaccgcaccctgcctggaagcctcatttctaaaacatatttctctctttctttttttttctttttgaagcggagtttccctcttattgcccaggctgaggcaggacaatcacttgaacccgagaggcaaaggttgtggtgagccaagatcgcgccattgcactccagcctgggcaatagcgcgatcttggctcaccacaacctttgcctctbggat

SEQ ID NO: 17185 - DNA, 176 bp, Homo sapiens
  misc_feature 46: w=a or t
  misc_feature 49: y=c or t
aaaaaattagctgggtatagtggcatgggtgcctgtagtctcagcwatycaggaggctgaggcagggggatcatttgaacccaagagtttgaggctgcagtgagctatgatcatgccactgcactccagcctgggcaacagagtggaatcctgttgtctcttaaaaaaaaaaaaaa

SEQ ID NO: 17186 - DNA, 161 bp, Homo sapiens
  misc_feature 150: k=g or t
ttttattattattatactttaagttttagggtacatgtgcacaatgtgcaggtttgttacatatgtatacatgtgccatgttggtgtgctgcacccattaactcgtcatttagcattaggtatatctcctaatgctatccctcccccctkccccaccccca

SEQ ID NO: 17187 - DNA, 180 bp, Homo sapiens
tgaaaagatcagacctacattgtggcgtccacctgagaggtgtaggacagctgaggttggacgtctggactgtgcaacccagcaggacaagcctgtggcacacatggccagaagctattgatctcttgaagattagtcctgagttttacttggtttgtgtgtcttctaagtggcagctgt

SEQ ID NO: 17188 - DNA, 343 bp, Homo sapiens
acccctgatttgttgtttagcgtggcagctactagctacatgtggctactgggcacctgaaagtggttcgtatgactgaggaactgaattgtaaattttatttcattttaatttaaacagacatgtggctagtggttaagtcaatgtgtagagcagctctagccaataattaaggaaatgtattaactattaactactacacagcaggcttaaaagacaaacagaatggaaggatagctacctctcaaccttgttgttttgactttccctgcctctgccagtccttcaagatttgtcaaaaaatgacagtttgatgacaagctcctgaactcattttaatttt

SEQ ID NO: 17189 - DNA, 333 bp, Homo sapiens
  misc_feature 25: y=c or t
  misc_feature 50: w=a or t
aggaatttggagacttacttcagtyagagctcaaggttatgagctgagtwgtttgtgagagcaaaatgatagaaatggtttaaatgtccatcaacagtaataaagtaaatgatgcaaaatcttttccagaggacatcttatggtgcttaaaatggattaaattgatctacaagtattgataaagacatttctccaaggcatgttgtgcaagtgataacctggaagttacagaaaatattcatagtgtgataccattatgttaaaaaaaaccactaaaaatatgccacatatctttggttgagatggggactcagcagcagatggggtgggagt

SEQ ID NO: 17190 - DNA, 341 bp, Homo sapiens
  misc_feature 256: k=g or t
aacccattagtcactcaggagcaggttgttcagtttccatgtagttgtatggttttgagtgagtatcttaatcttgaactctaatttgattgcactttggtctgaaagactgtttcttatgatttctgttcttttgcatttgctgaggagtgttttacttccaattaagtgggcaattctagaataactgttatgtggtgctgagaagaatgtatattctgttgatttggggtggagagttctgtacatgtctatkaggtctagcttggtccacagctgagttcaagtcttgaatatccttattaattttctgtctcgttgatctgtctaatattgacagt

SEQ ID NO: 17191 - DNA, 191 bp, Homo sapiens
atttatactgctacttttgaaagaattgtttttatgactatgctctttttgtgattgaaaagtcatctaatagaagctgtatagaagctactttttaattgctggcaaacagctttaagtgcactttctttgattacacttccattttttgttaaacttgaattttctgaagccttttatgtaccacaatc

SEQ ID NO: 17192 - DNA, 86 bp, Homo sapiens
acctcttcttgtaccagtcttgttctctctcactctttgccaatcacattggcttccttgttctttctggactacatcaagcatgt

SEQ ID NO: 17193 - DNA, 350 bp, Homo sapiens
  misc_feature 60: r=a or g
aagaatgccaaagaatagctagtaaaactataaaaaatataagaagacagagtaggccargcgcagtggctcacgcctgtaattccagcactttgggaggctaaggcaggcagatcgtgaggtcaggagatcgagaccatcctggctaacacggtgaagccctgtctctactaaaaatacaaaaattagccgggcatggaagcaagagcctgtagtcccagctacttgggaggctgaggcaggagaatcacttgaacccaggaggtggaggttgtggtgagctgagatcatgccattgcactccaacctgggcaacaagagagaagctccatctcaaaaataaaaaaata

SEQ ID NO: 17194 - DNA, 212 bp, Homo sapiens
  misc_feature 21: s=g or c
  misc_feature 22: s=g or c
cctccactaacacgaagattssatccacaccaaggagagaacactttatagcaactgatagagccagctgagctgtttccatggagacagtggtgatttcaggaaatccatctgttttagattgctctatagactcaccctaacttcttttacagctcatgtagctcaggggccctgaagcctccattcccacagcaccttctcccagccgc

SEQ ID NO: 17195 - DNA, 161 bp, Homo sapiens
  misc_feature 7: k=g or t
  misc_feature 10: w=a or t
  misc_feature 32: w=a or t
ttttatkatwattatactttaagttttagggwacatgtgcacaatgtgcaggtttgttacatatgtatacatgtgccatgttggtgtgctgcacccattaactcgtcatttagcattaggtatatctcctaatgctatccctccccccttccccaccccca

SEQ ID NO: 17196 - DNA, 328 bp, Homo sapiens
  misc_feature 227: k=g or t
atttgaatttctctgatgtccagtgatgatgagcattttttcatgtgtctgttggctgcataaatgtcttcgagacttcatccactttttgatggggttgtttgatttttttcttgtaaatttgtttaagttctttgtagattctggatattagccctttgtcagacggggagattgcaaaaattttcccccgttctgtaggttgcctgtccactctgatggcagtktcttttgctgtgcagaagctctttagtttaattagtgtaagtgttatttttgtacccattaaccgtcccctttgctcccctgtctagtactcctcccagct

SEQ ID NO: 17197 - DNA, 185 bp, Homo sapiens
aaatggaaaggaatggaaaggaatagaatggaatcaacccgagtgaaatggaatggaaagactggaatggagtggaatggaatggaatggaattaacccgaatagaatggaatggaacggaatggaacggaatgtaatggaatggaatggaatggaatcaacccgagtgcaggggaatggaatgc

SEQ ID NO: 17198 - DNA, 139 bp, Homo sapiens
gacatggtgcctcacgcttgtaatcttagcactttgggaggccaaggtgggcggatcacatgaggccagtagtttgagactagcctggccaacatggcgaacccatctctactaaaaaaaaaaaaaaaaaaaaaaattt

SEQ ID NO: 17199 - DNA, 211 bp, Homo sapiens
aagggagttattgttccatcttgccttatcagtgggtaggatctcttcatcatgcccctgctgggaatgttttaaactctccagtgttttaggaactctataagctgagggtgggaaattgaataaatattgattctgaagctaagaaaatagttgtggtaggttattgggggtttttttatttttttttaaattttcatttgggaaggca

SEQ ID NO: 17200 - DNA, 93 bp, Homo sapiens
cacagtcacataagttaatcaaattactgaaaactggttgtattgagaaaaatctttagccagaggaaaagccacaaattacatgggaacatc

SEQ ID NO: 17201 - DNA, 143 bp, Homo sapiens
tgaactttgacttcttagagtccatgagagaatggactaacaatacttgaagttagatacttgtcaaccctttccttctgttttttaatttttattttaatttaattagtatatttattttgagtcagggtcctgttctgttg

SEQ ID NO: 17202 - DNA, 152 bp, Homo sapiens
tatattttttgagacggagtcgctctgtcacccaggctggagtgcagtggcatgatcttggctcactgcaagctccacctcccaggttgacgccattctcctgcctcagcctccctagtagctgggactacaggtgcctgccaccacgccgg

SEQ ID NO: 17203 - DNA, 168 bp, Homo sapiens
ctccagcctgggtaacagagtgagaccctgtcacagaaaaaaaagaaaagaaaagaaaagaaaagaaaagatctgaactcttgaagcatgatagatctccaaatttgcctaatctgaaaaagttttcaagagtaattctgactacacaaatttcaacctcatcattga

SEQ ID NO: 17204 - DNA, 117 bp, Homo sapiens
ttatgattattgtttattatctttcttcacctccactaaaacgtaagctttaccaggactaagatcttcatctgttttgttcattggtgtatccaaatctctagagcagtgcctaca

SEQ ID NO: 17205 - DNA, 345 bp, Homo sapiens
agaggtgccaatcagacgggtttgactgcatggaagaaagcagagctggctgggcacggtggctcaagcctgtaatcccagcactttgggaggccgaggcaggtggatcacgaggtcaggagttcaagaccatcctgaccaacatgatgaaaccccgtctctactaaaaatacaaaaattggccgggtgtggtgttgtgcagcctgtaatcccagctgctcggggggctgaggcaggaaaattgcttgaacttgcgaggcggaggttgcagtgagcaagatcgtgccactgcactccagcctgggtgacggagtgagactccatctcaaaggaaaaaaaaaagca

SEQ ID NO: 17206 - DNA, 198 bp, Homo sapiens
gccattttcctatggttaaacatctaggccatcgattttctgccatttttagctgtagaaactgtgttttaagaaaccatatgtagaacctaaatatgttctattgatttttttttttgatatagagtcttgctattacacaggcaggattgcagtggcatgatctcagctcactgcaacctccacctcccgggttcc

SEQ ID NO: 17207 - DNA, 174 bp, Homo sapiens
agagcaggcgtttcgagttgcttctggaatcatcagctgaagcggcaggaggaaggtgccagggagaacagagtgtcgttgagccgttcggttttcacctcggacttcccagcagcttttgcagagtggtgtctagattacggagcacacgggtgccgcattcctgacagaccc

SEQ ID NO: 17208 - DNA, 287 bp, Homo sapiens
caaataagaatcagtagaagaggaccaggcacggtggctcatgcctgtaatcccaacactttgggaggcccaggcgggtggatcacctgaggtcaggagttcgagaccagtctggctaacatggcaaaacctcatctttactaaaaaaacaaaaattagccgggcatggtggcgcatgcctataatcccagctactcagaaggttgaggcacgagaatcacttgagtccaggagttcgagaccagcctgggtgacatggtgaaaccccgtctctacaaaaaaaaaaa

SEQ ID NO: 17209 - DNA, 161 bp, Homo sapiens
caaatgcatcagtttgataccaccatcatactttttgccatatctgtgtattttctttaaatcgactcattttttttttaattttttttgagattgagtattgctcttgttgcccaggctggactgcaatggcatgatcttgggtcactgcaacctccgcc

SEQ ID NO: 17210 - DNA, 166 bp, Homo sapiens
tttagcgtatttagtgtatgctgtgccccagtcagactagtgtccttgctattggtacttcctattctcccaaagtcctttcattcccaccttcgtatcttttttcatatggtccctgaagcctggaataccttccattcctctttcatttctagatgcccaacag

SEQ ID NO: 17211 - DNA, 239 bp, Homo sapiens
  misc_feature 125: k=g or t
  misc_feature 209: y=c or t
ctttcaggatcacagtgggaggtcagaagacagcacttatgggggttttgaggtctggatcttgtacccagcccttgaacttgaggtatggagatgggggtctttggaacatagaggtttgagtkctcagggttccttcagcactgacacctgccccagtcagcctgctgtctcccagcttagctggccccatcccagcctagcctgtycatgctgcctcctgtgtcctacaccggcaa

SEQ ID NO: 17212 - DNA, 269 bp, Homo sapiens
taaatggtactggaaaacatggatagccatatgcagaagaataagatggaacccatctctcaccatatacaaaaactaactgaagatgggtaaaaacttaaatgttaagacctgaaactataaaaattctagaagaagggctaggaaaatctcttttggactttggttcaggcaaataatttatgactaaaacctcaaaagcaaatacagcaaaaacaagaaaagacaaatgagatttttttttttgaggtaaggtttctgtttttcat

SEQ ID NO: 17213 - DNA, 179 bp, Homo sapiens
ctttcagaattggtttggaaacattcccttctcttctatttcttggaatagtttgaataggattggtatttttctttaaatgtttggtaaatttcagcagtgaaaccattgggtccctgggcatttctttgctgggggactttttattctggcttttatctcgttacttgttaccggtc

SEQ ID NO: 17214 - DNA, 115 bp, Homo sapiens
aatttatatagcaggtaaaggattcgttaaatgttgtaaggctcatagccttcccagttcttcttcctcttccttctcctcctcctccccctcttcttcttcttcttcttctggt

SEQ ID NO: 17215 - DNA, 167 bp, Homo sapiens
tatgactcaagagttttttggttttgttttttctgagacagggtctccctccctgtctcccaggctagagagcagaggtgggctccctgcagccttgacttcctgagctcatgtgaccctccaaccttagccccccaagtagctgggactactggggcacgccacca

SEQ ID NO: 17216 - DNA, 342 bp, Homo sapiens
agaggtgccaatcagacgggtttgactgcatggaagaaagcagagctggctgggcacggtggctcaagcctgtaatcccagcactttgggaggccgaggcaggtggatcacgaggtcaggagttcaagaccatcctgaccaacatgatgaaaccccgtctctactaaaaatacaaaaattggccgggtgtggtgttgtgcagcctgtaatcccagctgctcggggggctgaggcaggaaaattgcttgaacttgcgaggcggaggttgcagtgagcaagatcgtgccactgcactccagcctgggtgacggagtgagactccatctcaaaggaaaaaaaaaa

SEQ ID NO: 17217 - DNA, 59 bp, Homo sapiens
aaaaaagaaatcatgtttaatactatttcaatcaaacattatctttttttttttttttt

SEQ ID NO: 17218 - DNA, 153 bp, Homo sapiens
tatttaaaagtttcttttggtatttgccgctgtgtttttaaataactttgtctatctgtcttgacttcttagctttggattttgagaactgacttcccgccctggttgaggattcagctttcttactgtgccttcctcatgcacatgtgccat

SEQ ID NO: 17219 - DNA, 188 bp, Homo sapiens
  misc_feature 176: r=a or g
ggataactgtgcctctaatctccatctttcaggggtgtccatggtgtccatgatgtttagtagcagtattaagccagtcattgctctctgttgttctagcttgcagacatctacaaaacctatatgaatgggttgatttgctactaaacatcatggacaccatggacacccctgaragatggagatta

SEQ ID NO: 17220 - DNA, 169 bp, Homo sapiens
cagagggttggctgggcttggtggtgggcgcctgtggtcccggctacttgggaggctgaggcaggagagtggcgtgaacccgggaggcagggcttgcagtgggccgagattgcgccactgcacccagcttgggcgacagagcgagactccgtctcaaaaaaaaaaaaaa

SEQ ID NO: 17221 - DNA, 189 bp, Homo sapiens
tgaaaataatgatggtattttggtggaaatttcattgaatgtgtaaattgcttttggcaatatggtcattttcacaatgttgattctgcccatccacaaagctgggatttgtttccacttgtttatgtcgtctataatttctttcagcagtgtttagtagttttctttgtagagatctttcacctcctc

SEQ ID NO: 17222 - DNA, 162 bp, Homo sapiens
tctcaggttcaggtagttctcctgcctcagcctcccaagtagctgggattacaggtgtgtgccaccctgcccagctaatttttgtatttttggtagagacagggtttcgccacgttggccaggctggtctcgaactcctgacctcagatgatctacccgcca

SEQ ID NO: 17223 - DNA, 125 bp, Homo sapiens
gtcctcattgcgctgtggtggtctgtgtctcacgccttccgagcggcctcagatgccagaatgtgaagtcaacacaaccagagcagttgtcctgggagagttaagggtctgctctcaatcacggt

SEQ ID NO: 17224 - DNA, 233 bp, Homo sapiens
  misc_feature 222: s=g or c
  misc_feature 223: r=a or g
tctcggctcactgcaacctctgtctcccagattcaagcaattctcttgcctcagcctcccaagtagctaggattacaagtgcctgccgccatgcccaactaatttttgtatttttagtagagacagggtttcaccatgttggccaggctggtcttgaactcctgatctcaggtgatccgcccgcctcggcatcccaaaatgctgggattacaggcatgagcsrccgcgtccga

SEQ ID NO: 17225 - DNA, 441 bp, Homo sapiens
  misc_feature 381: m=a or c
ctgatcctgaaggctgtaggcatctgagtttgcagtccctgttctcaaccgaataggatattgcatttcctctcgtgagctgccgtgggccacagagggtttgccccccacctccccctgcactaggctggtgtccccacaacgggacccatggaccacacagttcagggtttcagccgcacaaccggagtgggctacgtgttaataagggggcaggtaaggggatgagaatccctcaccctatggccctgtagcgccggacactggcacagacatcatcccagaggcacatgctctgcctgagagaagacagccattgagcagccagcatcccaccaaagctgcctcctcagtgggagaatccagtgctagggacagggmccatggctaattcctttaggtatgacctgtctactacatgcctagagtccattcatctgt

SEQ ID NO: 17226 - DNA, 238 bp, Homo sapiens
atttccactcaggcccttttcaaacccatgtttcaattttgcaggtagtcagtatttgtcagcacccctgtaagcaggtggctgtcctggcttggtaggggagggactaacagagacccacatcccaggacgccgcccgtcaggctcccaggacactgccccaagcacccagcttcagtgggtgtgctgccccgagacgcactctcactgtgccggggggtgggacctctgcagccca

SEQ ID NO: 17227 - DNA, 144 bp, Homo sapiens
agagagctgaaatcaaacttatggatttactcaatggttttattcaatggtatagaatatgataactcagtggagggtcggggggagtgtggggagtggctggggaagggagcctgaagtgagttaacttattttccccgggca

SEQ ID NO: 17228 - DNA, 171 bp, Homo sapiens
gttttctttttttaaattattatactttgagttttgggatacatgtgcagaacgttgcaggtttgttacataggtatacacgtgccatggtggtttgcaactcatcatctacattagacatttcttgtaatgctattcctctcctagtcccccaccccctgacaggcccct

SEQ ID NO: 17229 - DNA, 134 bp, Homo sapiens
ttttagagacggtcttggtctgtcaccaaggccagagtgcagtgttgcaatcatagctcactgaggcctcaaactcttgggcccaggggatccttttgcctcagcctcccaaatggttggaactacaggcacca

SEQ ID NO: 17230 - DNA, 364 bp, Homo sapiens
  misc_feature 241: s=g or c
tcttgtgttgattctgttctcagggacacacattcttgcaggtggcacagtggcggccgcaatgtctgctttcgaccctccaatcaggctcactctgaggcagatgtaattgtgtggctgcaaaggcagagagccacacttgtatgatgcaacattctcttttctttccttttttagagtcaggatctcattctgttgcccaggctggagtgcagtggcatgatcatggctcactgcagtstcaaactgctgggctcaagcaatcctcctgcctcagcctcccgagtaggtgggtgtattagtctgttgtcacactgttataaagaactgctcaagattgggcagtttataaagaaaagaggag

SEQ ID NO: 17231 - DNA, 248 bp, Homo sapiens
gtatccttgtgattttgtttaatgtgtttctttaccctctctatttttggtaaactggtagtgcttgaataaattcaagtttaaattttttgccaagaaagctttataggtaatgctttgtacttctgtttaatcacatcagagtcatgtaaggtctgcctgtctattttagtcagtcatgttaataatctgtgggctcaggtggtatcagtctgatccatctgttacacaggtcactcaagaaccta

SEQ ID NO: 17232 - DNA, 177 bp, Homo sapiens
aaattagctgggtgtggtggcagatgcctgtaatcccagctattcaggaggctgaggcaggagaatcgcttgaacctgggacgcggaggttgtagtgagctgagatcatgccactgcactccagcctgggtgacagagtgagacgtcatctcaaaaaaaaaaaaaaaaaaaaaaaaa

SEQ ID NO: 17233 - DNA, 168 bp, Homo sapiens
actctgtctcaaaaaaataataaaataaaataaataaaaaatcagacatgacataggtcctcaaaaagcgttgttgaattaatttgcttttcatctccttttattcatttttctttatttttctccacctcctgttttaattttttttagaaactgggcctcactctt

SEQ ID NO: 17234 - DNA, 183 bp, Homo sapiens
  misc_feature 121: b=c or g or t
ctgtccctttgccactagtactactgctgcctgtcctcttaaccactgtgaggggtctaaaaccagctgcaaccaagtatctatgtatggaaactgatctgggtgtcctgatttaccagtbactttgtgccatacctttgaaactagggacctgtctaggcttccttctgatggccatcccac

SEQ ID NO: 17235 - DNA, 114 bp, Homo sapiens
gaggcaggagaatcacttgaacctgagaggtggaggttgcggtgagctaagaacatgccatcgcactccagcctggatgacaagagtgaaactccatctcaaaaaaaaaaaaaa

SEQ ID NO: 17236 - DNA, 62 bp, Homo sapiens
ctgtgatttagcttctcctcaagagctgattatgttgatgcaactcatgccattgaggagaa

SEQ ID NO: 17237 - DNA, 184 bp, Homo sapiens
  misc_feature 63: d=a or g or t
caagacattgaaagaggtgagggcatattcaccttttggatatttctgggaagaggaacagcdagtgcaaatgctctgaattgagcacgtgccaggagcggtcaagaagctagagggagaccagtgtacatggagtggcggtagtagatggagtaggccaggcttcagtcctctagattatgtg

SEQ ID NO: 17238 - DNA, 206 bp, Homo sapiens
cacttggttagacagagtaaggttgtgaatttgatctctgtgtttaatgaatgactttatgccttttggggctctgctatagtaactaaaatagaataaaccacatcctttttcttcagaagtttatagtgttagagactgggtgtcaaatgccagcagatgtaattaagacaatttagagacaaggagatttcagagtgggctga

SEQ ID NO: 17239 - DNA, 208 bp, Homo sapiens
ttaattgctgtcaatgtttaagatttgggctgggcgcggtggctcacgcctgtaatcccagcactttgggaggccgaggcaggcagatcgtgaggtcaggagatcaagaccatcctggccaacacggtgaaaccccgtctctactaaaaatacaaaaaattggctgggcgtggtggcgggtgcctgtaatcccagctactcgggaggc

SEQ ID NO: 17240 - DNA, 78 bp, Homo sapiens
aagactatactttcagggatcatttctatagtgtgttactagagaagtttctctgaacgtgtagagcaccaaaaacca

SEQ ID NO: 17241 - DNA, 243 bp, Homo sapiens
  misc_feature 23: y=c or t
aactttttttttcaagacggagytcactctgtcgcccgggctggagtgcagtggcgtgatctcggctcactgcaacctccgcctcccaggttcaagcgattctcctgactcagtgtctcgagtagctgggattacaggtgcccgccaccacgcccagctcatttttatatttttaggagagacggggtatcattatgttggccagtctggtctcgaactcctgacctcaggtgatccgcccaa

SEQ ID NO: 17242 - DNA, 211 bp, Homo sapiens
  misc_feature 1: v=a or c or g
  misc_feature 157: r=a or g
  misc_feature 158: k=g or t
  misc_feature 210: y=c or t
vcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacrkgtaggtagtataagtcggtgattaagaacatggactctgaagtcagactgcyc

SEQ ID NO: 17243 - DNA, 145 bp, Homo sapiens
taaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagt

SEQ ID NO: 17244 - DNA, 263 bp, Homo sapiens
  misc_feature 131: h=a or c or t
  misc_feature 196: h=a or c or t
ataaaggtggcttgctccattgatttttgtctgctcattgggaaagtctgctaatcaccatgattaagttccttaacagaaatgtcacttattttattcatctattcctaaagaaatgaagttttttttthcttttttcctagaagagtcagaacactttcagagcctaatttttttccggcaacacaagggtgthatttccttggatgagtctaagcaaaaattataaaacaagtgactgccacattccatctctgtgtccc

SEQ ID NO: 17245 - DNA, 119 bp, Homo sapiens
tgggactataggcacccatcaccatgcccggctaactttttgtattttttgtagagacggggttttaccgtgttagccaggatggtcttgatctcctgacctcgtgatctgcccgcctc

SEQ ID NO: 17246 - DNA, 275 bp, Homo sapiens
tttcctccacagcagcatttctgagttagtcactgttatccctctagacagttttatgtgtctattaaacatatattcaaactttttgaataaataggtttttgtttgactcaaaaaataatacgtttcttgtttttttgtgtatttttgagacggagttttactcttgttgcccaggctgtagtgcaatggtgcaatctcggctcactgcaacctctgcctcccgggttcaagcaattctcctgcctcagcctcccaagtagctgggcgtggtg

SEQ ID NO: 17247 - DNA, 189 bp, Homo sapiens
tattttatatttctaagcatataaagaagaggatattccagatgcagtgctcttcaaagttttctaaaaaatttgctctgcaaaaattaatgtgtcattggttacattcaaatagttttttaaaaaatctgcgaaatatgtatacttatggatttagagtaacttctgtaatttccacataggtcccca

SEQ ID NO: 17248 - DNA, 96 bp, Homo sapiens
ctttataggtgaagttgtgtttcttttaggcagaatatagttggggcttgtttctttatccattcagccactctgtgccttttaattggagaatgt

SEQ ID NO: 17249 - DNA, 77 bp, Homo sapiens
  misc_feature 29: h=a or c or t
  misc_feature 55: r=a or g
aatttaaatccatatgtcacatagcagthttgagagctcaaaagaaaggagagartaaatgagaatgagggtgtgat

SEQ ID NO: 17250 - DNA, 204 bp, Homo sapiens
gtaacactaatagctgactagctaagtgcctgtcggctccttggcagaggagttgattgtgttttcggctggatactaaatccaaaaactatgtaaaaatgtcaataggtgagtgcacattgattttggttagtcacagtgatatttgagcccctttggggactctgtctggggaagtattttacaagaaagataatataacat

SEQ ID NO: 17251 - DNA, 103 bp, Homo sapiens
tatttattgaggagtgctgggtactaggccattagaagaacaaacaacaacaacataggcctggaccttgcacttgcagagttcacaggctagagaggcgcct

SEQ ID NO: 17252 - DNA, 207 bp, Homo sapiens
  misc_feature 87: m=a or c
caacatgaacagacacttttcaaaagaagacacacacggtcaacacgcatatgaaaaaaatgctcaagatcactaatcatcagagamatgcaaatcaaaaccacagtgagataccatctcgcattagtcagaatggctattactaaaaagtcaaaaaataacagatgctggcaaggttgcagagaaaaaggaaggcatatacactgc

SEQ ID NO: 17253 - DNA, 243 bp, Homo sapiens
aaatgagatgaagaaaagtgcttggttggctgggtatggtggctcatgcgtgtaatctcagctactcaagactgagacaggaggatcgcttgagcccaggaggttggggctgtagtgaaccatgatcatgccactgcactccagctgggcaagagtgagaccctgtctcaaacaaaacaaaacaaaacaaacaaaaaagaaaactgcctggtgcagatccaattagattcctccccctcccac

SEQ ID NO: 17254 - DNA, 331 bp, Homo sapiens
  misc_feature 170: k=g or t
  misc_feature 204: d=a or g or t
agatcacattcaagaacgtgccatgaagtgggaatgaacatggactattggaggaaatgaaagaagccagtgtggctggaatgtcaggataggtggaccacggtaagagtttagatttttagtgaaatataaagtcactggaggatttttttcccaattatttgtgattktttttctcttttttttattattattatactttadgttttagggtacatgtgcacaatgtgcaggttagttacacatgtatacatgtgccatgctggtgtgctgcacccattaactcgtcatttagcattaggtatatctcctaaagctatccctccccccc

SEQ ID NO: 17255 - DNA, 207 bp, Homo sapiens
gtcaaggagattcttcttgcaatgcagggacccgtctggtcaatggcaggcctgaagaacaaacctgcaagctgggcatggtggctgacgcctataatccgagcactttgggaggccaaggcgggtggatcccaaggtcaggagatcgagaccatcctggctaacacggtgaaaccgtgttagccaagatggtctccatctcctgac

SEQ ID NO: 17256 - DNA, 119 bp, Homo sapiens
  misc_feature 27: m=a or c
  misc_feature 28: m=a or c
tgggactataggcacccatcaccatgmmcggctaactttttgtattttttgtagagacggggttttaccgtgttagccaggatggtcttgatctcctgacctcgtgatctgcccgcctc

SEQ ID NO: 17257 - DNA, 161 bp, Homo sapiens
  misc_feature 6: r=a or g
  misc_feature 18: w=a or t
  misc_feature 91: y=c or t
  misc_feature 131: b=c or g or t
  misc_feature 161: n=a, g, c or t
tgtgtrtagctgggtttwatgaccaccctcgtgcggcccggcacgcccgcacgtcccgccaccccctcccttgggtgtgtgtctctcagcyccctgcacaccgttccctatgtctgtggcccgcgtgcctbtgtgcgcgtgtgctccccccagcgccaggn

SEQ ID NO: 17258 - DNA, 112 bp, Homo sapiens
gtatagtggcatgatctcagctcactgcaacctccatctcctgggttcaggcaattctcctgcctcagcctcccaagtagttgggactacaggcatgtgccaccacgccctc

SEQ ID NO: 17259 - DNA, 169 bp, Homo sapiens
  misc_feature 3: y=c or t
  misc_feature 14: k=g or t
  misc_feature 17: s=g or c
  misc_feature 82: w=a or t
  misc_feature 83: m=a or c
  misc_feature 147: s=g or c
  misc_feature 148: k=g or t
  misc_feature 169: r=a or g
tgyggcgaatatcktcscttacaagggttatatatggaattatggtaccctccctcagattctttcttgtggagaagttatwmatgtgaagatccttggaattttggctcttattgatgaaggtgaaacagattggaaattaattgskatcaatgcaaatcccctgaar

SEQ ID NO: 17260 - DNA, 167 bp, Homo sapiens
cctgcctcagcctctcgactaactgggactacaggcatgcatcaccatgcctggtctagattggaaattttttttaaatgatcctttaccacatttgagaagcactgatgtaggcagagggaaaaagtgcaagctcaaagggttggagaagtgagatagtggcatct

SEQ ID NO: 17261 - DNA, 87 bp, Homo sapiens
aagtctgcgccgccaggtaaggcggggtggcccttgcgtctcccgcttccttgaaaaacccggcgggcgagcgaggctgcgggcgct

SEQ ID NO: 17262 - DNA, 86 bp, Homo sapiens
agcttctggctgggaagtggcaggaactagagtggccgcctcagacccacagcagaaggtacatgttgagaaagggctgcccccca

SEQ ID NO: 17263 - DNA, 124 bp, Homo sapiens
taattttttttgtatttttaatggcgacagggtttcaccatgttagccaggatggtctcgatctcctgacctcgtgatcccaaagtgctgggattacaggcgtgagccaccatacccgtcacca

SEQ ID NO: 17264 - DNA, 262 bp, Homo sapiens
tgtagtaatttcccaatttgatttttctctataattttatagcctcttgcaggtggatcacctgaggtcaggagttcgagaccagccaggctaacatggtgaaaccctgtctgtactaaaaatacaaaattagcaggtgtggtggcgggcgcctgtagtcccagctactcaggaggctgaggcaggagaatggcgtgaacctgggaggcggactgcagtgagctgagatcgcgccactgcactccagcctgggggacagagc

SEQ ID NO: 17265 - DNA, 94 bp, Homo sapiens
  misc_feature 7: s=g or c
caggaascaattgagactttggaaccctgctagtatttctcttgcctacaaagaagacactgaggagctaccaaggagcacaaaaaaaaaaaaa

SEQ ID NO: 17266 - DNA, 382 bp, Homo sapiens
  misc_feature 53: w=a or t
  misc_feature 121: s=g or c
ccttttgagttcttgctaacatcagttaggctcatactgttgggcatgtgtgwgtgtgcgggggggtttatttatttttttatttgagacggagtcttactctgttgcccaggctggagtscagtggcgtgatcttggctcactacaatctccgcctcccgggttcaagtgattctcctgtctcagcctcccaagtagctgggattacaggtgcccaccactatgcccagctaattttgtatttttagtagagacggggtttcaccatattgatcaggctggtctcgaactcctgacttcaggtgatccacccgcctcggcctcccaaagtgctgggattataggcgtgagcaccatgcctggccgtttcttttttcttttt

SEQ ID NO: 17267 - DNA, 110 bp, Homo sapiens
  misc_feature 77: s=g or c
gaaacggggcaaagcagactgcgcagtctgcagtcttcgtggcgggccaagcgagcttggagcccgcgggggcggasggtgagagcggccgccaagagagatcacaccct

SEQ ID NO: 17268 - DNA, 152 bp, Homo sapiens
ttagcaacagtgacccagaaaattttgagaagtccaatttcaccagaagaggcccagggctccctgtggtcacattttctacccagccattcttggcattgcaacctccattttctagctccagttgaattttctccacccagaccccgcct

SEQ ID NO: 17269 - DNA, 145 bp, Homo sapiens
tgaactactgaaaaatgtccttatttgttggagatgcatgtaaggtattttggggtaaaatgttaagatttctgtaactttcaaatggttccacaaataaaatcttaggtaaacaaaagaaaatgtatgaaaatgttaacagtta

SEQ ID NO: 17270 - DNA, 63 bp, Homo sapiens
atgtcactctgggagggagacagcagcaactaagctgtacaaggttttttttttttttttttt

SEQ ID NO: 17271 - DNA, 273 bp, Homo sapiens
  misc_feature 120: w=a or t
gggattgaggttcctttttctttgtacgtttaccagttgtttccacactgtttatagaaaagacttttatatgcattgaattatgttgatgccaaaggcttcattttgtctttgtttttwaattaatattttatttatttatttttttttagagacagggtctcgctttttcgtccaggctggagtgcattggcacgatcatagctctctacatcctagaaagtcaaagtctaaaatatctaatataagaacataaaaatctaggtcattttt

SEQ ID NO: 17272 - DNA, 209 bp, Homo sapiens
  misc_feature 76: k=g or t
  misc_feature 120: m=a or c
tttcttttatttattattcatattttttgagacacagtctctctctgtcacccaagctggagtgcagtggcgtgakctgtcatctctgctcactgcatcctccacctcctgggtttaaamcaactctcgtgcctcagcctcccgagtagctgggattagaggcacatgccaccatgcctggctaatttttttttctttttttttttttt

SEQ ID NO: 17273 - DNA, 182 bp, Homo sapiens
  misc_feature 75: w=a or t
taataaaaacattccagaggcccggcacagtggttcacacctgtaatcccagcactgtgggaggccgagacagtwggatcacgaggtcaggagatcgagatcatcctggctaacatggtgagaccccgtctctactaaaaacacaaaaaattagccgggtgtggtgatgggcgcctgtagtc

SEQ ID NO: 17274 - DNA, 87 bp, Homo sapiens
cagaggttgcagtgagctgagatcatgccactccactccagcctgggcgacagagcaagactccatctccaaaaaaaaaaaaaaaaa

SEQ ID NO: 17275 - DNA, 111 bp, Homo sapiens
aggattgaggtcaacctcctcctcgttttaggacacagagtgtggtgtggtgtgttgacttgctaaggtcacctagctggtcatcagctcagtgaggaccagaggccagac

SEQ ID NO: 17276 - DNA, 259 bp, Homo sapiens
  misc_feature 189: w=a or t
agaactagagaagcaagagcaaacacattcaaaagctagcagaaggcaagacataactaagatcagagcagaactgaaggagatagagacacaaaaaacccttcaaaaaaatcaatggaaatccaggagctggttttttgaaaagatcatcaaaattgatagaccactagcaagactaataaagaagawaagagagaagaatcaaatagatgcaataaaaaatgataaaggggatatcaccaccgatcccacagaaata

SEQ ID NO: 17277 - DNA, 132 bp, Homo sapiens
tttgagaatcatggtaaaaataacttgtatttgccttaccatcatgatcctactgttgagttaggaaaatatggttagacagactcacattactttttttcagaggtaaactctagattactgtgccaaccc

SEQ ID NO: 17278 - DNA, 130 bp, Homo sapiens
attaacagcatcccaaggcagaagaatttttcttagtacagaacaaaatggagtctcctatgtctacttctttctacacagacacagtaacaatctgatctctctttcttttccccacatttccccccga

SEQ ID NO: 17279 - DNA, 137 bp, Homo sapiens
gatcctcccaccttggtctcccagagtgctgggattactgacatgagccacagaataatctttgtgtgtcccacctccatccctccatcctttttattctgcctgtttgaacattttctgtattccccttttttttt

SEQ ID NO: 17280 - DNA, 203 bp, Homo sapiens
tatggctgaatagtattccgtggtatatatttaccacaatttctttatttactcattgattgatggacatttgggctggttccatatttttgcaattgtgaattgtgctgctataaacatgcgtgtgcaaatatctttttcatataatgacttcttttcccacccaagagtgggattgctggatcaaatggtagatctacttt

SEQ ID NO: 17281 - DNA, 251 bp, Homo sapiens
  misc_feature 235: w=a or t
cttcctagcagtgatggtctttacaatttggcatgtttgtgcagtggctggtaccagttgttccttttcatatttagtgcttccttcaggaactcttgtaaggctggcctggtggtgacaaaaaatctctcagcatttgcttgtctgtaaaggattttatatctccttcacttatgaagcttcgtttggctggatatgaaattctgggatgaaaattcttttctttaagaatgtwgaatattggccccttc

SEQ ID NO: 17282 - DNA, 245 bp, Homo sapiens
ggaagccaaaatattccttcttagactgaaaaaatgtgctttggtgccatgcttatttggctaaagccagaaaaatctgtctttaaatgaagtatataattcctgccatcatctgacaaggggtggataatgcagctggggaaataaatcacagaatattggtatagataggagtgtactggaggatttgattcacttccagtatttcattaatttgtatttggaagtttaaatacccggccaca

SEQ ID NO: 17283 - DNA, 72 bp, Homo sapiens
caaatgctgctaagattcccttttctgtcctcggagtcaaatgaagagagtttaattctttttttttttttt

SEQ ID NO: 17284 - DNA, 107 bp, Homo sapiens
agattgagtatcccttatctgaaatgcctgggacctgaagtattttggatttcagacttcttttcagattttggaatatttgcattatatttactgattgggcaccc

SEQ ID NO: 17285 - DNA, 372 bp, Homo sapiens
  misc_feature 253: n=a, g, c or t
  misc_feature 254: n=a, g, c or t
  misc_feature 255: n=a, g, c or t
  misc_feature 329: m=a or c
  misc_feature 371: m=a or c
  misc_feature 372: r=a or g
catacattaacaaattgtaaatattttcattacagaaaatgatagccaggcgtagtggctcatgcctgtaatcccagcactttgggaggctgaggcaggtggatcacctgaggtcgggagtttgagaccagcctgaccaatatggagaaaccccgtctctactaaaaatacaaaattagccgggcgtggtggcacatgcctgtaatcccaggtattccggaggctgagggaggagaatcgctagaacctggannngcagaggttgcagtgaactgagatggcacctttgcactccagcctgagcaacaaggcgaaactcctacctcagmcgtctgcatagctgggaccacaggcatgcactatcacacccmr

SEQ ID NO: 17286 - DNA, 292 bp, Homo sapiens
ttttttagtagagacagcttttcaccatgttggtcaggctgctctcgaactcctgacctcaggtgatccacaggccttggacctccaaagtgctgggattacaggggtggatgtccttactcttaagaacaatggtttctatgcactcaggaccttctgataacttgtttcaggcaaaagaaacccaaatgtgatggatggacatatatgatttttgatacactgcatccattctctgttctttggataatttttccttgttctcttgtaggaaatcacccttacccactcc

SEQ ID NO: 17287 - DNA, 325 bp, Homo sapiens
  misc_feature 256: k=g or t
  misc_feature 306: m=a or c
aaagagatgaaaatgcctgcctggaagataactatgatcctttttctcactagggtgattttatgtttatttatgtacttacattttagagatggggtcttgttctgtcgcccaggctggagtacagtatcatagttcccttgaagccccaaactactggactcaagcagccctctcgcctcagcctcccaaataactgggggactgtaggcatatgccaccatgctcagctaattaaaaaaaaattttttttttkggagaccggtcttactatgttgcccaggttggtctcaaactcctggcctmaaacgatgcccctgcccat

SEQ ID NO: 17288 - DNA, 177 bp, Homo sapiens
  misc_feature 3: w=a or t
  misc_feature 4: w=a or t
  misc_feature 137: k=g or t
  misc_feature 138: y=c or t
  misc_feature 139: w=a or t
tawwcataaatctcaattcatttgggtaaatatcaaggagtgcaattactggatcatatggtaagagtatgtttagttttgtaagaaaatgccaaaccatcttccacagtggctacaccattttgctttcctaccakywatgaatgagagctcctgttgctccacatcctcgccaaa

SEQ ID NO: 17289 - DNA, 220 bp, Homo sapiens
  misc_feature 3: d=a or g or t
  misc_feature 73: s=g or c
cadaggtcaggatacagccacagtgggattgtttgacgggcaagtggatctgcctccaatggggcacagagtscaagaacagggagggctttgaactacagagtcaagggcagaggtaacatggtgaaaagagggggattaagtatgtccactgctgactaagacctccagctgtccttccttagttggcttccaaaaaagtagcagctaggccttcact

SEQ ID NO: 17290 - DNA, 114 bp, Homo sapiens
gacgggttttgccatgttggacaggttggtcttgaactcctgatgtcaggtgatccacccatctcggcctcccaaagtgctgggattacaggtgtgagccaccatccccgcact

SEQ ID NO: 17291 - DNA, 140 bp, Homo sapiens
ctccacagcatctattgtttcctgactttttaataatcaccattctgactggcgtgagatggtatctcattgtggtttcgatttgcatttctgtgatgatcagtgatgttgagctttttttcatatgtttggtggctgca

SEQ ID NO: 17292 - DNA, 122 bp, Homo sapiens
ttttgggttttttttggagacagggtcttgctctgttgcctggactggagtgcagtggtgcaatcacacctgattgcaacctctgcctgctgggctaaagcaatcctcccacctcagcccga

SEQ ID NO: 17293 - DNA, 101 bp, Homo sapiens
  misc_feature 79: s=g or c
  misc_feature 80: s=g or c
tagccaggatggtctggatctcctgaccacgtgatccacccacctcagcctcccaaagtgctgacattacaggcgtgassactacagccggcccccaagcc

SEQ ID NO: 17294 - DNA, 229 bp, Homo sapiens
caataacattatctcatttaaaaaataagaataattatttaatattatctggacatatttgtataccaactgtcctataaacttttaaaagtaaaatttaaacttaaatcatacaatcatttaaacaatcattaaacttttgtttaaatttggatcaaatgtggttcatacaatgattgtctcttaaatctcttttataggctcctcctctgtcttttttccccaccta

SEQ ID NO: 17295 - DNA, 197 bp, Homo sapiens
  misc_feature 197: m=a or c
ctcttctgtttacactaactccttagttgattttaactagaattgtggctttaatacagttcagatgctaatgaactcagaaatgtatatttccaggccagactctcaatttaaactctggagtttatctcttgttacttatttcaatggctaatacatatcacttaatttcttgatatttcaacccccaacccagm

SEQ ID NO: 17296 - DNA, 272 bp, Homo sapiens
  misc_feature 251: y=c or t
  misc_feature 252: n=a, g, c or t
  misc_feature 253: h=a or c or t
ctgttgcccaggctggagtgcagtggcgcgatctcagctcacttcaacctctgcctcccggcttcaagcgattctcctgcctcagcctcctgagtagctgggattacaggcgcctgccaccacacccggctaatttttgagtttgttgttgttattatttttttttgagatggagtcttgctctgttgcccaggctggagtgcagtggtgcagtctcggctcactgcaagctctgcctcccgggttcacgynhttctcctgcctcagcctcc

SEQ ID NO: 17297 - DNA, 86 bp, Homo sapiens
atacaaaaattagccgttcttggtggcacatgcctgtgatcccagctgctcgggaggctgaggcgggagacttgcttgaacgcgag

SEQ ID NO: 17298 - DNA, 296 bp, Homo sapiens
ggaatgcttccagcttttggccattcagtatattagctgcaggtttgtcataaatagcgcttattattttgagatatgtttcatcaatacctagtttactgaaagtttttaacatgaaggaatgatgaattttatcaaaggccttttctgcatctatcgagataatcatgaggtttttgtcattggttatattaatgtgattgattttgtttattgatttgcatatgttgaaccagccttgcatcccagaaatgaggctgacttgatcatggtggataaacttttgatgtgctgct

SEQ ID NO: 17299 - DNA, 432 bp, Homo sapiens
  misc_feature 366: m=a or c
ccaatttgccaggctcaaaactctgaagttttttctgcctcttcctttttttgagacaggatcccctctgtcactcaagctgaattacagtggtgcaaccatggctcactgcagcttcaacatcctgaacctcttattattttgagatatgtgcaccaatacctagtttattgagtgtttttagcatgaagggtgttgaattttatggaaggttttttctgcatctattgagataatcaagtgatttttgtcattggttctgtgtatatgatggattatgtttattgatttgcatatattaaaccaaccttgcatcccacggatgaagctgacttgatcttgggggatacgtttttgatatgctgmtagatgtggtttgccagtattttattgaggatattcacttcgatgttcatcaggcggtattggcct

SEQ ID NO: 17300 - DNA, 267 bp, Homo sapiens
  misc_feature 82: r=a or g
  misc_feature 84: s=g or c
  misc_feature 104: s=g or c
  misc_feature 111: r=a or g
  misc_feature 119: y=c or t
  misc_feature 132: w=a or t
  misc_feature 140: w=a or t
  misc_feature 155: y=c or t
  misc_feature 176: s=g or c
  misc_feature 218: k=g or t
  misc_feature 220: w=a or t
  misc_feature 231: y=c or t
  misc_feature 252: y=c or t
  misc_feature 264: w=a or t
gatcgcaccactgcactccggcctgggcgacagagccagactccgtctcaaaaaaaaaagagaaacagtgtctttgggggarasccaggtgttggtgaaggcascgtttgragtgcatyctgtgaagaagtwaagagtgwagtggtgtttggttycttgtagcaagagtcctagascagtggtccccaacttttttggcaccagggaccggttttgtkgwagacagttttycaatgggactgggagggtgtycgggggagggcwagt

SEQ ID NO: 17301 - DNA, 354 bp, Homo sapiens
  misc_feature 294: s=g or c
tgttctttgatcctcatcattagcttcagggggtacatgctgtgattcttcccattttacagacaagaaactgagcccgctgggcgcggtggctcacgcctgtaatcccagcactttgggaggccaaggcgggtggatcacgaggtcaggagatcgagaccatcctgactaacatggtgaaatcccgtccctactaacaatacaaaaaattagccgggcatggtggcgcgtgcctgtagtcccagctactcgggaggctgaggcaggagaatggcgtgaacccgggaggcggasttgcagtgagccgagattgcgccactgcgctccagcctgggcgacagagcaagactccgt

SEQ ID NO: 17302 - DNA, 154 bp, Homo sapiens
tgttcaaattaatgaacctgcactgacatatcatagtcacccaattctatcttcaaatattcttcttcccctttctttctcttctctcctttggagaccccaatatgcatgtgtttgtatgcttcatggtgtccctatgtttctgagggccatc

SEQ ID NO: 17303 - DNA, 301 bp, Homo sapiens
  misc_feature 297: s=g or c
atgttacactgacaggaaagttgcagaagtcgtggagaatgtttcgacgcaccctccgccagctttcccgagggtaacgtcttgtgagcccgtgtacagttatcagaagctgtaaggcctgggtgcagcaggcgcgggtcctgactgcgttcaggtcttgccggctctcccactgagctcctttttctgtgccaggatctggcctgggatccccatggcgtttggtggccctgtcctgccctgcactctgggacaggagagaatctgctcctcggtctctcctgtcgtcgtgacccsggcc

SEQ ID NO: 17304 - DNA, 108 bp, Homo sapiens
gcctcccaggtttaagctattctcctgcctcagcctcctgactagctgggattacaggcgcccggcaccatgcctggctaattttttgtgggtttttttttttttttt

SEQ ID NO: 17305 - DNA, 235 bp, Homo sapiens
aatgtagatatttgctcattttacagaagaggaaactaaatttagttaactgacttgcgcaaaggcacataggaagtggcactttaaaactttccaactcaggctgggcgtggtggctcacgcctgtaatcccagcactttgggtgggcaaggcgggcggatcgcttgaggtcaggagttcgagacgagccttgccaacatggtgaaacacgatgtctgctaaaaaaaaaaaaaa

SEQ ID NO: 17306 - DNA, 158 bp, Homo sapiens
accacctgttctcaagcaattctcccatgtcagcctcccaagtagctgggactgcagggacataccagcatgtctggctaatatttttaatcttttgtagagacagggtctccctttgtcacccaggctggagtggctcactgctgcctcaacctgtt

SEQ ID NO: 17307 - DNA, 221 bp, Homo sapiens
tgatgccgagctttttttcatgtttgttggccacataaatgtcttcttttgagaagtgtctgttcatatccttcacccactttttgatagggttgttctttttttttcttgtaaatatgtttaagttctttgtagattctgaatattagccctttgtcagatggatacattgcaaaagttttctcccattctgtaggttgcctgttcactctgatgatagt

SEQ ID NO: 17308 - DNA, 80 bp, Homo sapiens
tggagctgaaatcccttccattcttctatttctgttggcatatattgggatattgtttttggtttttttttttttttttt

SEQ ID NO: 17309 - DNA, 186 bp, Homo sapiens
tgcaacctctgcctcccagattcaagcaattctcccgcctcagccacctgagtagctgggattgcaggtgcccaccactacacccagctaatttttgtatttttagtagagacggggtttcaccatgttagtcaggctggtcttgaactcctgaactcaggtgatccacccacctcggcctcccaa

SEQ ID NO: 17310 - DNA, 115 bp, Homo sapiens
ttgtatttacttatttttatttttattgtttttgagacagggtcttgctctgtcacccaggctggagtgcaatggtgtgatcacacctcactgcagcctcaacctcccaggctca

SEQ ID NO: 17311 - DNA, 259 bp, Homo sapiens
agcactttgggaggctgaggcaggccgatcacctgaggtcaggagtcccagaccagcctggtcaacatggtgaaaccctgtctctactaaaaatacaaaaattagcgaagtatagtggcgcgcgcctgtaatcccagctactccagaggctgaggcaggagaatcacttgaaccccggaggcagaagttgcagtgagccaaaatcgtgccactgcactccagcctgggcaacagagcaagactttgaccctcccctcac

SEQ ID NO: 17312 - DNA, 138 bp, Homo sapiens
gcaaatttttgtatttttagtagagatggggtttcaccatgttggccagactagtctggaactactgacctcaggtgatctgtgtgtcttggtcttccaacgtgctgggattataggcatgaaccaacccccccacca

SEQ ID NO: 17313 - DNA, 187 bp, Homo sapiens
gcattttcaaaccctctgaatctcaatttgcacatgtaagtacttgggtacataggagctgcttaataaataatcttgaatgaataaacatgacagtaacgtcagtctctcagggttgtacttgcagttttccaaatcattctcttcctctcaaccatgcttttgtatattctatattctgtcgccg

SEQ ID NO: 17314 - DNA, 94 bp, Homo sapiens
ccatgttccactaatttttgtatttttagtagagatggggtttcaccatgttagccaggctggtcttgaactcctgacttcatgtgatctgccc

SEQ ID NO: 17315 - DNA, 160 bp, Homo sapiens
gttctagaaatttgaatatggttctttttattaattttattttttattttttgatatgtagagacagggtttcactatgtttcccaggctgctctcaaactcctggacttaagggatcttcctgcctcagcctcccaaagtgctgggattacaggtgtga

SEQ ID NO: 17316 - DNA, 79 bp, Homo sapiens
cattgagccacatatttttatcatcagatttcctgcaaatcccttttgcctatttctttaaaaaaaaaaaaaaaaaaaa

SEQ ID NO: 17317 - DNA, 229 bp, Homo sapiens
aaacaagacaccatctctacaaatataagtaaacaaaattagccgggcatggtggcccgctcctgcagtcccagctattcgggaggctgaggtgggaggattaaaaaacaaacagaaagaaaaaaatgcacagtgcagagagtgggagcaatgccaaggtagaaggcatgcactagtactctctgacttgggagtactagggagggtccctggccaggttgggggaggt

SEQ ID NO: 17318 - DNA, 233 bp, Homo sapiens
aacccgagtacaatggaatggaatggaatggaatggaatggaatggaatggaatggaatgccttcaaaccgaatggaatggaaaggaatggaatcaacacgagtggaaaggaatggaatggaatggaatggaatggaatgatacggaatagaatggaatggaacgaaatggaatggaatggaatggaatggaatggaatggaatggaattgttccgagtggaataggagagaa

SEQ ID NO: 17319 - DNA, 65 bp, Homo sapiens
aaaagaaacggatttttcatagagtgaaaaggtctataacttaaggttcactttttttttttttt

SEQ ID NO: 17320 - DNA, 410 bp, Homo sapiens
gctggagtgcagtggcgtgctcttggctcaccgctacatctgcctcccaggttcaagtgagtctcctgcctcagactcctgagtagctgggattacaggcacacaccaccacacttagatggtttttgtatttttagtagagatgtggtttcaccatattggccaggttggtctcgaactgctgacctcaggtgatccacccactttgatctcccaaagtgctgggattataggcatgagccaccgcgcccagcctcattttaataaattaataaattctgctctctctggaggtctagacctttgagaaggcttaaaacaaaaaaggaggccaggcatggggctcacgcctgtaatcccagcactttgggaggcaaggactgcacccagcctggcctcttttttttttt

SEQ ID NO: 17321 - DNA, 272 bp, Homo sapiens
cctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaaga

SEQ ID NO: 17322 - DNA, 469 bp, Homo sapiens
  misc_feature 341: n=a, g, c or t
  misc_feature 452: w=a or t
atgatttcttcttatttgaattttttgagactcattttgtgacctatgatacattatattctggggaatgttccctgtgctgattgaaagaatgtgttctgcagttgacgggtgaagtgttctgtgaatgtcaaataagtctattaggtcttgagtgtagtttaactctgaggtttctttgttggctctatgtttggttgatctgtccactactgagtgcagtgttgaaatcccctactagtactaattgcctactgtgtggcaatctacctctcccttggtagatctgtttgctttatatacttgggtgctccgatgttgggtgcatagatatttatagntgttatatcctcttgctgaattgacccctttatcattatatattgaccttctttatctctttttacggtttttgactagtagtctattttatctgttataaatatcgctawtcttgatcttttttagt

SEQ ID NO: 17323 - DNA, 124 bp, Homo sapiens
ggctggtctcgaactcctgacctcaagtgatctgcccacctctgcctcccaaagtgctgggattacaggcgtgagcactgtgcccagctgaaagtttctacatgcttctttggaacccatccct

SEQ ID NO: 17324 - DNA, 81 bp, Homo sapiens
tacaaataaaagatgttacaaaaataaaaaaaaaaaaaaaaaaaaaaaaaaaaaaaaaaaaaaaaaaaaaaaaaaaaaaaa

SEQ ID NO: 17325 - DNA, 61 bp, Homo sapiens
tccaaggcagttctgcgtatctcccaagatcctgcctctgccttttttttttttttttttt

SEQ ID NO: 17326 - DNA, 100 bp, Homo sapiens
  misc_feature 49: y=c or t
  misc_feature 53: w=a or t
  misc_feature 58: w=a or t
  misc_feature 62: k=g or t
  misc_feature 70: k=g or t
  misc_feature 74: k=g or t
  misc_feature 86: k=g or t
agtcttttatttcaggattatttcttagaatttatatgttttttttttycagwacttwattkgttttttkgttkgtttcctttttkggaatttttttttt

SEQ ID NO: 17327 - DNA, 138 bp, Homo sapiens
gctaatttttgtatttttagtaaacatggggtttcatcatgttggccaggctggtctcaaactcctaaccacatgatccacccacctcggcttcccaaaatgctgggattacaggtgtaagccaccgcgcccggccaa

SEQ ID NO: 17328 - DNA, 166 bp, Homo sapiens
ggagaaacttgggagaagaaaaaagagctttggaagaggaagaactgagaaatctccagagaaacgtccagagaaatctgtgaagtccacaagtgtggaagggaaagggaagtgtgattaggctgggatacagaaggctaacagtacactttatatgagaagagct

SEQ ID NO: 17329 - DNA, 165 bp, Homo sapiens
attttattttattattattatactttaaattttagggtacatgtgcacaatgtgcaggttagttacatatgtatacaagtgccatgctggtgtgctgcaccctttaacttgtcatttagcattaggtatatctcctaatgctatccctcccctctccccccacaa

SEQ ID NO: 17330 - DNA, 203 bp, Homo sapiens
  misc_feature 87: w=a or t
  misc_feature 93: w=a or t
  misc_feature 128: k=g or t
  misc_feature 131: y=c or t
  misc_feature 133: y=c or t
  misc_feature 138: y=c or t
  misc_feature 157: k=g or t
  misc_feature 166: k=g or t
ccttacatgtgaaaccacaaaccagaagtaactacctattttttaattcctttcatttctgtctcttttaaaaatcttttttttttwaatatwacagtttgaccagcctggccaacatggtgaaacckggycyctacycaaaatacaaaaagtagckgggcatggkggcatgagcctgtagtcccagctattcagggggctga

SEQ ID NO: 17331 - DNA, 90 bp, Homo sapiens
tctctggcttttcattctgaaggctgccatacatgttaataaatttgtatgccttttctcctattaatctgcctcttgggccctggcaga

SEQ ID NO: 17332 - DNA, 151 bp, Homo sapiens
ctatatgttctgtgattccatttatataagctgcccagaacaggcaaatctatagacacagaaagcaatgtgtggttgccaggagctgaggggaagggagagtggggaaatgtgacactttcatgccatggggtttctgtctggggtgaaa

SEQ ID NO: 17333 - DNA, 111 bp, Homo sapiens
  misc_feature 104: m=a or c
  misc_feature 107: m=a or c
ctggagggcagtggcgcaatctcagctcacgcaagctccacctcccgggttcatgccgttctcctcaatcagcctcccagatagctgggactacaggtgcccamcamcaca

SEQ ID NO: 17334 - DNA, 171 bp, Homo sapiens
agggcctagcacatgcatactgaataaacattcatgtggcttatgtcccatgttcactttggggtggagacttcacatttctttttctttttgagacagagtcttgctatgtcacccaggctggactgcaatggcaccgtatcagctcactgcatccttcacctcccaccc

SEQ ID NO: 17335 - DNA, 272 bp, Homo sapiens
tatacctggtttatggtagtaaaacccctaagatgagacagagcttgggtagtgagctttgacgcagccaggagatttgtgtggcaggagccagtgaatgggggagagggatgagggtgttaggttagagtcaatccctctgcaagagaaggttttaggggccaggcgcagtgtctcacgcctgtaatcccggcactttggggggctggggcgggcggatcacctgaggtcgggagttcgggaccggcctggtcaacatggtggaaccccgc

SEQ ID NO: 17336 - DNA, 125 bp, Homo sapiens
ttttaatttcactgcaatgactttactttgcatttataaaatagtgattttaatttgcatttacctaactactgatgatgttgagcatctttcctttccttttcttttttttctttttttttttt

SEQ ID NO: 17337 - DNA, 248 bp, Homo sapiens
ctggagtgcagaggtgcaatctcagctcactgcaacctccgcctcctgggttcacacaattaccctgcctcagcctcctgagtagttgggattacaggcacccactaccacgcccagctaatttttgtattttcagtagagtcgaggtttcaccatgttggccaggctggtcttgaactcctgacctcaagtcaggacctccttggcctcccaaagtgctgggattacaggtgggagccacggcaccc

SEQ ID NO: 17338 - DNA, 202 bp, Homo sapiens
ctttcctttatcactctcttctttcctttctttcttgtctcgttgtgctacccaggctggagtgagtggtgcaattatggcccactgcagctcaccctcttgggctcaagtgaccctcccgtcttggcctcctgagtagttgggactacaggtgcacaccaccatgcctgactaattttcttttcttttttttttttttttt

SEQ ID NO: 17339 - DNA, 163 bp, Homo sapiens
attctttgcctcatttttctgatagtgttttacattgtcttatattcctgaattttcactgtgtctgaacttttgttttgattaagtgccgttcactgtggacgtcttaactgcctgggacttcaggaacagggtaggggcagggggttagtggaggctgcct

SEQ ID NO: 17340 - DNA, 233 bp, Homo sapiens
  misc_feature 59: n=a, g, c or t
  misc_feature 60: s=g or c
acattcctattactataatttcatggtaagaagttcacacaataggccgggcgcagtgnstcacacctgtaatcccagcactttgggaggttgaggcgggtggatcacctacggtcaggagtttgagaccagcctgaccaacatggtgaaacctcatctctactaaaaatagaaaaattagctgggcatggtggcgggcacctgtaatcctagctactcgggaggctggggca

SEQ ID NO: 17341 - DNA, 99 bp, Homo sapiens
aaccatagcaagaggaactttggaaactatgcaaacacatggaaattaaacaacatgctcccgaatgaccagtgggtcagggaagaaattaagagggaa

SEQ ID NO: 17342 - DNA, 102 bp, Homo sapiens
ctctctttctttctttctttctctttctctttctttctttcttctttttctttttctttttttctttttgacaaagtcttgctctgttgcccaggctggagt

SEQ ID NO: 17343 - DNA, 144 bp, Homo sapiens
tgttttttttttgagactgtgtctcgctctgtcgcccaggctggagtgcagtggcgcaatcttggctcactgcgacctccgcctcccgggtttaagtgattctcctgcctcagcctcctgagtatctaggattataggcacctg

SEQ ID NO: 17344 - DNA, 167 bp, Homo sapiens
atgaagaatgtgatgtatggatctattattcactgttttttaaatattcttcatttaaattgtacagttttccttatatggtaatcacacatttcttattaggtatattcatgggcattttataaggtttttgttgctcttgtgaataagctccactttcccataac

SEQ ID NO: 17345 - DNA, 193 bp, Homo sapiens
  misc_feature 53: v=a or c or g
tggcgcgatctcgattcactgcatcctccacctcctgcattcaagcaattctvctgcctcagccccctgagcagcttggactacaggcgcgtgccaccatgcctagctaatttttatatttgtagtaaagacggggtttcaccatattagccaggctggtcttgaactcctgacctcatgatccacccgccca

SEQ ID NO: 17346 - DNA, 102 bp, Homo sapiens
  misc_feature 13: v=a or c or g
cgaattgtttgcvctgttgccacatttaaaaaatacactccatttgctaaattttaaaaaaaatttttaagagacatggcctcactctgtcatccaggttga

SEQ ID NO: 17347 - DNA, 161 bp, Homo sapiens
  misc_feature 149: k=g or t
  misc_feature 150: k=g or t
  misc_feature 151: d=a or g or t
ttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgckkdcctggataac

SEQ ID NO: 17348 - DNA, 318 bp, Homo sapiens
ctctgcttctatggcccccctggcgtgggtaagaccagcattgctcgctccatcgcccgcgccctgaaccgagagtacttccgcttcagcgtcgggggcatgactgacgtggctgagatcaagggccacaggtaggcctggcctgacagctctccccacgcactcccctcagctgtgctgccgggcttcgtcttctccggtcaccctttaacatctggtagagcaatccgggttgtgggcaaccgattccactcatgctggagtaactgaaaagtccagccatgtggcggacttcaggcccagctgattccaggtgac

SEQ ID NO: 17349 - DNA, 139 bp, Homo sapiens
ccgagaggtaatcgagcagttgagaggtgggaggtggacagtttaatagaggaagactccctggagtaggtggccatcatactacatagatgcctgataaggtgacaaggacagaacctggctcaaatctcagagaagg

SEQ ID NO: 17350 - DNA, 202 bp, Homo sapiens
  misc_feature 111: s=g or c
cccgtctctactaaaaatacaaaaaattagccgggcgcggtggcgggcgcctgtagtcccagctactcgggaggctgaggcaggagaatggcgtgaacccgggaagcggasttgcagtgagccgagattgcgccactgcagtccgcagtctggcctgggcgacagagcgagactccgtctcaaaaaaaaaaaaaaaaaaaaa

SEQ ID NO: 17351 - DNA, 131 bp, Homo sapiens
tatctacctgcctcggcctcccaaagtgctgggattacaggcatgagcttctgtgcccagcctcactttattttttaaccccaataaatgtatatccacaggacattgcttcttctttttttttttttttt

SEQ ID NO: 17352 - DNA, 166 bp, Homo sapiens
  misc_feature 115: w=a or t
  misc_feature 116: m=a or c
agcacttttccttgctgccgccatgagaagaagtatgtgttttcttccccttctgacatgattgttaagtttcctgaggcctccccagccatgctgaactggccccatgcagaawmtcatgagacgtgacttcagaggcctcctctctgaaggtgagggaggcggc

SEQ ID NO: 17353 - DNA, 198 bp, Homo sapiens
  misc_feature 63: r=a or g
  misc_feature 99: r=a or g
  misc_feature 102: r=a or g
  misc_feature 106: m=a or c
  misc_feature 125: y=c or t
  misc_feature 129: w=a or t
  misc_feature 135: w=a or t
  misc_feature 141: w=a or t
  misc_feature 145: r=a or g
  misc_feature 151: y=c or t
  misc_feature 160: y=c or t
gtgaacagattttgatgttggtattgatgttacctggagtgatctcaaaggtcaggtgggaargaagggtgtcatctatactctttttgaccatttgarcargtamttatctcagtgccttgacygtawtgggawtttaawtagratcccyttccccccycctttaattaattaattttaattttaattaattttttc

SEQ ID NO: 17354 - DNA, 268 bp, Homo sapiens
  misc_feature 175: w=a or t
  misc_feature 181: w=a or t
  misc_feature 191: y=c or t
  misc_feature 215: s=g or c
  misc_feature 216: r=a or g
  misc_feature 223: w=a or t
  misc_feature 231: k=g or t
  misc_feature 232: s=g or c
  misc_feature 233: b=c or g or t
  misc_feature 247: w=a or t
  misc_feature 255: k=g or t
agactttcccttttcttaggctttttctttcaaatatctgttttcaggattttctagtgtttatgctttaagcaatacttttaatgtcccctcagtttttatgaaaaatgcataggttatatttcacatacatatgtttacatatttggtgttaagttttttttctttttttttwaattawactttaagtyctgggatacatgtgcagaaagtgsrgtttgtwacatagtksbacatgtgccatggwggtttgckgcacccatcaacc

SEQ ID NO: 17355 - DNA, 291 bp, Homo sapiens
  misc_feature 187: n=a, g, c or t
  misc_feature 254: n=a, g, c or t
  misc_feature 255: n=a, g, c or t
aatatgtttatggcttaggcccagctcacataccagtaagaaaaccaggacaggaaggaataggctcttatagttggataaaactacaagtaggaggctgctctacaagctagttgaggaggaaagccgagagaccatgcacctgcagaactgagtgtcagggcaaaggaaaccctgcccttacacnttctgcaagagggtcatgcatcatccatagggctcgggatttcctgcttaatgtaacactcaggacnnagagaagcagagtgataagtgtgaggactggccctt

SEQ ID NO: 17356 - DNA, 63 bp, Homo sapiens
aaaaggcaattcacaaaagaagaatatgaataaaaaagaaatgtttctttttttttttttttt

SEQ ID NO: 17357 - DNA, 166 bp, Homo sapiens
tataaggaagtgtcatggagccctttgaaatccagtgaagcaagtctggtctcaaatggaactcgaaagcatattaggtggatattggaaagccttttaaaaagtaatcattgaggcagtcaaataaagtaaaattaacttcagtctgagttgtaataaagagcct

SEQ ID NO: 17358 - DNA, 98 bp, Homo sapiens
gagaattgaagtctggtttaaccctgtccttaaccttccctggggccctggatgggtagttctgtagctcccggcctcttgctgaccactggaccaac

SEQ ID NO: 17359 - DNA, 126 bp, Homo sapiens
ctaataaaggtagttataaatatgtaatttatggaaacccattattttgttgctctttgagatccttcttgtttttcttgtttgcactaatacagattttaggctatctgaaaactgtcaggaacc

SEQ ID NO: 17360 - DNA, 223 bp, Homo sapiens
caaactttgatgtatatttttattaaggtcactttccattgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaagt

SEQ ID NO: 17361 - DNA, 201 bp, Homo sapiens
  misc_feature 143: w=a or t
  misc_feature 147: k=g or t
  misc_feature 156: w=a or t
  misc_feature 159: y=c or t
  misc_feature 181: m=a or c
tgtgagtggttacttagtaattagatgaatgagttatttcattggcatttatcatttgatgtgtaggtttttcctatttataacaaacattgaacactgactaattacctgcaactgaaagagggttaaaaaaaaaaagtctwagtkgagaactgwatyctcaacttattttcaacccacmagtgctcttgaagagtatga

SEQ ID NO: 17362 - DNA, 106 bp, Homo sapiens
tactggtatgataacagctcatagatcagaaatggtctgttttaaaccttcctatccatattgaacacaatgatgttgaggtaaaaggggccctttcttcttcttc

SEQ ID NO: 17363 - DNA, 132 bp, Homo sapiens
ctcctgggctcgagcaatcctcccacctcaccctcctgcatatttgggactacaggtacataccatgcccagctaattcagaaaaaccatgagccatctttacacacatggacatctgactgcacccaccca

SEQ ID NO: 17364 - DNA, 51 bp, Homo sapiens
  misc_feature 2: n=a, g, c or t
cnccagttttctcaaacgtagcttttttcttttttcttttttttttttttt

SEQ ID NO: 17365 - DNA, 199 bp, Homo sapiens
tgcatatgaatggacaataagatttcttggatattttcatggcaaaggtgaggagaaatttttattgctttttgaagaaacatgatttttattaccttgggttattccaggagataattgataaatgtcagtagtttgttggtcttcttcttaaaggaggatcaagagaagcagtacagcatggcagactagaagcaat

SEQ ID NO: 17366 - DNA, 79 bp, Homo sapiens
tcactttacatctcaggttttaaacagggtaaattagatgtcaaaggaaacagcttttaatattcaaaggatgctggct

SEQ ID NO: 17367 - DNA, 248 bp, Homo sapiens
cctcttctgcaagggggatggactccttagcactgcttggcatcaggaagccctctagccctcctgttaagagcggctttgtttctggcatgtccaaagctgctccacactgttatacttacacaaacaacttgccagggagattcccaccactctcagcatctttgcattgaattagcaaaactaccaattagggattcttcctaacgtgaatttaaatgccaccttctcatttcatactccacact

SEQ ID NO: 17368 - DNA, 144 bp, Homo sapiens
tttagtagagatggggtttcactggctggtctcgaactcctgacctcaagtgatctgcccgccttggcctctcaaggtgctgggattacaggcatgagccactgtgccagggtggctgctgggtggagtaaagctaggactgca

SEQ ID NO: 17369 - DNA, 128 bp, Homo sapiens
  misc_feature 12: s=g or c
tatttttagtasagatggagtttcactatgttggccaggctggtcttgaactcctgacctcaggtaatcctcccacctcggcctcccaaaatgctgggattactggcgtgagccaccttgcccggcct

SEQ ID NO: 17370 - DNA, 85 bp, Homo sapiens
tgttgaggctgcagtgagccgagatcatgccactgcactccagcctgggtgacggagtgagactcggtctcaaaaaaaaaaaaaa

SEQ ID NO: 17371 - DNA, 100 bp, Homo sapiens
caccaccatgcccggctaattttttgtatttttagtagagacagggtttcacagtgttagccaggatggtcttgatctcctgacctcgtgatccgcccta

SEQ ID NO: 17372 - DNA, 98 bp, Homo sapiens
  misc_feature 38: s=g or c
tagcaaatgtcattgttgtcttattttaaggaattgcsacagccaccccaaccttcagcagccaccatccagatcagtcagcagccattaacaaggag

SEQ ID NO: 17373 - DNA, 102 bp, Homo sapiens
gtgtgtgtgtgtgtagtctgtatctcatgtgtgtacatgtgcaccatttcttgtatttcaatattggtgtcagggagataattttgcaaatggctggggata

SEQ ID NO: 17374 - DNA, 99 bp, Homo sapiens
acatatgtatacatgtgccatgctggtgtgctgcacccattaactcgtcatttagtattaggtatatctcctaaagcaatccctcccccctccccccac

SEQ ID NO: 17375 - DNA, 366 bp, Homo sapiens
  misc_feature 119: r=a or g
aattcgcacgaaaccaaaaccaaaaccaaaaaacaaaccctactacaaggagaagaaaaatccaactgaagaataaaaatttcaacagctaggtctgggcacagtggctcatgcctgtratttcaacactttgggaggccgaggtgggcggatcacttgaggacaagagttcaagaccagcctggccaacatgatgaaaccccatctatactaaaaatacaaaaattagcctggtgtggtggtgggtgcctgtagccccaactactcaggaggctgaggcaggcgaattgcttgagtccaggaggcagaggttgcagtgagctgagatcgtgcaactgcaccccagcctgggtgacagagcgagac

SEQ ID NO: 17376 - DNA, 118 bp, Homo sapiens
agaaaaatgaccaaatttaaaagatatcctttaggccttggctgaacacaggatctctttaaaaagaaaaaaaagataccattttaggctaagtgcgttaaaattcctacagccagaa

SEQ ID NO: 17377 - DNA, 148 bp, Homo sapiens
  misc_feature 18: n=a, g, c or t
  misc_feature 19: n=a, g, c or t
  misc_feature 147: k=g or t
acaggaggattgcttgannccaggagtttgagattacagtgagctgtgatcacaccactgggtctctctctgtcacccaggctagagtacagtggtgtgatcacagctcactgtaatctcaaactcctgggctcaagcaatcctcckg

SEQ ID NO: 17378 - DNA, 348 bp, Homo sapiens
  misc_feature 105: k=g or t
cccatcacctgagcagtgtacactgcaccctatttatagtcttttatccctcacccccttcccattctttccccccgagtccccaaagtccattgtgtcattctkatgcctttgtatcctcatagcttagctcccacttatgagtgagaacatgcgatgtttggttttccattcctgtgttacttcacttagaataatggccttcaatttcatccaggtggttgcagatgctattaattcattcctttttatggctgagtagctccgtgacctgtgtgtgtgtgtgtgcacaagtgagtgagagatttcgaacgcccacccctcgactttgaaatctgagcaaaacca

SEQ ID NO: 17379 - DNA, 293 bp, Homo sapiens
tgaactacacttttagatcacaccattcaagacataagcttagggcggggcacggtggctcacgctgtaatcccagcactttgggaggccaaggtgggtggatcacctgaggtcaggagtttgagaccagcctgaccaacatggtgaaactctgtctctactaaaaatacaaaaattaggtgtggtggcacgcgcctgtaatcccagctactcaggaggctgaggcaggagaatcacccaggaggtggaggttgcagtgagccaagatcacatcattgcactccagcctgggt

SEQ ID NO: 17380 - DNA, 329 bp, Homo sapiens
  misc_feature 318: n=a, g, c or t
  misc_feature 319: n=a, g, c or t
cactgagagaatgaaagtgaaaagacaaataacatcttagtattattacagaaacaatgtggccaggcacggtggctcacgcctgtaatcccagcactttgggaggccgaggtgggtggatcacctgaggttgggagttcgagaccagcctgaccaacatggagaaaccctgtctgtactaaaaatacaaaaaaaattagctgggtgtggtggcgtgtgcctgtaatcccagctacctgggaggctgaggcaggaaaattgccggaacccaggaggcagaggttgaggtgagccgagatcgcaccaccgcactccagnntgggcataca

SEQ ID NO: 17381 - DNA, 210 bp, Homo sapiens
  misc_feature 189: k=g or t
cctatggtaatgatgcttctttctgtaatacttcctgaaagattttcttgaggctattgtacagatttaactgtttttccataagtagatggggtaattctaatgataaactctgttactggtttatttgttttatatactacaatttttatcattagaattaccccttctacttatggaaaaacagtkaaatctgtacaatagcctcaa

SEQ ID NO: 17382 - DNA, 217 bp, Homo sapiens
ttatgaccgtgttacatatgaggaaattgagctttaggcagattaaataatttgtccaaggttgtaaatgctagtaaatgtaaagaaaagaattttcaacccagaatttcacatccagccaaactaagcttcataagagaaggagaaataaaatcctttacagacaagcaaatgctgagggattttgtcaccaccaggtttgccttacaagagctcc

SEQ ID NO: 17383 - DNA, 83 bp, Homo sapiens
  misc_feature 38: n=a, g, c or t
gtttcctttgaagcagaaggccggaacaagcgtagaantaaacttgctggacttggagagaaggctaagacaaacccgccaga

SEQ ID NO: 17384 - DNA, 202 bp, Homo sapiens
cccgtctctactaaaaatacaaaaaattagccgggcgcggtggcgggcgcctgtagtcccagctactcgggaggctgaggcaggagaatggcgtgaacccgggaagcggagttgcagtgagccgagattgcgccactgcagtccgcagtctggcctgggcgacagagcgagactccgtctcaaaaaaaaaaaaaaaaaaaaa

SEQ ID NO: 17385 - DNA, 363 bp, Homo sapiens
  misc_feature 290: d=a or g or t
agtgtgtcaagttcaatttctgtcaacatacatgagtttacttctatctatcatttacaggaacagcaaaattttatatcatgtgaaaatgttttccttccgtttactactcacacatgagttatcctgaggttaaatgtgaatgtttgagattttatcgaatctactttaagctttgtctttgagatctcttattttattttattttttttaatatttctttttattatactttaagttctagggtacatgtatacaacgtgcaggtttgttacatttgtatacatgtdccatgttggtgtgctgcacccattaactcatcatttacattaggtatatctcctaatgctatccgtcccctca

SEQ ID NO: 17386 - DNA, 72 bp, Homo sapiens
tactttgttggtccttcggccgtgttttggctattaggaaggaggagtgtcgtgcatgttcccatagcagct

SEQ ID NO: 17387 - DNA, 154 bp, Homo sapiens
cattcaaaacaacaataatggaaacataccctgcatgtaatacatctaaacacccacaaataaacagtgattaagattaatgtaccttcagcttgtgcctattcttatgcacttatgtaggcatgaagatttaattttccctgtcacacccgca

SEQ ID NO: 17388 - DNA, 226 bp, Homo sapiens
ccacaacctctacctcccgggttcaagtgattctcctgcctcagcctcccgagtagttgggattacaggcatgcgccaccatgctgggctaattttgtatttttagtagagacagggtttctccatgctggtcaggctggtctcgaactcctgacctcaggtgatcctctcacctcagcctcccaaagtgctaggattacaggcgtgagctactgtgcccagccta

SEQ ID NO: 17389 - DNA, 198 bp, Homo sapiens
ggaaaaattagccaggtgtggaggcatgctcctgtcgtcccagctactctgcaggccgaggtgagagaatcacctgattccgggaggtcgaggctgcagcagtgagccaagatcatgctgctgcactccagcttgggtgacagagtgagaccctgtctcaaaaagaaaaagagaaagagagaaagattgagagagagc

SEQ ID NO: 17390 - DNA, 138 bp, Homo sapiens
aaacagttcttttgtgaaaacttaacaagttatggaaataagtggggtatataagtaaaatgtgtatagtgttctctctagactcagtgcagtgctttctcctgaagataactttttatttacttttttttttttttt

SEQ ID NO: 17391 - DNA, 146 bp, Homo sapiens
actttaagttctggggtatatgtgcagaatgtgcaggattgttacatagatatacatgtgccatagcggtttgctgcacccatcaacccatcatctacattagatatttctcataatgctgtccctcccccagtcccccacccctt

SEQ ID NO: 17392 - DNA, 263 bp, Homo sapiens
ccaaggacatgactgacccctaatgaaagggggaggaactagagggaaggccttgagtagagatgggcactaaaataaaataaaataaaataaaataaaataaaataaaatataaataaaacaatcttttttccctcccctttggctcgctgtttcagggggctgcaaaaggagttagaccactgaacttcttgttctatttaggaacaatgttgacattgggcgatttctttatctgaagaatggggtcttcctcctcgcca

SEQ ID NO: 17393 - DNA, 63 bp, Homo sapiens
aaaaggcaattcacaaagaagaatatgaataaaaaagaaatgtttcttttttttttttttttt

SEQ ID NO: 17394 - DNA, 131 bp, Homo sapiens
gtcctggcctggcctaggagcaaatcagatgcccctagagcggttcccctgtggcaaacacattttcacttctattttcaggcaggtcaaagtaaaaatgaaaatttatgcttttacatgtcccaaggctc

SEQ ID NO: 17395 - DNA, 214 bp, Homo sapiens
cctaattgttctggcttgatttctcactactatgttgaatagaagtgttgagattgggcacctctgtcttgtttctgatactagaggaaactttcagcatttcactgtttactctgttgagatggatacttttgtatgtatgttgtttggagtttttattatgaaaatgtatttacttctgttataggcttttaataaattttttgagaggata

SEQ ID NO: 17396 - DNA, 275 bp, Homo sapiens
  misc_feature 265: k=g or t
  misc_feature 267: n=a, g, c or t
ttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattkancgcaccaa

SEQ ID NO: 17397 - DNA, 180 bp, Homo sapiens
  misc_feature 10: d=a or g or t
  misc_feature 11: m=a or c
  misc_feature 104: w=a or t
taatactgadmaactttattctaaccacaaaatagatagcctttcttttgtcttcactttcactatcattagcacagtgtttaataccgtttcttcatctatawcacaattataatgatataggaagccactcaaataaggcagacatgttgcgttgcgcttaaaaaaaaaaaaaaaaaa

SEQ ID NO: 17398 - DNA, 149 bp, Homo sapiens
tatcaccaaagttttccaaagcagtttgaggccctagaaaatgctctctgcagtaatgctgcactacgttgacattctggtgtcaaaccccctgtcttcttagacatctttgctctgtgttatcttccagccccacgcacccccacaga

SEQ ID NO: 17399 - DNA, 317 bp, Homo sapiens
ttcctgtctccataaattaaaccaccaactacccaatttcacaaaggcctagcagtattctgatttatttatttttttcacccctatatctcatccatcaagtcctgttgtcactacctcgaaaacatatcctgattctttctttgcatttttcttcgctctgcctccattggagtatacattttcatccttactgccataagcttctaacagggctcagagtttccaccttgtccctcactcaccagctagaggccttttgaaaagaagtcaggccactttcctgcttaaatcttccaatagctttttccctggca

SEQ ID NO: 17400 - DNA, 129 bp, Homo sapiens
ggactacaggcgtgcactgccacgcccggctaatttttttatttttagtagagatggggttttgccatgttggccaggctggtctcaaactcctgaccttaagtgatccacccccaccccccgcccaat

SEQ ID NO: 17401 - DNA, 233 bp, Homo sapiens
  misc_feature 59: b=c or g or t
acattcctattactataatttcatggtaagaagttcacacaataggccgggcgcagtgbctcacacctgtaatcccagcactttgggaggttgaggcgggtggatcacctacggtcaggagtttgagaccagcctgaccaacatggtgaaacctcatctctactaaaaatagaaaaattagctgggcatggtggcgggcacctgtaatcctagctactcgggaggctggggca

SEQ ID NO: 17402 - DNA, 261 bp, Homo sapiens
  misc_feature 93: k=g or t
  misc_feature 105: r=a or g
  misc_feature 183: r=a or g
  misc_feature 184: r=a or g
ttaagtcctgcattttgtaagaggcaaatggagagtaacagaagagtgtcttttctcctggttttggagtcttgcactggccatgagtgttgkgactgatggtcracccaggcgggcattttaataaatggcctgtgattcttttttgaaagatgctcttccacaagagttaagccagttagrrttcctgtttcctcttgttgatatgagagaagatctcctgtattttaacacgtttttaccaagaaaggtggcacgggt

SEQ ID NO: 17403 - DNA, 154 bp, Homo sapiens
cattatccccagaggtaaattgaaatgtacatgcagacaagaaccgctcttgactgcaattagacatatatgatctaaggtattctggccattcattagtgctaattgtttgagaaacaagcccagaacaaatgattaaaatgtaggcaccatt

SEQ ID NO: 17404 - DNA, 186 bp, Homo sapiens
gccttgaatccatctactttcctcagacaaaccagatgctatcattcttgtgctgtaaactcttcaacaacgccctagtgacctaggggtatagcccaaactttcactcagggaacagtattcttcactggcccccatccatctctttagccatctgctccaccacactttttttttttttttttt

SEQ ID NO: 17405 - DNA, 110 bp, Homo sapiens
cctgctctttgtttcatctttgaaactaagataatgtgtacataatttgaggagtacttttataaagcttatagcagaagcagcaatctaccccattcctctgcacccca

SEQ ID NO: 17406 - DNA, 110 bp, Homo sapiens
cctttggtctttgatgatggtgacatacagatggggttttggtgtgaatgtcctttctgtttgttagttttccttctaacagagtggacctctagcaaactccaaaagac

SEQ ID NO: 17407 - DNA, 113 bp, Homo sapiens
tgaggctggcctgcctctctcccgcctgcccctctccctgcctaataggctgggctggtgctgggtgagggctgccagcaggcattgccctctgtgcatgtgtgtccccgggg

SEQ ID NO: 17408 - DNA, 259 bp, Homo sapiens
  misc_feature 118: s=g or c
  misc_feature 119: n=a, g, c or t
  misc_feature 120: s=g or c
agcactttgggaggctgaggcaggccgatcacctgaggtcaggagtcccagaccagcctggtcaacatggtgaaaccctgtctctactaaaaatacaaaaattagcgaagtatagtgsnscgcgcctgtaatcccagctactccagaggctgaggcaggagaatcacttgaaccccggaggcagaagttgcagtgagccaaaatcgtgccactgcactccagcctgggcaacagagcaagactttgaccctcccctcac

SEQ ID NO: 17409 - DNA, 182 bp, Homo sapiens
cagcttttttaaaaaaatgttttttagagacggggtctcactgtgttgcctaggctggtcttgaactcctggactcaggcgatcctcccacctcagcctcccaaagtgctgggattacaggcatgagccactgcactcagcccagttactgcttttcattcctcacgtcttatggccaccgc

SEQ ID NO: 17410 - DNA, 82 bp, Homo sapiens
ccatctatttttctttgtttttgctgcatttgcttttgggttcttggtcatgaagtgtttgcttaaaccaatatctagaagg

SEQ ID NO: 17411 - DNA, 293 bp, Homo sapiens
  misc_feature 12: y=c or t
  misc_feature 114: v=a or c or g
aaattttttagyggaaacggggtttcactgtgttggccgggatggtctcgatctcctgacctcgtgatccgcccgccttggcctcccaaagtgctaggattacaggcgtgagcvaccgcacctggcgatttccttcctttttaaggctaatattcaattgtctgtaaattccacatttggctcatgcattccatctgtcgatggacactttggttgctttacctgtttgctattgtgaatgatgctgcaatgggcatacgtgtgcacgtatctcttccagagtcaggtcacga

SEQ ID NO: 17412 - DNA, 84 bp, Homo sapiens
  misc_feature 11: h=a or c or t
  misc_feature 12: h=a or c or t
aatgtattcchhtaagttttggaggtcagaggcccaaaatgggtctcactgggctaaaatcaagatgttgacagcattagtttt

SEQ ID NO: 17413 - DNA, 163 bp, Homo sapiens
attaacctttttttcttttttattatacttttaagttttagggtatatgtgcacaacgtgcaggtttgttacatatgtatacatgtgccatgttggtgtgctgcacccattaactcgtcatttagcattagatatatctcctaatgctatctctccctcctct

SEQ ID NO: 17414 - DNA, 206 bp, Homo sapiens
caggatgtgcaattttgttacataggtaaacgtataccatggtggtttgctgcacctatcaacccctcacctaggtgttaagcccagcatgcactagctatttttcctcaggctcttcctccctaacctccacccccatcaacaggccccagtgtgtgttgttcccctccctgtgtccatgtgttctcattgttcagcccccacta

SEQ ID NO: 17415 - DNA, 182 bp, Homo sapiens
  misc_feature 13: n=a, g, c or t
  misc_feature 152: s=g or c
gaagactcactcntgctcctcttccagctttggggtttggagagggatagagaaactgcacacagctctgtgaacttcctagacatcgagttctttggtggcacaacagtgtcgacttccaatggtcacttgtccccaggatggtctccggsatcttcctcatcttgctggccccccacctt

SEQ ID NO: 17416 - DNA, 295 bp, Homo sapiens
  misc_feature 12: b=c or g or t
  misc_feature 175: w=a or t
  misc_feature 176: k=g or t
  misc_feature 191: b=c or g or t
cacaggcttttbctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggawkaagaggaagacagtbaggaatgcagcgaggaagaggatggctacagcagttaggaggcagagaatgaggaagatgaggatgacaccgaggaggctgaagaggacgatgaagaagaagaa

SEQ ID NO: 17417 - DNA, 181 bp, Homo sapiens
ggaaatgcaaaaattagccgggtatggtggcgggcatctacagtctcagctactcaggaggctgaggcaggagaatggctttaacccgggaggcggaggttgcagtgagctgagataacaccactgcaactctagcctggcgacagagcgggactccatctcaaaaaaaaaaaaaaaaaaa

SEQ ID NO: 17418 - DNA, 55 bp, Homo sapiens
atctctgcaaacagtttacaaaagctttcttttttccacattctcaccaatacct

SEQ ID NO: 17419 - DNA, 164 bp, Homo sapiens
tttgggcgagagtgtcccgttttttcaggtagtctgtcacggtttcccttggctaggaaagggaagtcccctaaccctttgcacttcccgggtgagacaacacccccccaatccccgccctggcgtcttctcgccctctgtgggctgcacccactgtccaacca

SEQ ID NO: 17420 - DNA, 120 bp, Homo sapiens
ctggtctcaaactcctgactgcaggtgatctgcctgctgggattacaagtgtgagccactgcacctggccaaaagctattaattttaatagagtctaacttacaagtttttttttttttt

SEQ ID NO: 17421 - DNA, 91 bp, Homo sapiens
  misc_feature 12: m=a or c
  misc_feature 26: s=g or c
gaatggcgtgamcccgggaggcggasttgcagtgagccgagatagcgccactgcactccagcctgggcgacagagcgagacccccgtctca

SEQ ID NO: 17422 - DNA, 183 bp, Homo sapiens
  misc_feature 8: s=g or c
  misc_feature 10: m=a or c
  misc_feature 95: s=g or c
caaagaasamaaaaaattagccaggagtagtggtggacacctgcagtcctggctacttgggaggctgaagcagaagaatcacttgaacccaggasgcagaggttgtagtgagccgagatcgcgtcactgcactccagcctgggtgacagaatgagactccatctcaaaaaaaaaaaaaaaaaa

SEQ ID NO: 17423 - DNA, 126 bp, Homo sapiens
tgtctcaccagatctgcagctctagggaagcaaccctttgcccaagaggcccagatttcataaactgccctccctgacctgtggaacactctggcatttaatttttcactgaaatagctgaggctc

SEQ ID NO: 17424 - DNA, 172 bp, Homo sapiens
tttttttataacagctttattggtatataatttatatgccatgaaattcattcctttaaggataaaattcagtggtttttagaatattcacagcaaccatcatcactctcatttcacattttaatcatcctaaaaagaaacctcatattattagcaatctctccccagtccc

SEQ ID NO: 17425 - DNA, 114 bp, Homo sapiens
cgcacttttacattccggtgggggaacgacacaatgaacagacaattttaacacaagttgaatgacatgatggagagaagtttaggtgtctgtgggggcaaatgaaaggggaag

SEQ ID NO: 17426 - DNA, 125 bp, Homo sapiens
gtgagccagtggtacgagctggtggtgtttacagcaagcatggagatctatggctctgctgtggcagataaactggacaatagcagaagcattcttaagaggagatattacagacagcacagtgc

SEQ ID NO: 17427 - DNA, 135 bp, Homo sapiens
gctttatgcctgagaattggttcacagctttggcaaccatgtgtctgtcttgtttctgtgcctcatggtcctatgtccagcatcttagtccttcctagacaccagagcctcctggacccctgtccactcccctcg

SEQ ID NO: 17428 - DNA, 191 bp, Homo sapiens
  misc_feature 12: h=a or c or t
  misc_feature 130: w=a or t
tgtgggtatgghgttgcaggacctgaaaataaaatagttttttaaggtggtgcagaatgtcctttttgggcctggctattgaggataataagcacataactggtaaagttattgaaatataaattcaggwtgctcactgcaacagtatattattgttatgcttatagcagataagtgtgtattggggaaat

SEQ ID NO: 17429 - DNA, 135 bp, Homo sapiens
  misc_feature 13: s=g or c
actagttaaaggsaataattgtgcatgtgacaattcttggtctctttctcttcaacacaaggactctgtctgtgttctccttgtgtgtcctccctatgtgatcgacattctcttttcagtctgtcaactggatgc

SEQ ID NO: 17430 - DNA, 171 bp, Homo sapiens
  misc_feature 12: y=c or t
  misc_feature 13: w=a or t
ctcagttctttywagtattgaataatatttttaaacaaaaaacaaatgatcatctcaattgatatgggttggctgtgtccccacccaaatctcaacttgaattgcagctcccataattcccacatgttgtgggagggaccttgtgggagataattgaatcatgggggcagt

SEQ ID NO: 17431 - DNA, 90 bp, Homo sapiens
catgtttattggccgcataatgtcttcttttgagaagtgtctgttcatattctttgcccactttctgatttttttttttttttttttttt

SEQ ID NO: 17432 - DNA, 99 bp, Homo sapiens
ttttctttgtttcctgaactgttgtgttagaaaactctcccttatggccgggcgcggtggctcacgcctgtagtcccggcactttgggaggccgaggtg

SEQ ID NO: 17433 - DNA, 262 bp, Homo sapiens
  misc_feature 211: w=a or t
  misc_feature 243: w=a or t
  misc_feature 254: k=g or t
caaatccttttcctgcattatgatagtatctgtgtgaaccaaccttttttcagccctttttgttatggaatgttaagaatgttagtttacaaggttataaagtagaagagtctaattagaaaccagaaaatatctcagtcttttggtctgaatttgttttcctttggttagattcttaaagtagaaaaaaaaaaactactacttattttgwaaacattttgaggattttgattcagatatttwaaattattatktgagataa

SEQ ID NO: 17434 - DNA, 149 bp, Homo sapiens
  misc_feature 20: w=a or t
  misc_feature 131: r=a or g
caaaattagccgggcatggwgacgcatgcctgtggtcgcagccgctcggcaggcttaggcaggaggatcacttgagaccgggaggcagaggttgcagtgagccgagatcatgccctgtgttggattttaarggaaattttgtggcccaa

SEQ ID NO: 17435 - DNA, 166 bp, Homo sapiens
  misc_feature 8: k=g or t
  misc_feature 9: r=a or g
cagatgtkrtcttctagaatttttatgagtcttagatatgagtctttaatctagcttgacttgatttttgtataacgtgagagtggaggatccagctcattcttctacatgtggcttgccaattatcccaccacccattttttgaatagggtgtcctttccccact

SEQ ID NO: 17436 - DNA, 122 bp, Homo sapiens
tgtgtttttttggccttttcatgaagcttgaattaaatctagtttttgtgaaaaataaaactaaagcaatataagaatcccttaagttggtcttataaaatcatatggtttttttttttttt

SEQ ID NO: 17437 - DNA, 120 bp, Homo sapiens
gttttgctcttgttgcccaggctggggtgctgtggcgctatctcagctaactgcaacctctgcctcccgggttcaagcgattctcctgtctcagcaccctctccccgcggtcccccccgc

SEQ ID NO: 17438 - DNA, 141 bp, Homo sapiens
agttttagggtacatgtgcacattgtgcaggttagttacatatgtatacatgtgccatgctggtgcgctgcacccactaactcgtcatctagcattaggtatatctcccagtgctatccctccccctccccccacccccgt

SEQ ID NO: 17439 - DNA, 126 bp, Homo sapiens
gctggaactacaggtgcgcaccgccatgcccggctaatttttgtatttttagtagagatggggtttcaccaagttggccaggttggctcgaactcctgacctcaggtgatcctcctgcctcggccc

SEQ ID NO: 17440 - DNA, 149 bp, Homo sapiens
  misc_feature 5: r=a or g
ctcaraaacaaggccagggtatatttttagaacagttagtacagcgagcaagctaggtggtgtacaccacatggagacaatgagtctgtagagttcttagtaactggccccagcagacggcagccactgcctgagagggcaccccaact

SEQ ID NO: 17441 - DNA, 198 bp, Homo sapiens
  misc_feature 124: k=g or t
  misc_feature 126: w=a or t
cagtggtgtgatcttggctcactgcaagctctgcctcccgggttcatgacattctcctgcctcagcctccccagtagctgggactacaggtgcccaccaccacgcccagctaattttttttttkgwatttttagtagagacggggtttcaccacgttagcaaggatggtctcgatctcctgacctcgtgatccaccct

SEQ ID NO: 17442 - DNA, 339 bp, Homo sapiens
  misc_feature 170: v=a or c or g
cagttctgctctgttcttggttatttgtcttctgatagctttggggtttgctcttgattctctagttcttttagttgtgatggtagggtgtcaatttgagatctgtctagctttttgatgtgggcatttagtgctgtaattttctgtcttaacactgctttatctatttvccagagattctggtatgttgtctctttgtgcacaaaaccacacaactacatgaaaactgaacaatctacccctgaatgactcctgggtaaataataaaattaaggcagaaatcaagcagttttttgaaacaaatgtgcacaaagagacaacataccagaatctctggga

SEQ ID NO: 17443 - DNA, 176 bp, Homo sapiens
agtagctgggactaaaggcacacgccaccacgcacggctaatttttgtatttttagtagagtcggggtttcaccatgttggccagaatggccttgatttcttgacctcgtgatccacctgcgtcggcctcccaacgtgctgggatgacaggcataagccaccgcgcccggccacaa

SEQ ID NO: 17444 - DNA, 158 bp, Homo sapiens
  misc_feature 63: h=a or c or t
ctcctgacttcaggtgatccacctgcctcagcctcccaaagtgctgggattgcaacctctgchtccctggttcaagcaattctcctgcttcagcctcctgagcagctgagattacaggcatgagccaccatgccctgctatttttttttttttttttt

SEQ ID NO: 17445 - DNA, 87 bp, Homo sapiens
ccaggtttctcgaatcaagctggctctgctaacagactcagccatcaacctgcggcatttatggagcactttttttttttttttttt

SEQ ID NO: 17446 - DNA, 170 bp, Homo sapiens
tgaatgaataacacttttaaactactcatttaaaaataatttcctgtttacctaaaagtcacaagagtagtatattctttacctggactccgtaattgttaatgtatcgtcctgtgtaatttattattctctctgaatgcacacacacaggtatttttttcccctggacc

SEQ ID NO: 17447 - DNA, 215 bp, Homo sapiens
cttttgccaaggctccattcccctgcctgactccaaagagggcctgaaaattgctgtcatcatgacggttcccatctcctgggtacccatttatgtgccaggcagtgagcttaacactttctgaagattatctgttgatacctcaaaacagtccttgtttttccagtgtgaaaactgaggcttggatgggtggggtcacttagccaggccacacc

SEQ ID NO: 17448 - DNA, 160 bp, Homo sapiens
  misc_feature 87: s=g or c
gattggccgggtgtggtggcgggcgcctgtggtcccagctgctcgggaggctggggcgggagagtgtcgtgaacctgggaggcggasttgctgtgagcagagatcgtgccactgcactccagcctgggcgacagagcgagactgcatcccaaaaaaaaaa

SEQ ID NO: 17449 - DNA, 140 bp, Homo sapiens
gtatcgctctgtcgcccaggctgtagtgcagtggcatgatctcggcccactgcaagctccgccctccgggttcacaccattctcctgcctcagcttcccgagtagttgggactacaggcgcccgccaccacgcccggctg

SEQ ID NO: 17450 - DNA, 131 bp, Homo sapiens
ctttttgagacacaccttcatctgtagacttggtcactgcttctttgggtgtgtaaggtgtgctagaataatgccttagcattcagcagagaagttctaccaggctctatctttttttttttttttttttt

SEQ ID NO: 17451 - DNA, 243 bp, Homo sapiens
gactgtgccttctgtgtttaaaaatcatctagtgtacttagcttaaaaggaaaactaacttcttattgtggcctacaaagatcagcatgatctggtccctgttcgtcttgtcagccccgtctccttccactctgatcctggctaaaaacaacctagccacatcggggtttttagttcttggaatataccagtctcttccccatctatagcattcatacatgctgttccttctgcctggggtaa

SEQ ID NO: 17452 - DNA, 98 bp, Homo sapiens
  misc_feature 12: k=g or t
cgttcacgaagkagacactcaagccgaacatcagacagaagatgcagcaggtctcgggaccacaaaaggtcacgaagtagagaaagaaggtggagcac

SEQ ID NO: 17453 - DNA, 139 bp, Homo sapiens
cgagcctgccgactagcagggattacaggcacctgccaccacgtccagctaattttgcgtctttttagtggtgacagtgtttcactgtgctgaccaggcccatcttgaactcttgacctcaggtgatccatctgccccc

SEQ ID NO: 17454 - DNA, 110 bp, Homo sapiens
ggacacaaacaaatggaagaacattccatgctcatggataggaagaatcaatatcatgaaaatggccatactgcccaaggtaatttatacattcaatgccatccccccga

SEQ ID NO: 17455 - DNA, 166 bp, Homo sapiens
cagatgttatcttctagaatttttatgagtcttagatatgagtctttaatctagcttgacttgatttttgtataacgtgagagtggaggatccagctcattcttctacatgtggcttgccaattatcccaccacccattttttgaatagggtgtcctttccccact

SEQ ID NO: 17456 - DNA, 133 bp, Homo sapiens
ggtgttggtggcaattgacatgtgtctttggtgtccaaagatgggaaggatgtataggtacacagggattatgtttgaaggttcttaggcactgcattgggattcatgtgacctttgctataccagggggcac

SEQ ID NO: 17457 - DNA, 152 bp, Homo sapiens
aaaacctagaccttgagcgaacatctgtatattggttgaaaacgatagtggtaaccattgatcccccttcatttgatgtttggaaaattccagtaattatcatttttgcaacgaatatggataccacatagtactttggtgttacctacttc

SEQ ID NO: 17458 - DNA, 78 bp, Homo sapiens
ggatgtgagggcgatctggctgcgacatctgtcaccccattgatcgccagggttgattcggctgatctggctggccta

SEQ ID NO: 17459 - DNA, 241 bp, Homo sapiens
gagaaggaaaagaaagagggtttgtggtatttctttagaccttgtacatgtacctttcagtcccattactcctcccccaaagtctgagaggggcattcagaaattttacaaaatctcttttcggagattatttaaaacacacataccaaaaccatatgcctatctgactaaggtgactatgggaagagtgaaggagtagaagagcatgtagatttatctgtactgtcggatgctggtgcta

SEQ ID NO: 17460 - DNA, 120 bp, Homo sapiens
tgtgaacttaggtgccagtagtcaatgtagtttagtggaaaggatactggggtcttggaattttatccctgctttgtcatttaatacctttgcaaaaatggacaaatcatttagtctttt

SEQ ID NO: 17461 - DNA, 63 bp, Homo sapiens
ctatggttttagcacatcttcagatgttttgatgattatttttcttttttttttttttttttt

SEQ ID NO: 17462 - DNA, 388 bp, Homo sapiens
catgaggaaagttgttatagttcagaactcctgtaactttcccacggtcacctagggaataaggcagcaaaactcaggttcaaacctgggcagcctggctccaacacagagcccaaagggaagacacgaactccttcacctttcagacagaatgcaacacttcagcgcaagtttttttggaaaacaccctggcaaaaagtagcatgtatcctggtttttaaaaagttcattccctttgatgcaatattgggactctaagaagttgaatcaagaccacatattatagagggaaacagagaaaacttatctaccggcaaaaaggtgctcaggtgtcattctgaacaccagtcagcctgaggtggcccttctcccaggccctacccaccca

SEQ ID NO: 17463 - DNA, 208 bp, Homo sapiens
agtgaaaccccatctctactaaaaatacaaaaaattagctgggcatggtagcgggcgcctgtagtcccagctaccctgggaggctgaggcaggacaatggcttgaacctgggaggtggagcttgcagtgagccgagatcgcgccactgcactccagcctaggcgacagagcaagaatccatctcaaaaaaaaaagaaaaaagaaaaga

SEQ ID NO: 17464 - DNA, 137 bp, Homo sapiens
aagccctgtactatcttgatctgagtattttgcatttgagctgctgcttctggtttggataggaatttttttcctcctattggggctgtacatttctttctctctctctctctctcttttttttttttttttttttt

SEQ ID NO: 17465 - DNA, 227 bp, Homo sapiens
gtttaaattctaaagggatgtagcatgctgagaagaaataactataaacaaggtgtccattttatgaattatacaatttatggtatgacagaagaccaagggacataacacaaatttggagttaaagaaattaacagacattctcaataattcctcagctattatggcagagatgctgggacaatggatgtccatgtagcagtactttttttttttttttttttttt

SEQ ID NO: 17466 - DNA, 51 bp, Homo sapiens
aattttttctattggattggtttatttactttcaatttgtctttttttttt

SEQ ID NO: 17467 - DNA, 216 bp, Homo sapiens
  misc_feature 128: w=a or t
  misc_feature 129: y=c or t
  misc_feature 198: w=a or t
tgacacatagatacatgtgcacacataattttagacagaattggtaatttactttctatctttgtgtgtgtgtgtgtgtgtgtgtctgtgtgtgtgtgtgtgtgttttgagacagggtctcactctgwyacccaggctggagtgcagtggcatgatcatggctcactgcagcctcgacatccgggacccagtgttttwtaaatttttttttttttt

SEQ ID NO: 17468 - DNA, 207 bp, Homo sapiens
  misc_feature 121: m=a or c
ttttttttgagatggagtctcactctgttcccaggctggagtccagtggcacgatctcagctcactgcaacctccgcctcctaggttcaagtgattctcctgcctcagcctcctgagtaamctggggatacaggcatgagccaccacgcccagccaacaacacttctttaatatttaatactcagttcatgttcagttttctcattt

SEQ ID NO: 17469 - DNA, 96 bp, Homo sapiens
aatgtattcccttaagttttggaggtcagaggcccaaaatgggtctcactgggctaaaatcaagatgttgacagcattagtttttttttttttttt

SEQ ID NO: 17470 - DNA, 150 bp, Homo sapiens
tgttgaaccaaccttgcatcctggggataaaatgcacttgactgtggtgtattagcttctcaatgtgctgctagattttgtttgctagtattttgttgaggatttttgcaactatattcatcaatgatattggcctgaagttttcttttc

SEQ ID NO: 17471 - DNA, 127 bp, Homo sapiens
  misc_feature 100: r=a or g
ccagcactttgggaggccaaggcaggtggatcacttgaggtcaggagttcgagatcagcctggccaacatggagaaatcctgtctctactaaaaatacaraaattagctgggcatggtggtgggtgc

SEQ ID NO: 17472 - DNA, 175 bp, Homo sapiens
  misc_feature 7: m=a or c
  misc_feature 127: k=g or t
  misc_feature 129: w=a or t
cagagamtaacgatgtttcttatttgaatccagtgaaagtactcatgctttgtgttcttgggaattactgagttcaaattcctaatgatgcttgggttacactttgctttgtttctcctagtttctktwtatatgatccggagtggcactggtaataagattgaagaaggtgggc

SEQ ID NO: 17473 - DNA, 101 bp, Homo sapiens
tgactacaggcgcccgccaccacgccgggctaattttttgtatttttagtagagatggggtttcactgtgttagccaggatggtctcgatctcctgacctc

SEQ ID NO: 17474 - DNA, 138 bp, Homo sapiens
ctggaatatgtcttgcaggagagaggtttccagaatgagtctaacattgaactcaatggaggacagggagagccatctggctgcagtttatcttttctcctaatggaaaacttaatgtttctgatgctcctggcacgt

SEQ ID NO: 17475 - DNA, 144 bp, Homo sapiens
  misc_feature 80: w=a or t
  misc_feature 81: w=a or t
cgcatttgaaagcacatcagtttaaagtatgagtctttgaatagacaaaaggaaagagttggattttggggttggttcawwtgtttattttccaagagtccttacggtttggaagggacttgggcatgtgctctggggtgaggt

SEQ ID NO: 17476 - DNA, 178 bp, Homo sapiens
tcctcccacccggatctaggcgcgcaggggccaagcagggacgcagcccagtggctccagccacgccgtcctgcccccttctgcagaaactgatgctctgagaggccaagcagtttgcccaagattacacagtcttagccgtgcctgggagaaccttctcttcaactctgccggcacc

SEQ ID NO: 17477 - DNA, 171 bp, Homo sapiens
ctcagtaggggcaggcctgtctacctgggggtttgggaacgaactgggggataggctgcgggggtttcacgtgaaaccaggaggtctagaaagcacagggatcctctcctcaaggaagaacttgccccctcccccaaagccaagagtgcccctgcagagcgaggcagagta

SEQ ID NO: 17478 - DNA, 67 bp, Homo sapiens
cacaaaatattggtttgttccatttttgatgatgttaaccttcacagtttggttaaggtatgctttt

SEQ ID NO: 17479 - DNA, 59 bp, Homo sapiens
agtgctaggattacaggcgtgagccaccatgcccggccattctcacttaaaaaaaaaaa

SEQ ID NO: 17480 - DNA, 221 bp, Homo sapiens
  misc_feature 101: k=g or t
  misc_feature 102: k=g or t
  misc_feature 123: r=a or g
ctgctggtgggaacataaattagttcagccattgaggaaagcagtttggcaatttctcaagaaccttaaaacagagctaccattcgtcccaggaatcccakkattaggcatatacccaaaggrgtatacattgttctaccataaggacacatgcacatgaatgctcactgcagcagtattcataatagcaaagacatggaatcagcctaaatgcccaccga

SEQ ID NO: 17481 - DNA, 150 bp, Homo sapiens
  misc_feature 130: k=g or t
  misc_feature 131: r=a or g
tttttttgccaggtcattcaacatttattcaaccaaaaatactaagtcagctctatacaaactaatggaaggatacagctatgcaaatatagaacactaaagtgttacatgacagatgtatgaggtaggkrttattttcatgcgcgtcca

SEQ ID NO: 17482 - DNA, 237 bp, Homo sapiens
aatagtttgcttctgtagcataggtaaaattattgtacagagttttatgtgggccaaaagaaattggccaggcgcggtggctcacacctgtaatcccagcactttgggaggctgaggcgggtggatcacttgaggtcaggaatttgataccagccaggccaacatggtgaaaccccatctctactaaaaatacaaaaaaattagtcaggcgtggtgatgcgcacctgtaatcccgaa

SEQ ID NO: 17483 - DNA, 249 bp, Homo sapiens
  misc_feature 230: r=a or g
aaaaaattaaaaaactgaagaattagcctagcatggtggcacatgcctgtagtcccagctactgaggcggctgaagtgggaggattgcttgagtccaggaattcaaggctacagtgaactatgattgcaccactgcactctagcctgggtgacagagtgagattgtctcaaaatagcagcagtagcaacaacaacaaaaactagtgtttccaaccatacttatggcacarggtaaaggaaattgcagag

SEQ ID NO: 17484 - DNA, 395 bp, Homo sapiens
  misc_feature 332: v=a or c or g
  misc_feature 333: n=a, g, c or t
  misc_feature 345: w=a or t
  misc_feature 392: w=a or t
cagtttctccatagtgtcgatggtctttacaatttggtatgtttttgcagtggctggtaccagtttttcctttccatatttcctttcttcaggaaggaccggtggtaataaaatctctcagcatttgcttgtctgtaaaggattttatttttccctttgcttatgaagctcaatttggctggatatgaaattctgggttgaaaatccttttctttaagaatgttgaatattggcccccagtctcttctgtcctgtcaggtttctgcagagagatccgctgttagtctgatgcgcttccctttgtgggttacctgatctttctctctggctgvncttaacattgtwtccttcatttcaaccttggtgaatctgacaattgtgtgtcttggggwtgc

SEQ ID NO: 17485 - DNA, 180 bp, Homo sapiens
agagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagagagagagagagagagagagagagagagagagaga

SEQ ID NO: 17486 - DNA, 293 bp, Homo sapiens
aacgataaatatattaggttgtggtgagccttatggtctctgttgcaactgttcaacacagctatcataacaaaaaagcatccagaggcaataggcaaacaaataggttttattaaacaatgaaaatggctcttagcagagaggagagctggagaggggacaggatgggcaggtcatcttcccccgaagtcaggtcatctcttccatagtccactgcctcttccctgaagtttggccatctcttccccaaattccagttgtctccttgaagtccaggcatctccccctttaga

SEQ ID NO: 17487 - DNA, 241 bp, Homo sapiens
tatttattgtatattatatgtctaatgctatacttctatagcttctgtatttctaaaattgtttagctttttttatttttattttattttttatttttatactttaagttttagggtacatgtgcacattgtgcaggttagttacatatgtatacatgtgccatgctggtgtactgcacccactaactcgtcatctagcattaggtatatctcccaaagctatccctccccccacccccca

SEQ ID NO: 17488 - DNA, 138 bp, Homo sapiens
gtaaatattggcctagtgactctgccttggtttccccacttgaaggaagcagatagaacagtatcctccgaggagtggaggctggggatcggtgaattattgataaaaggagagctcttaacctagcctggcacgtta

SEQ ID NO: 17489 - DNA, 90 bp, Homo sapiens
tgccttagtgcatgacttgaattagtttcctatatgttactatatttttatttatttattttgattttgatttttttttttttttttttt

SEQ ID NO: 17490 - DNA, 144 bp, Homo sapiens
gaaaaaggcccagagccaggcaggcagctcagggcaaaagtcaggatgccccgattccagtcccaggggcaggagagtacagctgcccaagcaggcacactgcagacggccctggcactgcctcccacctgctacaggacctgc

SEQ ID NO: 17491 - DNA, 194 bp, Homo sapiens
actattgttttgccttaggttccagattctgcatttttacatcctggaaaagatgtgggaaaaatattatttgaaatatgccttgcacatggcactcagcgtgtttatctagggcagcgtgtggcagctcagtcctcctgcaatacctcaaactgcacaactaaatagtcagcatctgttatactcccgcacat

SEQ ID NO: 17492 - DNA, 126 bp, Homo sapiens
  misc_feature 109: s=g or c
  misc_feature 110: m=a or c
ttttagtagaaatgtggtttcgttatgttggacaggctagtcttgagctcctgacctcaaatgatctgcctgccttggcctcccaaaattctgggattacaggcgtgasmactgcacccggcgcac

SEQ ID NO: 17493 - DNA, 110 bp, Homo sapiens
  misc_feature 97: k=g or t
ttaaattaatgctaataatttggatattttattttatttttggctgctcgggtaactttagcccttaaccaagcatatgtgggtttttttggttgtktttttttgttttt

SEQ ID NO: 17494 - DNA, 143 bp, Homo sapiens
atttaagataatatccagttcatgtagacatgaatatatatgctttatgatcaatattacctgataatatcactactaaagctatgttctttttgctttattaaagattttaaagccagcaacatcactttggtagtgatatt

SEQ ID NO: 17495 - DNA, 110 bp, Homo sapiens
tgataagcaacaaaacaagtctcaataaatcaacattatatcaagcactgtctcagaccacagtggaacaaaattgaaaatcaactccaaaaggagccctcagaaccgcg

SEQ ID NO: 17496 - DNA, 214 bp, Homo sapiens
ctgactgggagacacctcccagcagggttcaacaagcacttcatataggagagctccagctggcatctggcaggtgcccctctgggacaaagcttccagaggaaggaacaggcagcaatctttgctgttctgcagcctccgctggtgatacccaggcaaacagggtctggagtggacctccagcaaattacagcagacctgcagcagacgggca

SEQ ID NO: 17497 - DNA, 126 bp, Homo sapiens
aatagctgggattacaggcatgtgccaccacgcccagctaatacttgtgtttttagtagagatgaggtttcaccatgttggccacgctggcctggaatgcctgacctcaagtgatctgcccaccat

SEQ ID NO: 17498 - DNA, 325 bp, Homo sapiens
  misc_feature 305: y=c or t
  misc_feature 306: w=a or t
ctcagagtagccactaatgattgatcctttgaatttcaatggtatcagttgtgatgtcttttttttaatctctgattttatttatatgggtttctctccatttggcaaaaggtttgtcaattttgttaatcttttcaaagcatcagctttttgttttattatcttctgtatttttttcatttcaacttcatttatttatgctatgatctttattatttattttttctagtaatttagggtttggttgctcttgcttttctagttctttaagattcatcactaggttgttaatttgaaacttttcywtttttaatataggcccaat

SEQ ID NO: 17499 - DNA, 169 bp, Homo sapiens
atttggagataggagtcttactttgtcaccctgcctggactgcagtgacataaacacggcttgctatagccttgacctgccaggctcaagtgatcctcctgccttaaccccttcaaatagctacaggtgctcaccaccatgcctggctatttttttttttttttttttt

SEQ ID NO: 17500 - DNA, 306 bp, Homo sapiens
  misc_feature 111: r=a or g
  misc_feature 112: m=a or c
  misc_feature 184: r=a or g
  misc_feature 185: w=a or t
  misc_feature 203: r=a or g
  misc_feature 204: w=a or t
  misc_feature 297: w=a or t
gttgtcgcccagtctggagtgcagtggctccatctcggctcactgcaatctccgcctctcgggttcgggcgattctcctgcctcaggctcccgagtggctgggattgcagrmgcgcgccaccatgcccggctaattttttgtatctttagtagagatggggtttcaccatgttggccgggctgrwctcgggctcctgacctcrwgatccgcctgctttggcctcccaaagtgctgggattacaggcatgagccaccgtgcccagctggattttgcttttcaatttgatgactatgtwgcatagacg

SEQ ID NO: 17501 - DNA, 354 bp, Homo sapiens
  misc_feature 285: k=g or t
  misc_feature 286: k=g or t
tgaaatagtgtctctaaaatgcttaggacattgtctggcttgcacgaaagagtttctaaaaaattattatgttcggccgggcgcagtggctcccgcctgtaatcccagcactttgggaggccgaggctggcggatcacctggggtccggagcttgagactagcctgaccaacatggagaaaccccgtctccactagaaatacaaaatgagtcgggagtggtggcgcatacctataatcccagctactcgggaggctgaggcaggaaaatcgcttgaacccaggakkcagaggttgcagtgagccaatatcgtgccattgcactccaggctgggcaaaagtgaaactccgtctca

SEQ ID NO: 17502 - DNA, 106 bp, Homo sapiens
aagacactagaaaacattttctgttgaacagtattctggttttatccatagggatgaatctcattctctttaaaaattgtctggctaacagccaggtgcagtggtg

SEQ ID NO: 17503 - DNA, 140 bp, Homo sapiens
ctttgagacggagtctcgctctgtcgcccaggctggagtgcagtggtgcaatctccactcactccaacttctgcctcccaggttcaagcgattctcctgcctcagcctccagagtagctgggactacaggcgcacaccac

SEQ ID NO: 17504 - DNA, 211 bp, Homo sapiens
  misc_feature 11: w=a or t
  misc_feature 98: w=a or t
  misc_feature 100: w=a or t
  misc_feature 106: w=a or t
  misc_feature 110: d=a or g or t
gggaatttgawtgggggtaatacctatagagatacaagaaacatttaggagtttaacataaatctttgttacttttatgctcattatttgctattatwtwtatttwtatdtttttgagacagagtctcactcttgtcacccaggctggagtgcagtgcgtgacctcatctcactgcaacctccgcctcccaggctaaggcaggagaatcgc

SEQ ID NO: 17505 - DNA, 90 bp, Homo sapiens
aatgtggtatgcttgttacaaacgatgaaccaatgtaggtaggttattctgacctaaagtccgtaatttacttttttttttttttttttt

SEQ ID NO: 17506 - DNA, 242 bp, Homo sapiens
  misc_feature 136: s=g or c
  misc_feature 242: s=g or c
gaagaagccatcaaagaggaggtggtcaaggagcccaaggatgaggcacagaatgagggcccggctacagagtcagaggccccgctgaaggaggatgggcttttgcccaaaccactctcttctgggggagaggaasaagaaaaaccccggggcgaggcttctgaggacctgtgtgagatggccctggacccagaactgttgcttctgagggatgatggagaggaggagtttgcaggagcaas

SEQ ID NO: 17507 - DNA, 99 bp, Homo sapiens
ctaattgaaaaggatgtcctatttccgatgtatatttttggcagttttgtcaaaaatcagttgggctgtaaatatgtgcagtcttatttctgggtcctc

SEQ ID NO: 17508 - DNA, 216 bp, Homo sapiens
  misc_feature 78: k=g or t
  misc_feature 134: y=c or t
ggagaggtgctctgctttttagagtttccagtttttctgttctgttttttccccatctttgtggttttatctactttkggtctttgatgatggtgatgtacagatgggtttttggtgtggatgtcctttctgtytgttagttttccttctaacagacaggaccctcagctgcaggtctgttggagtaccctgccctgtgaggtgtcagtccgccct

SEQ ID NO: 17509 - DNA, 113 bp, Homo sapiens
actacaggcgcccgccaccatgcctggctaattttttatatttttagtagagagggggtttcaccatgttagccaggatggtctcaatctcctgacctcgtgatccacccacc

SEQ ID NO: 17510 - DNA, 122 bp, Homo sapiens
  misc_feature 110: s=g or c
attcactatcaagagaacagcatgaagtaaaaaacaaaacaatacccattcctgtgattcaattacttcccaccaggacccttccatgacatgtgggaagtaattgaatsacaggaatgggt

SEQ ID NO: 17511 - DNA, 350 bp, Homo sapiens
  misc_feature 107: m=a or c
  misc_feature 108: w=a or t
  misc_feature 173: w=a or t
  misc_feature 174: w=a or t
  misc_feature 306: s=g or c
attaaagtagacacacggggcactttgacccacctgtagtacatttctttcacagcaaggcagtgcaaccggtagcacatcgggctcttttagatgctgctccagcmwtggtccggtggatcatgcttggtttagaagctgggttgtctttctcctgcccccagtcctgtctwwgcttttatagtgcatcatacaccacgtagaaccgagccaggttcctgccatgtggacgctgttcctgcctgagagtctcttagaggaaggctgggaacactgtggaaagactgggcatctctgcaggcggastgaatggatgtgaaacccctgtgggcatgtgcttccgagttcct

SEQ ID NO: 17512 - DNA, 195 bp, Homo sapiens
  misc_feature 45: r=a or g
tgaatacgttcagcttttctgggggtttttttttgttgtttttgrgacagtctcactcttttccccaggctggagtgcagtggcgcgatctgcggcctctccctcccaggttcaagtgattctcctgtatcatcctcccgagtggctgggattacaggcgtgtgccactatgtgtggctgatttttgtgatgtga

SEQ ID NO: 17513 - DNA, 101 bp, Homo sapiens
ttgcaggttagttacatatgtatacatgtgccatgctggtgcgctgcacccactaactcgtcatctagcattaggtatacctcccaatgctatccctcccc

SEQ ID NO: 17514 - DNA, 86 bp, Homo sapiens
aatgtaattacacctttcaaaagtaaacacgtttgctaaatctcagtgtttcacatattgggtaaaatgattcctttttttttttt

SEQ ID NO: 17515 - DNA, 236 bp, Homo sapiens
cggagggcagtatctgctttggctgtgggatcgatggggaagtgaggtcaagtgtatgaggcttcctaaggtggcagggaagaggctctgcacttgttgatactatcccaacatctcagaactgagaggcaagaatatgaatcacatggggaatcactgacagcctcaggtcctcctttatgagctggatgtctgtggagaaccttggttgatttttttggttgtgaatggaggca

SEQ ID NO: 17516 - DNA, 76 bp, Homo sapiens
cacaacctttttcctgttctgtctttaaataatacttgtgtgtatttgtggagtctagtgttcttttttttttttt

SEQ ID NO: 17517 - DNA, 176 bp, Homo sapiens
attggccgggtgtggtggcgggtgcctgtggtcccagctgctcgggaggctgaggcaggagaattgcttgaacccgggaggcagaggttgcagtgggtcgaggtcatgccactgcactccagcctgagcaacaagagcgaaattccatcttaaaaaaaaaaaaaaaaaaaaaaaaa

SEQ ID NO: 17518 - DNA, 286 bp, Homo sapiens
atttatttatttattttttggagacacagtctcactctatcccccaggctagagtgcaatagtgccatctcggctccctgcaacctccgcctcccaggttgaagcaattcttctgcgtcagccttctgagtagctggaattacaggcacgtgccaccacgcccgactaatttttgtatttttagcagagacggggttttgtcatgttggccaggctggtctcgaactcctgacctcagcctcggcctcccaaagtgctggaattacaggcacgagccaccaccccc

SEQ ID NO: 17519 - DNA, 250 bp, Homo sapiens
aattttttttaaagatggagtcttgctctgttgcccaggctggagtgcagtggcgtggtctcggctcactgcaacctctgcctcccgggttcaagtgattctcatgcctcagtctcccgaatagctgggattacagccatatgctatcatgcctggctattttttgtatttttagtaaagatggtttcaccctgttggccaggctggtctcgaactcctgacctcaagtgatccacccgacccagccact

SEQ ID NO: 17520 - DNA, 182 bp, Homo sapiens
gctatagtagcattttggttgattccatgtctctgctatctttatggtagaatgatttatattcctctgggtatatactcagtaatggaattactgggtcaaatggtggtactgcttttaactctttgaggtatcatcatactgccttccacaatggttgaactaatttatactcccacctt

SEQ ID NO: 17521 - DNA, 102 bp, Homo sapiens
aaaagtaattctgttttaacataactgacttgtaggtgaacttctggacaacagtgtttttctcaattaggaactgcctacgctgtactttctctgcagcta

SEQ ID NO: 17522 - DNA, 156 bp, Homo sapiens
tctgggtgctcctgtattgggggcacatatatttaggatagtcagctcttcttgttgaattgatccctttaccattatgtaatggccttctttgtctcttttgatctttgttggtttaaagtctgttttatcagagactaggattgcaacccctgc

SEQ ID NO: 17523 - DNA, 159 bp, Homo sapiens
  misc_feature 117: w=a or t
tctctattaaaaatacaaaaattagccgggcgtgggtgcctgtagtcccagctactcaggaggctgaggcaggagaatcacttgaacccgggaggcggaggttgcagtgattctccwgcctcagcctcctgagtagctgggactacaggcacccacccc

SEQ ID NO: 17524 - DNA, 133 bp, Homo sapiens
tcaaaattgctgattgggaggccggctgcagtggcccgtgcctgtagtcctagcacttcgagaggctgaggcaggtgaattgcttgagcttaggagtttgagaccagcctggacaacacaacaaaaccccacc

SEQ ID NO: 17525 - DNA, 151 bp, Homo sapiens
  misc_feature 19: r=a or g
  misc_feature 20: r=a or g
acagggcttgtgttgatgrratccctcagcttttattgttctgggaaagtctttagttattcttcatgtttgaaggatattttcaccaggtatattattctagggtaaaagtttttttccttcagcactttaaatatgtcatgccactcta

SEQ ID NO: 17526 - DNA, 82 bp, Homo sapiens
tattttttagtagagatggggtttcacaatgttggccagactggtcttgaactcctgacctcaggtgatctgcccgcctggc

SEQ ID NO: 17527 - DNA, 86 bp, Homo sapiens
gacagagtctccctatgttgcttaggctggtttcaaactccagagctcaggcgatctgcccgccttggcctcccaaagtgctggga

SEQ ID NO: 17528 - DNA, 153 bp, Homo sapiens
  misc_feature 130: m=a or c
  misc_feature 131: w=a or t
cagaaggactaaggtaggccctgcctgccttccagatgaccatctaggttcagtgtgtgggctcatctgcttgcttgtttttccagctgcccgggtgtcttcttgatgcagtgtgccaaggtgaagagtmwtggttggagagaaggtgggaaa

SEQ ID NO: 17529 - DNA, 262 bp, Homo sapiens
aaacatcgttctgagaaggcaacaatttctgaggatttatgttgatgacaatcatgttgaaatttgtgttagttaattgaaccattttcatattagcagatgagacctagaaaaggtcttagaacacataagttttgagcttaatttctttcttgaaacggtgtatctcaactctgtcacctaggctggagtgcagtggtgctttcatagctcactgcaacctcaaactcctcaactaaatgatcctcccaccccaccccct

SEQ ID NO: 17530 - DNA, 176 bp, Homo sapiens
  misc_feature 21: s=g or c
aattccacgagacaccacctsttcccccaaaacctattgaaatttcaaacaaataagcaacctgataaacaagaagataataacaacagtctccagcaagccagagttgcaaggtattttggtggtggcacctttattctttagggtcttagggccacaaaaattcctcaaccaga

SEQ ID NO: 17531 - DNA, 190 bp, Homo sapiens
  misc_feature 157: w=a or t
  misc_feature 158: r=a or g
ctctgtttcccaggctagagtgcagtgacatgatcttggctcactgcaaactccgcctcccgggttcaagagattctcctgcctcagcctctgagcagctgggattacaggtgcccgccaccgtgcccggctaatttttgtattttttagtagagawrgggtttcaccaccttggccaggcgcggtggct

SEQ ID NO: 17532 - DNA, 243 bp, Homo sapiens
tcctagaagtctaccaggagaaacatctctgaataacatgggaaggtaagaatggcaacattaggattgcagtttttctcttttttctttttttctttttttcttcccccaacccctgccaattattattcttttttattctggtaacataacatagataaaatttaccatcttaactatttttaagtacggttcagtggtattaagtgcattcccacagttgtgaaccattatccccgtctt

SEQ ID NO: 17533 - DNA, 238 bp, Homo sapiens
tctacataaatgcggcagtgctatatagaaaattaacattaattttaataaaaaagaaaattgatatatcctcaagttatatcaataaaatgtggaaatcttagcttcaaccctgaaggtcaggcaagttttctttgaactgttgcaatggtaatcaaaatcattcacacatttttataagaaactaaatatagtcattaatcatcaattaataagtgatcaattgatgactgcccca

SEQ ID NO: 17534 - DNA, 142 bp, Homo sapiens
  misc_feature 44: r=a or g
tcttagcctcctgagtcactggaattacaagcacgcccggctarttttggtatttttagtagagcatggcggtttcaccgtcttggctaggctggtcttgaacacctgacctcaggtgatccacccacctcggcctccctgt

SEQ ID NO: 17535 - DNA, 149 bp, Homo sapiens
  misc_feature 8: y=c or t
  misc_feature 76: b=c or g or t
agtctgtycaaactcctgacctcaggcgattcacccgccttagccgcccaaagcactgggattgcaggcgtgagabagcgcacctggcctatagtaacattttaatcaaaacacagcatcataggtggagactgaaagcctaccattat

SEQ ID NO: 17536 - DNA, 139 bp, Homo sapiens
ctgaggttaggagttcgagaccagcctggccaacatggtgaaaccccgtctctactaaaaatacaaaaaattagccgcgcgtggtggcaggcgcctgtcatcccagctactcaggagactgaggaatcacttgaacccg

SEQ ID NO: 17537 - DNA, 53 bp, Homo sapiens
gttttaggttgttgtttctgtgagacctctcgtgtcttttttttttttttttt

SEQ ID NO: 17538 - DNA, 164 bp, Homo sapiens
ttggcatagattggaatgcaatggaatggaatcaacccgagtacaggggaatggaatggaatggaatgcaatggaatggaatcatccgtaatggaatggaaaggaatggaatggaatggaatggaatggaatcaactcgattgcaatcgaatggaatggaatgg

SEQ ID NO: 17539 - DNA, 198 bp, Homo sapiens
caacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgc

SEQ ID NO: 17540 - DNA, 271 bp, Homo sapiens
aagattggccgggcgtggtggcgggcgcttgtggtcccggctgcttgggagcctgaggcaggagaatcgcttgaaactggtaggcagcggaggttgcagtgagccgggatcgcgccgctgcactccagcctgggcgacaagagcgaaattccatcttggggaaaaaagaagtttccttcagtgacggactgacagaccccacttatgatggtcaggccataagattgtaatggagctgaaaaatttctcacttcatgagtgaaagaagcct

SEQ ID NO: 17541 - DNA, 139 bp, Homo sapiens
ctgttaggcaattatttgagtaagctttgtgtaactcttgtacctactaagattttggcagatttagtttatcctagatgagctaaagtcacttcaaactaaaagtaaaaatctaagtgtgatttttaaaagacactga

SEQ ID NO: 17542 - DNA, 79 bp, Homo sapiens
cacagtttcttttgctgtatagaagttctttaatttaattaggtcccatttgtcaattttttttttttttttttttttt

SEQ ID NO: 17543 - DNA, 164 bp, Homo sapiens
  misc_feature 13: s=g or c
  misc_feature 15: w=a or t
  misc_feature 16: w=a or t
  misc_feature 21: m=a or c
  misc_feature 26: w=a or t
ttggcatagattsgwwtgcamtggawtggaatcaacccgagtacaggggaatggaatggaatggaatgcaatggaatggaatcatccgtaatggaatggaaaggaatggaatggaatggaatggaatggaatcaactcgattgcaatcgaatggaatggaatgg

SEQ ID NO: 17544 - DNA, 182 bp, Homo sapiens
acttaaaagatgagtaggatataggagaaagggaggggctaggtgttgcaaatgaaggaaaagcaaaaacatagagaattactttatgtgtctggttttacaagcaattttgggttggcatttagagtatgtgacaaggagcatctgggaaaagatcaattaggaggcttttttttttttcc

SEQ ID NO: 17545 - DNA, 86 bp, Homo sapiens
cagtggtttgtcttgatacttgtaagtgaagctgtttctccccaattatgaaatgcggtgatggtggttttttttttttttttttt

SEQ ID NO: 17546 - DNA, 133 bp, Homo sapiens
  misc_feature 9: k=g or t
  misc_feature 10: y=c or t
aagacggakyttgctctatcacccaggctggagtgcagtagtgtgatctcggctcactgcaacatccgccccccgggttcacaccattctcctgcctcagcctcccgagtagctgggactacaggcacccgcc

SEQ ID NO: 17547 - DNA, 122 bp, Homo sapiens
  misc_feature 95: r=a or g
  misc_feature 96: s=g or c
aaggctggagtgcaatggcacgatcttggctcattgcaccctctgtctcccgggttcaagcaattctcctgcctcagcctcccgagtagctgggrstacagacgcatgccaccacacccggc

SEQ ID NO: 17548 - DNA, 93 bp, Homo sapiens
gaatacaatggaatggaatggaatggaacggaagggagtggaatggaatggaatcaccccgagtgcaggggaatggaatggaatggaatgcta

SEQ ID NO: 17549 - DNA, 216 bp, Homo sapiens
aatttttgtattttttaattaatttatttttttgagatggagtttcactcttgttgcccaggctggagtgcaatcatgtgatctcagctcactgcaacctctgcctccctggttcaagcgattctcctgcctcagcctcctgagtagccgggtatggtggcgcatgcctgtaatcccagctactcaggaggctgaggcaggagaatcgcttgaacc

SEQ ID NO: 17550 - DNA, 130 bp, Homo sapiens
  misc_feature 43: m=a or c
ttggatcagcccccatttggccaacaggtgactctaccccagmgtgggcctgagaggacccatcccccatctcaccattctgccccagcgccctggatcctgcctctaccacttcttccctgcagcgttg

SEQ ID NO: 17551 - DNA, 120 bp, Homo sapiens
  misc_feature 13: s=g or c
acgagaccagctsggatcacaggtgcacaccaccacgcctggcttgtttctactaattaacctaccctaaggatgtggtccaaaaactgtctaggtgatgcaattttttttttttttttt

SEQ ID NO: 17552 - DNA, 135 bp, Homo sapiens
  misc_feature 12: m=a or c
attaaaaatacmaaaattagccaggcatggtggcacgaacctgtaatcctagctactcaggaggctcaggcaggaggattccttgagtctgggaggtccaggctgccgtgagctatcgttgcaccactgcactcc

SEQ ID NO: 17553 - DNA, 125 bp, Homo sapiens
aaaaatacaaaaaactagctgggcgtggcagcgggtgcctgtggttccagctactcgggaggctgaggcaggagaatggcataaacccaggaggcggaggttgcagtgagctgagatcacaccat

SEQ ID NO: 17554 - DNA, 239 bp, Homo sapiens
  misc_feature 45: w=a or t
  misc_feature 46: w=a or t
  misc_feature 49: w=a or t
  misc_feature 50: w=a or t
  misc_feature 64: m=a or c
  misc_feature 65: w=a or t
  misc_feature 119: d=a or g or t
  misc_feature 132: m=a or c
  misc_feature 133: w=a or t
  misc_feature 141: m=a or c
  misc_feature 186: r=a or g
  misc_feature 187: r=a or g
  misc_feature 236: m=a or c
  misc_feature 237: w=a or t
ccagacaaaaacaaaaacaaaccagtgattccagtaaagtatgawwagwwctatagcaaaaggmwgagggaactgagaagaatgtgatttaacattctgcctaagggaatgagggagtdttcacagaagagmwgataaaamtggaagcttagacaattacacaaggacataatatatacaaatcarrttattaattcagaatcacaaaatgttttttgtcttctgtcaactgatgmwgg

SEQ ID NO: 17555 - DNA, 101 bp, Homo sapiens
  misc_feature 23: s=g or c
  misc_feature 44: s=g or c
  misc_feature 45: r=a or g
  misc_feature 54: r=a or g
catagcaagagcaggagcaagasagagtggcaaggagacaccasrcacttttaracaaccagatcccatgggaactcattaccaagggaaggacaccaagt

SEQ ID NO: 17556 - DNA, 91 bp, Homo sapiens
atggaggctttgctcatttctttttattcttttttctctaaacttcccttctcgcttcatttcattcatttcatcttccattgctgatacc

SEQ ID NO: 17557 - DNA, 221 bp, Homo sapiens
gaagagcacagaactaaggattaggctgcatcagttctacacttgattgtcattatctagctaagtgaccctgagtaagtcacttaccctgtctggggctcagtttcatcatgtataagtgagggtgttggtcagtaattttcaaactgaagttcaaagactatcttgagttcttgttttaaatgcaggtttctgagcctcattgaaacctcccagccttt

SEQ ID NO: 17558 - DNA, 207 bp, Homo sapiens
  misc_feature 13: v=a or c or g
  misc_feature 66: w=a or t
  misc_feature 88: r=a or g
  misc_feature 158: w=a or t
  misc_feature 159: w=a or t
aaggcacaaaggvtccacactctctacctcagaccctccttcaacatcgaggcctttccatttggwggtcaagggtgagaccaccctrtcccccgaccctgcatcacccacactaagccatcctctcccaaggattccatgacatcattggcccaaawwgtgggtgctgccaccgtcttccaagaaggtgaacccatccccctcttc

SEQ ID NO: 17559 - DNA, 114 bp, Homo sapiens
cacaagggtttccgcatgaaaaaaatcttttcttcccccacaaaaaaacctttaccatcaaaatcttgccatctgatttagaaaggtgttttttcttcttcttctttttttttt

SEQ ID NO: 17560 - DNA, 215 bp, Homo sapiens
  misc_feature 124: r=a or g
aagaattcgcacaccaccagagaaaataatctttattaaaatgaaaacaggaaggaaaagaagaagaaagagaagaccaaaaagaaaaatccagaaaacataaactggcaggaataagttcttrttaataataacattaatgtaaatagactgaattgtccattcgagatgtagagtggctgaatgaataagaaaataataccaaatgatctatt

SEQ ID NO: 17561 - DNA, 99 bp, Homo sapiens
  misc_feature 19: m=a or c
tatgctgagaactggaggmtggcttgagctcacaagacagaggttgcaatgagccaagatcaagatagcaccactgcatagaagcctgggtgacatagt

SEQ ID NO: 17562 - DNA, 108 bp, Homo sapiens
atgcagtcttggctcactgcaacctctacctcctgggttcaagcaattctcctgcttcagcctcctgtgtagctgggactacaggcacatgccagccacacccggcca

SEQ ID NO: 17563 - DNA, 255 bp, Homo sapiens
gctccccccaccccatgacaggccctggtgtgtgatgttccccaccctgtgtccaagtgttctcattgttcaattcccacccatgagtgaaaacaatgcagtgtttgctttcctgtccttgcgacagtttgctcagaatgatggtctccagcttcatccatgtccctgcaaaggacatgaactcatccttttttatggctgcatagtattccatggtgtatatggataaagctggaaacaatcattctcagcaaa

SEQ ID NO: 17564 - DNA, 121 bp, Homo sapiens
aatcagaaatgacagcctggtgactggctccatgctgggtgaagtccagcaaactgcaggccctgtaagtgcctaatcccaaacctgggcaacatagggagaccttgtctctacaaaaaaa

SEQ ID NO: 17565 - DNA, 110 bp, Homo sapiens
tagtgtttcctgttgaattttacgtgaccttgaccagttaggttttctctctggtccttggttctctacctcggatgtgcttcttcagcccacagaatcctagtccgtgt

SEQ ID NO: 17566 - DNA, 67 bp, Homo sapiens
acccagcatatgtattgggatagcttctgatagagtaatttcctgggtcctgtgggcattttttttt

SEQ ID NO: 17567 - DNA, 155 bp, Homo sapiens
  misc_feature 137: k=g or t
  misc_feature 151: s=g or c
tttatacatccacttactactgtaagtttcctttttttttttcacatctctttaaacgtaattcctccacctgtttcctacatatcactccctgcttttctacacagaaacagtgtttgtttggttgtttccatttkgccccctttcccasgcct

SEQ ID NO: 17568 - DNA, 261 bp, Homo sapiens
  misc_feature 70: m=a or c
  misc_feature 71: s=g or c
  misc_feature 89: y=c or t
  misc_feature 93: r=a or g
  misc_feature 129: s=g or c
  misc_feature 131: n=a, g, c or t
  misc_feature 140: k=g or t
cattttgggagcaccgaggtgggtggatcactttgagctcgggagattggaggccagcctggacaatgtmscaaaagcctgtctctgtyagarataccacaattggctgggcgtggagtcacgtgcctstngtcccagtkactcgggaggctgaggcaggagaatctcttgcacccaggaggcggaggttgcggtgagtagagatcatgccactgtactctagcctgggcaacagaatgagactccctctcaaaaaaaaaa

SEQ ID NO: 17569 - DNA, 148 bp, Homo sapiens
ttgactgccatcctctttccttttactaattgtgattagattttctcaaaagattggcttgaaagaacagaaggcccaagacgtggaccacttgatgtcttcctcctctttttatggttctgacatgacagctcttctggaccacatt

SEQ ID NO: 17570 - DNA, 108 bp, Homo sapiens
ttacgtattagaatcaaccccagatagttcagcacagaaaagcaatggcatgattagtagtatcgtctttgaagatgaaagtgaactatttggtgaacctcccaactc

SEQ ID NO: 17571 - DNA, 105 bp, Homo sapiens
  misc_feature 2: d=a or g or t
  misc_feature 89: m=a or c
  misc_feature 90: m=a or c
  misc_feature 95: m=a or c
  misc_feature 96: s=g or c
  misc_feature 105: m=a or c
tdacacccgctgccatcggcaccgattagtttccacgccctctagtgcgccctcgggggccctagtaacctccctccttcccttgggcmmgggcmsgggaggccm

SEQ ID NO: 17572 - DNA, 105 bp, Homo sapiens
  misc_feature 12: m=a or c
tgtaaaaatgtmaagaaataacttgcatctggaaaagaaatgcacactgaagcatttatacgggcttagttcaaaaatgctgtcctttttttttttttttttttt

SEQ ID NO: 17573 - DNA, 228 bp, Homo sapiens
  misc_feature 4: m=a or c
  misc_feature 12: m=a or c
tcgmataatctmttatttgctgaactacacgccatctgtaggtgctggggtgctggcagggctactgggtgatgaccgctcactccgcttgtccgtactcatcataatgtggtgaactccaggctcaaatatccgctggcctcccagacacctcctcctgggaatccaggaggcaccccaacttaacatgatcattgaggaaccctcgatgtcttcctgcacccctct

SEQ ID NO: 17574 - DNA, 220 bp, Homo sapiens
  misc_feature 137: n=a, g, c or t
  misc_feature 138: d=a or g or t
cacgaggttaagagtttgagactagcctggccaagatggtgaaaccttgtctctactaaatatacaaaaattagctgggcgtggtggtgggtgcctgtaatcccagctagttaggaggctgaggcaggagaatcacndgaacccaggaggtggaggttgcagtgagccaagattgcaccactgcccatctcaaaaaaataaaaaataaaaaaataaattc

SEQ ID NO: 17575 - DNA, 248 bp, Homo sapiens
  misc_feature 12: s=g or c
  misc_feature 91: s=g or c
ctctgctagaastacaaaagttggctgggtgtggcggcgggtgcctgtggtcccggctgctcgggaggctgaggcgggagaatggcgtgasccgggagatggggtttgcagtgagccgagatcgcgctactgcactccagcctgggtgacagagcgagactccgtctctaaaaaatttaaaaaatttaaagtgccagaggtggttagacacccccgttttccactcctgtcctctctgaggtccccac

SEQ ID NO: 17576 - DNA, 114 bp, Homo sapiens
actcccaagtagcttcgactacaggcacacaccaccatgcctggataatttttgtatttttagtagaggcaggttttgccatgttggccaggctggtctcgaactcctgaccac

SEQ ID NO: 17577 - DNA, 204 bp, Homo sapiens
  misc_feature 21: w=a or t
  misc_feature 22: w=a or t
  misc_feature 23: w=a or t
  misc_feature 38: w=a or t
gattgctatagcaataatatwwwtttccttgagatttwttttccttcaaattttcttttaagttctggggtgcatgtgcagatgtgcaggtttgttacataggtaaacatgtgccttggtggtttgctgcacagatcaatccaacacctaggtataagcacagcattccttagctattcttaatgctctccctctctccacccc

SEQ ID NO: 17578 - DNA, 120 bp, Homo sapiens
gtaagcttaccactattcattattatttatcatcctccttttgttgtgaaacttcagtggcaaattgtccatacttgttatctccaccatctcaccattgttcactcctttacccccacc

SEQ ID NO: 17579 - DNA, 219 bp, Homo sapiens
tacaggcatgagcctccgtgccgggtccagtttgcctttcatcatgaggtggagactgccacgtggtagcagtaacaaaagagaaacacacttgggagggaaagtgccaggcagatgaagacaagggaggtggccgagagggcctaagaagtgacttgatttttttatttttatttatttgtttatttttttgagatggagtctctctctgtcgcccac

SEQ ID NO: 17580 - DNA, 304 bp, Homo sapiens
tactttgtaacatgactaaacccagagcaaactgaccatgcattaataataaaatgtaggcatgaaaatttgtatttcgtatacttaaagtcagagtcagatttttccagttttctgatctgtatgttttttaaataagctttttgtaagatgaaaataatgcccttttgattatgcagtattttcttgtttgcttagagacataaagaacatttaaactgtcagttattataatgacaagaggtattcctgatcagtaagagaagttatcactgaagacatttctgatttcactgcccagact

SEQ ID NO: 17581 - DNA, 187 bp, Homo sapiens
acactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgataccccc

SEQ ID NO: 17582 - DNA, 171 bp, Homo sapiens
aaatatttaaaattcagtaactctatagagaaataaagggttttcccaatcctggaaaaaaatggttaaaattgtaaatcttacatatattttaccatagtaaaaaatgaattaggctgggcccatggctcgcgcctgcaatcccagcactttgggaggctgaggcagacc

SEQ ID NO: 17583 - DNA, 133 bp, Homo sapiens
gttgttgaatcatccttgcaaaacagctgaatgccattcggagttgcagaggttttctgatttctaaaagtaatcacagtatttttaggctagaaaatgacaagtcataaatgtctttggtttgcagtattct

SEQ ID NO: 17584 - DNA, 91 bp, Homo sapiens
cgtcagatggaacagattgtggaaggaattaagcaaagtagaatgaagatggaaaagaaaaagcaagagaacaaaatgagaagagaccacg

SEQ ID NO: 17585 - DNA, 255 bp, Homo sapiens
tctctgttggtttccattggtctgtttttgtatctctgttaacattacactattagaattacttttgttttataataagtgatgatttctgtctggtatagcaaattatcctacttggttcttttaaaggagtgttgtgctggtttttacactgttgtttgctgggactagaactctgcaaatcacatttctcctttgtcagctggctggcctgtagggactactaaaggcagattgtagggctagaagagacat

SEQ ID NO: 17586 - DNA, 170 bp, Homo sapiens
  misc_feature 12: s=g or c
  misc_feature 129: r=a or g
ggtttgttggascttatggaaaagcaaatgtaggtataagtaacgataaaaagggttagattccctttcgccgaaagaccgaggtttcccgggcgatgccaatcagcccggggttagtcgagtcctaartctcatccgaacggagcaggcgatggcagatgaggttaatt

SEQ ID NO: 17587 - DNA, 163 bp, Homo sapiens
  misc_feature 30: w=a or t
  misc_feature 41: k=g or t
  misc_feature 45: y=c or t
  misc_feature 145: b=c or g or t
  misc_feature 150: r=a or g
  misc_feature 162: r=a or g
  misc_feature 163: r=a or g
atgttggccaggctggtctcgaactcctgwactcgggtgakctgyccacctaggccccccaaagtgctgggattacaagcatgagctatgcacctggcctttttaactttttgttaaggaaattttaaagcactcaccgagagtbgagaraatagcacaggrr

SEQ ID NO: 17588 - DNA, 266 bp, Homo sapiens
  misc_feature 130: k=g or t
  misc_feature 190: d=a or g or t
  misc_feature 210: k=g or t
atcctgcttatcagttatttttttcatggattgtaccttgtgtgctgtatctaaaaggtcattaccatatccagggttacctaggttttctcctatgttatcttctaagcgttttatagttttgtgattkataattaggcctaccttccattttgagttaatgtttgtgaaggatgtattcttttcagtdtttattttagtttatatgtkgtttctcttcttttcctctaatcacctggtttatgaaaactcgtgaaagtaggttg

SEQ ID NO: 17589 - DNA, 128 bp, Homo sapiens
tggaacctggagaatttgagatctccagaggaggtagacaaggaaagtcaaaggaatctggaagaggaagagaacctgggaaagggagagtaccaagagtcactgaggtctctggaggaggagggccc

SEQ ID NO: 17590 - DNA, 101 bp, Homo sapiens
  misc_feature 24: b=c or g or t
attattctacctgttgtgtgagtbtagtatatttaatttactttttgttactctttacatactgtttatttttgttagtttttaattgaagatggactgtc

SEQ ID NO: 17591 - DNA, 61 bp, Homo sapiens
  misc_feature 21: k=g or t
tgagccaagaccacaccagtkcactccagcctgggcaacgaactctgtctcaaaaaaaaga

SEQ ID NO: 17592 - DNA, 67 bp, Homo sapiens
ctctacatgactgcacagtgcttttgcacattcattgtcttccttgacctttttttttttttttttt

SEQ ID NO: 17593 - DNA, 113 bp, Homo sapiens
tgctcctgtccatggtcctgggcccaaatctgaaaacctgataactaccctgtcttctcaccttttggggtttacatgggactgttttcttttcttttttttttttttttttt

SEQ ID NO: 17594 - DNA, 98 bp, Homo sapiens
tgcaatcttggctcactgcaacctctgcctcctgggttcaagcgattctcctgccttagtttcctgagtagctgggattacaggcgcacaccaccatt

SEQ ID NO: 17595 - DNA, 200 bp, Homo sapiens
ctttcctttatcactctcttctttcctttctttcttgtctcgttgtgctacccaggctggagtgtagtggtgcaattatggcccactgcagctcaccctcttgggctcaagtgaccctcccgtcttggcctcctgagtagttgggactacaggtgcacaccaccatgcctgactaattttcttttctttttttttttttt

SEQ ID NO: 17596 - DNA, 132 bp, Homo sapiens
ctttaggaaattctgatatcaaaatcatgaatttacacaataaataagtttcatgtaaaatggtatttacaagataaacaaattgtgttataaaacagttttggattcctcactggaatttttcttttcttt

SEQ ID NO: 17597 - DNA, 205 bp, Homo sapiens
  misc_feature 57: k=g or t
gccggtcgcctcggagagcgcggaggctggagcccctttgctacactggcgcggatkatgatgcatcattatcacagaagaaattcgtgtctatagcttttaaggacttgattacatcattttcaagcctgatagttttggaatcaccattagagcttaagacacacctgccttcatttcaaccacctgtcttcataccctgaca

SEQ ID NO: 17598 - DNA, 76 bp, Homo sapiens
aagactatactttcagggatcatttctatagtgtgttactagagaagtttctctgaacgtgtagagcaccgaagac

SEQ ID NO: 17599 - DNA, 261 bp, Homo sapiens
  misc_feature 148: s=g or c
  misc_feature 152: r=a or g
  misc_feature 230: r=a or g
  misc_feature 261: r=a or g
cggtggctcacgcctgtaatcccagcactttgggaggcctaggtgggcggatcacctgaggtcaggagttcgagacctcctggccaacatggtgaaacctcgtctctactaaagctacaaacattagccgggtatggtggcgtgcgtstgtratcccagctactcaggaggctgaggcaagagaattgcttgaacccaggaggtagaggtttcagtgagccaagattgcrccattgcactccagcctgggcaacaagagtr

SEQ ID NO: 17600 - DNA, 213 bp, Homo sapiens
tttcagttgctctgcctccttgccaacatttggtatggctagtctttattttagacattttagtagatatgtagtgacatcttattataataatatatagctttagttgtatattttgaaataaaaattagttatttctgaattgaatggacttttaaaagattatacttgtgcccatcattattttttgctcctgtgtctttcctaggggct

SEQ ID NO: 17601 - DNA, 50 bp, Homo sapiens
tcgaaagacgtcttaaagaaaatgcaaagaagaaatgatgacaaatccgt

SEQ ID NO: 17602 - DNA, 157 bp, Homo sapiens
atggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttg

SEQ ID NO: 17603 - DNA, 124 bp, Homo sapiens
  misc_feature 12: y=c or t
tttaagctgccyaagaaagtgtagactttgggtcagtcctgggtaagagcaatagctcttttgagatgaaggatagtgtgataaaagagagacctttgtgatagctaaggtgaactaaggagga

SEQ ID NO: 17604 - DNA, 146 bp, Homo sapiens
ataaagcatacagaaacccacctaaaatagactcagggaggtaggaggtttcctaagggctgagactgaaagataatagggattgcttgatggcattgttgatggggctgtgggtgagaacagtgctccagggaaaagaggccagc

SEQ ID NO: 17605 - DNA, 87 bp, Homo sapiens
ttaagtcttttacctaaaggcccagccgtcaccagacaacagaataatcaatctgcctgaaaatccctcctccttgtcctacgactt

SEQ ID NO: 17606 - DNA, 189 bp, Homo sapiens
atgagattgtagaaagagccatcgctaaatctaggaagaccgtgcttgcatatttacatatctggcccctctcctgtagatatgaaggtctaccgatgatggggaagcaacttgaagagaataacactttcacatcatcttttgacttcactatggaaaggagcaggaataggagaaaagaagaccaaa

SEQ ID NO: 17607 - DNA, 162 bp, Homo sapiens
  misc_feature 85: y=c or t
  misc_feature 86: y=c or t
acaaatgcatcagtttgataccaccatcatactttttgccatatctgtgtattttctttaaatcgactcattttttttttaattyyttttgagattgagtattgctcttgttgcccaggctggactgcaatggcatgatcttgggtcactgcaacctccgcc

SEQ ID NO: 17608 - DNA, 139 bp, Homo sapiens
  misc_feature 123: n=a, g, c or t
cctggctaattttgtatttttagtagagacggggtttctccattttgaggctggtctcaaactcctaacctcaggtgatccgcccacctcggcctcccaaagtgtgggattacaggcgtgacnaccatgcccggccgac

SEQ ID NO: 17609 - DNA, 136 bp, Homo sapiens
  misc_feature 7: k=g or t
  misc_feature 136: r=a or g
ctaagtkttagggtacatgtgcacattgtgcaggttagttacatatgtatacatgtgtcatgctggtgcgctgcacccactaatgtgtcatctagcattaggtatatctcccaatgctatccctccccccccccgr

SEQ ID NO: 17610 - DNA, 105 bp, Homo sapiens
tcaagtagtcctcccacctcggcctcccgagtagctgggactacaggcatgtgccactacacctggtcaatttttcgtaactgcaaatatcctattcctcagccg

SEQ ID NO: 17611 - DNA, 215 bp, Homo sapiens
atgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgc

SEQ ID NO: 17612 - DNA, 98 bp, Homo sapiens
aattctagcagaggtacaaagaggagctggtaccatttcttctgaaactattcccatcaatagaaaaagagggaatcctccctaattcattttatgag

SEQ ID NO: 17613 - DNA, 255 bp, Homo sapiens
cagaattatctatattatttttactagcattttcttttgattcgtattctctattaagacattgttctcatacttcagattttcttttttttaaattttattttgttattattatactttaagttttagggtacatgtgcacaatgtgcaggtttgttacatatgtatacatgtgccatgttggtgtactgcacccattaactcgtcatttagcgttaggtatatctcctaatgttatccctcccccctcccctt

SEQ ID NO: 17614 - DNA, 170 bp, Homo sapiens
atgggttgtctgaggattttctggcaggagttttcttgttttgtgtgtttgaattaaactcttgaacgtgtctagaatgcttttaacatgaaataatatgcttggggtgggggagggcaattttgtttccttccagtgtgccagcactaattagtcaataatccgtcctg

SEQ ID NO: 17615 - DNA, 77 bp, Homo sapiens
ccattctcctgcctcagcctcctgagtagctgggactacaggcacctgccaccattcctagctaatttctttctctt

SEQ ID NO: 17616 - DNA, 237 bp, Homo sapiens
  misc_feature 45: k=g or t
  misc_feature 128: k=g or t
  misc_feature 223: m=a or c
cagctcactgtaagctccgcctcccgggttcacgccattctcctkcctcagcctcttatgtagccgggattacaggcacccactaccacgcctagctaattttttgtagttttagtagaacgggtgtktcatcatgttagccaggatggtctccatctcttgacctcgtgatccacccacctcggcctcccaaagagttgggattataggcatgagccaccgmgcccagcccctcct

SEQ ID NO: 17617 - DNA, 125 bp, Homo sapiens
gcttttggactgggactaagccactactggctgctttcttccctagcttgcagatggtctatcatgggacttttcaccttgtgatcatgtgagccaattctccctaataaactcctcccccacga

SEQ ID NO: 17618 - DNA, 269 bp, Homo sapiens
  misc_feature 47: w=a or t
  misc_feature 48: w=a or t
  misc_feature 55: y=c or t
  misc_feature 134: w=a or t
ctttgtttcttggttagttgttttttgtggtggcttggatgcgcgtwwttttgtytgtttgttcttgccatcacggattcctttttcctgaacataatgagttctagatactccgtagtgaagccaagtttctwttgatttttagaaatgccaattccttctttgacttcgttttgttatagatatcatagacaattaacatccttggagtctgtagtctttgaatgcagaagggaaaatcttatctagtagatacttgttaatgccaa

SEQ ID NO: 17619 - DNA, 136 bp, Homo sapiens
ctaagttttagggtacatgtgcacattgtgcaggttagttacatatgtatacatgtgtcatgctggtgcgctgcacccactaatgtgtcatctagcattaggtatatctcccaatgctatccctccccccccccga

SEQ ID NO: 17620 - DNA, 104 bp, Homo sapiens
acatacttgattagatttggagagtgagggagagggcaaggtggcaacatgactcagatttctttgggcattttgggtggattatggtgccattcactgcccac

SEQ ID NO: 17621 - DNA, 208 bp, Homo sapiens
aatttgtatatatatatattttttttagttgattatttatttatttatttatttattattattatactttaagttttagggtacatgtgcacaatgtgcaggttacatatgtatacatgtgccatgctggtgtgctgcacccactaactcgtcatctagcattaggtataactcccgatgctatccctcccccctccccccaccccca

SEQ ID NO: 17622 - DNA, 174 bp, Homo sapiens
gtttataaaggtaaaagattgagaataacgtaatgcttgacaataggggactggttaaataattagctacccaatcagtgaaatactttgtagccaataaaagtggtaagttatgggtacaaccacaatggaaacggctgatagtttcttttttttcttctttttttttttttt

SEQ ID NO: 17623 - DNA, 186 bp, Homo sapiens
  misc_feature 177: m=a or c
ctataggcacgcactaccatgcctggctaattttttattttggtagagatgaggtttcaccatgttggccaggctggtctcgaactcctgacttcaggtgatccacctgccaaagtgctgggattacaggttgagacaccgcacccggccaacatggtgaaacctcatctctaccamaaaaaaaaa

SEQ ID NO: 17624 - DNA, 139 bp, Homo sapiens
  misc_feature 13: y=c or t
  misc_feature 19: y=c or t
  misc_feature 85: y=c or t
atgcatgggcttyggagtyaggcagtactggactctaatcccagtgctgttaccctttagctgtgcgattgtgggagagtctgtyaacatctcagagccttgatttcctcatctttaaagtgtaacaatggcgacccac

SEQ ID NO: 17625 - DNA, 89 bp, Homo sapiens
ttttttgtgatgaaagtaggtcaaacattacatctttccattgaaagggaaacatccatgtcaggagttcccattcgtttagtactttt

SEQ ID NO: 17626 - DNA, 89 bp, Homo sapiens
cttggctcactgcaacctccacctcctgggtccaagcgattcccctgcctcagcttctagagtagctgggattacaggtgcccgctaca

SEQ ID NO: 17627 - DNA, 333 bp, Homo sapiens
  misc_feature 12: y=c or t
gagagagaaatyttaggaactctacgcagaggggcagtatacacaaaagcaagacaaagtgagcaagggagagaaaacaaacatcttactatgtgtgggaatgagcaaaaggagagggggagaaagactgagcacagttgcatatgggagtggagctccttgtgatgttttagtgattaaataggtgacagctaggaagggtgatcacttggctttgtggcaagaggtttgtctctgagcgtttctcagcacctggtaggcttcttcctgtattaggacaacttcacaccaagattccttctagaaccttgagcctagttaaccccacgcccc

SEQ ID NO: 17628 - DNA, 364 bp, Homo sapiens
  misc_feature 12: s=g or c
  misc_feature 86: m=a or c
  misc_feature 87: s=g or c
  misc_feature 89: k=g or t
  misc_feature 253: n=a, g, c or t
  misc_feature 254: m=a or c
tctaggactcasatgctcctctgttgtggtatgtggaccactggtgacatgtgatgtgattttaagtagcacagagataagagcamstkaaaaaaaaattgcatcattccaacaaagtcagcgtgatggaaaatattgagcaaataattcaggtggtgtgagagctaacaaaaattgtaaaaatggtacgcaaagtaactaaagtttaagaaacactgccctcagataaggtctagaatttcctcagtctctnmtgtaaatatttttctggaggacacagctccgctgtctaccgcatatgcccagagaagtctaaagctctttggtgggatacagtttagcctgaacctggggcccccaacat

SEQ ID NO: 17629 - DNA, 220 bp, Homo sapiens
  misc_feature 8: s=g or c
  misc_feature 12: y=c or t
  misc_feature 24: m=a or c
gaaatgtsggaytgcgtaaaagamtgaacctatgactgactggggtacctgaaagagacaggtagaatgggaccaagttggaaaacatattataggatatcatccaggataatttccccaacacagcaagacaggccaacattcaaattcaggaaatccagagaaccccattaagatactccatgagaagatgaatcccaaaacacataatcatcagatt

SEQ ID NO: 17630 - DNA, 234 bp, Homo sapiens
  misc_feature 13: m=a or c
  misc_feature 37: r=a or g
aaaaatgcaaatmgcacacccccttttttgtaacctrgaaaagtgagaacaataatgtgagagcagatgagtttgaggattagttggtttgttttatagccggtttggaatgtgaggctcactaaaagaatgtattccaaaaggaaccatgagtaatcctgactacagaatctaatgcgtcttttttttccccatgccatagccgcgtacgctgtgtactctgtgacaagaaac

SEQ ID NO: 17631 - DNA, 146 bp, Homo sapiens
cctcaggtgatccacccaccttggcctctcaaagtgctgggattacaggtgtaagccactgcgcttggcctaaggcttaatttcttaatacattggctattctttttattgtgtgagacaaagtctggctctgggtttgtttttgt

SEQ ID NO: 17632 - DNA, 180 bp, Homo sapiens
ccatctctactgaaaatacaaaattaactgggcatggtggggaatgcctgtaatcccagctacttgggaggatgaggcaggagaatcgcttgaacctgggaggcagaagttgcagtgacccgagattgtgccattgcactccagcctgggcaacaagtgcaaaactccatcaaatagtaa

SEQ ID NO: 17633 - DNA, 177 bp, Homo sapiens
  misc_feature 45: r=a or g
  misc_feature 85: v=a or c or g
  misc_feature 142: v=a or c or g
  misc_feature 155: k=g or t
  misc_feature 165: w=a or t
  misc_feature 166: k=g or t
  misc_feature 175: k=g or t
ctgcttttcaaattttatatatatatgtgtgtgtgtgtgtgtgtrtgtatgtatgtgtgcatatacatatgtgtgtgtgtatatvtatgtgtgcatatacatatatacatgtagtatatatgtattctcaaatatatatgavggatatatatatktgagtatgtwkgtaggggtkgt

SEQ ID NO: 17634 - DNA, 163 bp, Homo sapiens
  misc_feature 123: r=a or g
atcaattttcccaaggatttttacattttcagtccatgtaaaacttcaactcttatttttcttaataagagtatgggggggtgggcagtttctataattaactgataggtctctgttaaaatraggttctctttctaataaaaaacaaatgtgacgtggcttg

SEQ ID NO: 17635 - DNA, 205 bp, Homo sapiens
cccatctctactaaaaatacaaaattaactgagcgtggtgtcgggtgcctgtaatcccagctacttgggagactgagacggagtcttgctctgtcgcccagactggagtgcagtggtgtgatctcagctcactacaacctccatctcccggattgaagcaattctcctgcctcagtctcccaagtagctgggattacaggcaccc

SEQ ID NO: 17636 - DNA, 159 bp, Homo sapiens
  misc_feature 139: s=g or c
ccatcacacccggctaattttttgtatttttagtagagacggggtttcactgtgttagccaggatggtctcgatctcctgtcctcgtgatccgcccggcctgccttggcctcccaaagggctgggattacaggcgtgascaccgcgcccggccccatca

SEQ ID NO: 17637 - DNA, 133 bp, Homo sapiens
  misc_feature 57: v=a or c or g
  misc_feature 78: r=a or g
  misc_feature 99: r=a or g
  misc_feature 100: m=a or c
  misc_feature 108: m=a or c
  misc_feature 118: r=a or g
  misc_feature 119: r=a or g
gccgagattgcgccactgcactccagcctgggcgacagagcgagactccgtctcaavaaacaaaaaaaacaaacaaaraaaacacatcgaggtatatgrmtgaattamatcagttctrrtaactgctcctgat

SEQ ID NO: 17638 - DNA, 177 bp, Homo sapiens
tatgttgaaccagccttgcatcccaggaatgaagtcatcttgatcatggtggataagcttttggatatgatgctgtattcagtttgccagtagtttttcttttgaggatttttgcactgatgttcattaggtatattggcctgatgttttcttttcttttttttttttttttttttt

SEQ ID NO: 17639 - DNA, 240 bp, Homo sapiens
  misc_feature 182: m=a or c
gcatgaaaaataatataatcagcaattattggatatagtattctgtttatcagtagggtcaatatttttctttctttttatttatttatttattatactttaagttctagggtacatgtgcacaacgtgcaggtttgttacatatgtatacatgtgccatgttggtgtgctgcacccattamctcatcatttacattagatatttcccctaatgctatccctctcctatgcccctacccc

SEQ ID NO: 17640 - DNA, 51 bp, Homo sapiens
gaaaaacaaacggggagcccagggggaaggaaggcaggcgagaaagaggca

SEQ ID NO: 17641 - DNA, 98 bp, Homo sapiens
tgtggcgccatctcagctcactgcaagctctgtctcccgggttcgcgccattctcctgcctcagtctccagagcagctgggactacaggcacgccatg

SEQ ID NO: 17642 - DNA, 216 bp, Homo sapiens
  misc_feature 76: s=g or c
  misc_feature 120: r=a or g
aggctcgtttcgaactcctaacctcaggtgatccacctgcctcagcctcccaaagtgctgggattataggcgtgascaccgcgcccggcccaaaataataatttctttaccaaagaggaraagaactatggttatcgtgtattttagaagctaagtgctaaagatcttagatgactggcagtctaatcagagtctgtctcccttgccttgccacta

SEQ ID NO: 17643 - DNA, 81 bp, Homo sapiens
ggtgatgaaataatctgcacaccaaactaatgtgacacgcagtttacctgtgtaacaagcctgcacatgtacccccgagcc

SEQ ID NO: 17644 - DNA, 178 bp, Homo sapiens
  misc_feature 16: r=a or g
  misc_feature 66: d=a or g or t
  misc_feature 77: k=g or t
  misc_feature 78: k=g or t
  misc_feature 80: k=g or t
  misc_feature 81: d=a or g or t
  misc_feature 147: s=g or c
gcatattccaactcarcctccatgttgttcctctcctgctaattatgactaaatagctttattttdtatttttttakktkdtgagacagagtcttgctctgtctcccaggctgaggcaggagaatcacttgaacctgggagtcagasgctgcagggagctgacatagtgccactgcac

SEQ ID NO: 17645 - DNA, 144 bp, Homo sapiens
  misc_feature 26: y=c or t
accacaccaggctaattttttgtatytttagtagagatggagtttcaccatgttggccaggctggtcttgaactcctggcctcaggtttccacctgcctcagcctcccaaagtgctgggattacaggtgtgagccaccggcccc

SEQ ID NO: 17646 - DNA, 139 bp, Homo sapiens
  misc_feature 118: s=g or c
ttttagtgtctataagtcaagtctttggtgttaaagattttaactatcatttgctgtaattcttagaaagccgagggactaatcatttatgtttcgtgcataaggaaatgggcgttasttccccaagaccccaggagcc

SEQ ID NO: 17647 - DNA, 189 bp, Homo sapiens
  misc_feature 16: k=g or t
  misc_feature 33: y=c or t
tctgcagatcattttkgctgcagcgagcatccyagtaagtaggtctgcctgtttccttgggagggatccccagaagtgggtctgggcgcctgcagtcctcggtaagccttgcggatttgttttccaaaagctggagatgaattggctcagttctcatccttcccgggcagctaaccacccagcgcccac

SEQ ID NO: 17648 - DNA, 174 bp, Homo sapiens
ttgttgctgcttattacaccaagaagacagggctttggggcgatgcttttggttttttgctgggggaagatctttattactgatcaagatagcagttctaaatgccatgtgaacttgggacaatatatgtgagaattatatctcacttaaggtgccgggaactctttttctttt

SEQ ID NO: 17649 - DNA, 122 bp, Homo sapiens
acagccaatcaatgatcaagacctgcttttttcctcctaaggttgaataactttatgagaatgtttctgtatgatgtttaaaagcaacttcttatttgctttccacacattgattttgcctt

SEQ ID NO: 17650 - DNA, 121 bp, Homo sapiens
  misc_feature 12: s=g or c
  misc_feature 13: y=c or t
aaaggtaaagasycatgtggagcatcctgtgggcgcctggacggggcagcaggagggacctactgcagggtattcgcagacaccaaggcccagcttggccttcatgtcagctttttccttt

SEQ ID NO: 17651 - DNA, 59 bp, Homo sapiens
agtttaaccatttttttaaacacgactgaccagtgtagaaaatgaaaacacccagtttt

SEQ ID NO: 17652 - DNA, 54 bp, Homo sapiens
ggtccatctgtcttacagtgaagtgtgttagcatttcagaggtcattctttttt

SEQ ID NO: 17653 - DNA, 374 bp, Homo sapiens
  misc_feature 332: h=a or c or t
  misc_feature 333: m=a or c
agaagaaagtgagcccatccattacttgttcatttattttcaaataaaaaatgtatttctcttttatttctcctttcctttcttcattctacttttcaccatttccaccattttgtcaatcctgctcatagatataagcatgagagtgttgttagcaatacgtctgaatgtccagtttacatcaaaattaagaacatgcaaataatgtatgctagagttaaatctaatacatattcagtctccaaatctctagtctttcaaattgttcagaatctctgcaaaagtttctaactaatcttactaatcctccaataattaaatcgttttttcahmtttgtctaaatgcacacacataccgcaatccacacaccacg

SEQ ID NO: 17654 - DNA, 84 bp, Homo sapiens
gctttagtctcctgagtaactgagactacaggcatgtgccactgcacctggctaactgttgtatttctttcttttttttttttt

SEQ ID NO: 17655 - DNA, 237 bp, Homo sapiens
  misc_feature 32: w=a or t
  misc_feature 33: y=c or t
cagctcactgtaagctccgcctcccgggttcwygccattctcctgcctcagcctcttatgtagccgggattacaggcacccactaccacgcctagctaattttttgtagttttagtagaacgggtgtttcatcatgttagccaggatggtctccatctcttgacctcgtgatccacccacctcggcctcccaaagagttgggattataggcatgagccaccgcgcccagcccctcct

SEQ ID NO: 17656 - DNA, 224 bp, Homo sapiens
atcttcttttgtatcagattctccatccttctcttaattgaagattgtgtttttcaagctatggttcatcattgctgctttccttacaaaatgaattcgaatggcaatcagcattttccttaaggaatatagtagatttaattacataaaaagaattgaaaatatcagagactattgtacataactatttacgttccatgaaattgttagtatacacacacacc

SEQ ID NO: 17657 - DNA, 134 bp, Homo sapiens
  misc_feature 133: m=a or c
gtagctgggattataggcacccaccaccatgcctggctaattttttgtatttttagtagagatgggatttcaccgtgttggccagcgtggtctcgaactccttacctcaggtgatccacctacctcggcctama

SEQ ID NO: 17658 - DNA, 162 bp, Homo sapiens
ggactacaggcgcccaccaccacgcccggctaattttttttatttttagtagagatggggtttcatcatattggtcaggctggtctcgaactcctgacctcatgtgatccacctggctttggtctcccaaagtcctgggattacaggcatgagccaccgcgc

SEQ ID NO: 17659 - DNA, 175 bp, Homo sapiens
gtgctggtcacagaagcaggaacctcaaaggcctgtctacaaaccatttattcatttattcattgaggtgcttttagcgaagtctctgcttctgggcgaatggtggcgagcaagttaaaaaagcctgggtcttgtggcagatgacgaacaagtcattctacagaaggcggcctta

SEQ ID NO: 17660 - DNA, 225 bp, Homo sapiens
  misc_feature 10: w=a or t
  misc_feature 132: d=a or g or t
caaggggttwattaacatcagacactaacagcaggtgcagagctgtgagtcatccagcatgcagagtatgattgtactggtagtttttactggtagtttatagttgtgcctgtattcttaggtacttgcgtdgtactgaatttggttttcaaatattagtacaatccagctatctgaagagattacatggggtaatcctacaataattctgcaaaaacatttcat

SEQ ID NO: 17661 - DNA, 86 bp, Homo sapiens
atgtctacaaggcaacaagtcctttgatatatagcaatgtaataacgttgtcacacagctgccaaccaagcaccggtccctgccct

SEQ ID NO: 17662 - DNA, 161 bp, Homo sapiens
  misc_feature 14: r=a or g
  misc_feature 107: s=g or c
cttgggaggctgargcatgagaatcacctgaatccagaggcggaggttgcaatgagccgggatcggaccactgcactccaactccagcctgggtgacagagtgagastcttgtctcaaaaaacaaaaacaaacaaacaaacagaaaaagtaaccctggcaa

SEQ ID NO: 17663 - DNA, 95 bp, Homo sapiens
  misc_feature 55: k=g or t
  misc_feature 68: b=c or g or t
tacattgtgtaatctaatctttataacaatcctgtaagccagacattatcatatktatttttgcagtbcagaaatattaaagtgtccaaggcctc

SEQ ID NO: 17664 - DNA, 249 bp, Homo sapiens
  misc_feature 121: w=a or t
aagctggagtgcagtggcgcaatcttggctcaccacaacctccacctcccgggttcaagcgattctcttgccttagtctcctgagtagctgggattacaggcacacaccatgcctgggttwaatttttgtattttagtagagatggcgttttgccatattggctaggctggtctcaaactcctgacctcaagtgatctgcctgccttggcctcctgaaatgcttggaaaacactcactccccaccaccg

SEQ ID NO: 17665 - DNA, 68 bp, Homo sapiens
  misc_feature 42: y=c or t
ctctggcagcctgggcagggaggcggcggggggccgcggagycgctggccatcgattctccccgcatc

SEQ ID NO: 17666 - DNA, 167 bp, Homo sapiens
tccacaggaaaattattagagctaatacatgcattcaacaaggttgtgggatacaaaatcattagagaaaaattcatagtatttcaatactttgaatgaacaatttgaaaatgaaattaaaggccagccacagtggcttgtgcctgcaatcctagcactttgagagg

SEQ ID NO: 17667 - DNA, 233 bp, Homo sapiens
  misc_feature 21: r=a or g
  misc_feature 28: r=a or g
tttgggatgtaatctgggtgrgcaagtrcatggtgcatttctttgaactttgacttgcaacaggtgggtgaggagtctcttgactcaatgaagtactgttgtctggagagtggtctgttaaagcagactttctggcagtaccttgccctatggcttaggataaagaacaaagaaaccagtggttctgttggtctggaactggattggtttttttttttttttttttttttttt

SEQ ID NO: 17668 - DNA, 206 bp, Homo sapiens
  misc_feature 29: k=g or t
cgctggtaccggttgttcctttccatgtktagtgcttcatccaggagctcttgtaatgcaggcctggtagtgacaaaatctctcagcatttgcttgtctataaaggattttatttctcctttgcttatgaagtttagtttggctggccataaaattctgggttgaaaattattttcttaaaaatgttgaatattggcccccccgac

SEQ ID NO: 17669 - DNA, 249 bp, Homo sapiens
taagtttccagataaggcttctgagaactataaataaagcatcctaagctgtttcttaaaactggtatgtcagactgtattgtaaagagttaactgtcggccgggcgcggtggctcacgcctgtaatcccagcacttaggcaggcggatcaccaggttagtagtttgagaccagcctgaccaacatggtgaaaccccgtctctacaaaaaatgcaaaaattagctgggcatggtggtgccccactgtag

SEQ ID NO: 17670 - DNA, 290 bp, Homo sapiens
  misc_feature 248: n=a, g, c or t
  misc_feature 271: r=a or g
tggacaaataatattcctttgtatagatgtagcacattttatttatccattgatcagttgatggacacttgattgtattcattttttggttattataaataatgccgctgtgaacattcatgcacaggattttgtgtggatgtctgtttttaattatcttgggtatatacctaggactggaattgtaggttatatggtcggtctatattaaaaccagacatccacacaaaatcctgtgcatgaatgtncacagcggcattatttataatarccaaaaaatgaatacaatc

SEQ ID NO: 17671 - DNA, 126 bp, Homo sapiens
atgacgcgatctcggctcacagcaacctctgcctcctgggttcaagcgatgctgtcgcctaagactcccgagtagctgggattacaggtgcccaccaccacgcccagctaattttttttttttttt

SEQ ID NO: 17672 - DNA, 122 bp, Homo sapiens
gacctctgttgatgttcgaatttcttcttgatccttgaaatgaggttaagaagcatttggctatttgatcttttcttctttctctttttcttttgagacagtcttgatttgttgcccagtac

SEQ ID NO: 17673 - DNA, 110 bp, Homo sapiens
ctcagcctttcccctagtggctcctctcagtgtgaaagcacatgtggaggagaataaaaatcatagcattagatatccttccatgattctcatgattttttttttttttt

SEQ ID NO: 17674 - DNA, 90 bp, Homo sapiens
tatttcattttccttctaaaagttatctttaaagttttttttctttctttttttctttttctttttcttttctttttctttttttttttt

SEQ ID NO: 17675 - DNA, 290 bp, Homo sapiens
tttgtttattcttcccacaacttactttactaaaattctaatcatctttgaaagatttggcttatcaggcttgtgctggcttttagcaccaagagtgtcatgtttgagaggtgtggctatctatggaaacaaagatgaaattactcaaacctatactattttgatgagtcgctcatttcaaggtattaataagtaagtattcctgtttttggaatgcataaattgtgaagagaaaagaatggagaaaggtgccagagaactggtttgggataatttatttagagggagcc

SEQ ID NO: 17676 - DNA, 92 bp, Homo sapiens
ccattgggttgtaaatagaaatatcctgtggcaacttctggaaaacattcttttattttattttttctttttctttttcctttttttttttt

SEQ ID NO: 17677 - DNA, 120 bp, Homo sapiens
ctgttgtgtgagaagagctttttaaatgttaaccactatcgtcaacatcctccttatcatctctgaaagctcttaagacagtgctttgcttgctgattagcaaacatttttgctggagcc

SEQ ID NO: 17678 - DNA, 138 bp, Homo sapiens
agattgattggagtgggagatagtgggaggagggaaatagaatacctttcagatttaaaaaaagcctattcatgaacatttaatagcaagctgctatggaaacttctgaaaatttttttgttggttttaataaattat

SEQ ID NO: 17679 - DNA, 307 bp, Homo sapiens
  misc_feature 8: w=a or t
taaatggwactggaaaacatggatagccatatgcagaagaataagatggaacccatctctcaccatatacaaaaactaactgaagatgggtaaaaacttaaatgttaagacctgaaactataaaaattctagaagaagggctaggaaaatctcttttggactttggttcaggcaaataatttatgactaaaacctcaaaagcaaatacagcaaaaacaagaaaagacaaatgagatttttttttttgaggtaaggtttctgtttttcattcattcattcattctttcttactttttttttttttttt

SEQ ID NO: 17680 - DNA, 141 bp, Homo sapiens
aatcatatatccagtctaccatggttgggcatttgggtacgttccagtttttggctaccataagcataatatgagtaataagagtaatgattaatctagaagatgtctctcagtgaccatatgttcacatttccacaggca

SEQ ID NO: 17681 - DNA, 339 bp, Homo sapiens
  misc_feature 45: s=g or c
  misc_feature 325: k=g or t
  misc_feature 328: k=g or t
  misc_feature 334: s=g or c
  misc_feature 335: y=c or t
cagtgttactttggcttgttagataagactggctgttatcaccasagaagaaaaacctcaccccctttttggtcaaaattgtagtaactgatattatttttctttaaaaaataatttgttcagataaagtctaagaaattccctattaatctctcattttttctggacaccagaactttgtaatagaattttattcatacttactcataactacactgaagttggatttatagaatattgtttgaaactgctgtttggtgaatatttttcattttattgtgctgaggaatatctgaagataccagcttaacagcctttttttttkgakgcggasycttc

SEQ ID NO: 17682 - DNA, 110 bp, Homo sapiens
taccatttaaaagtgtacagttcagtggcttttagtatattcacaaagttatacaaacatcaccactgtctaattctttttttttttttttttttttttttttttttttt

SEQ ID NO: 17683 - DNA, 149 bp, Homo sapiens
caaaaattagttgggcgtgttgacacatgtctgtagtcccaggtgtagtcctcaggaggctgaggcagaggctgcagtgagccgagaaggtgccactgtgctccagcctgagtgacagagcaaggctctgtctcaaaaaaaaaaaaaaa

SEQ ID NO: 17684 - DNA, 166 bp, Homo sapiens
tgtcagtgtgatgcacctgtgtggtgagtgttgtctgtgtatcattttccacaaacatagattttggttcatgcctgagctctctgactgataactgtcttaagattaaaaggaaaccctttggagttagtgtgcatttctggatttgtctttttttttttttttt

SEQ ID NO: 17685 - DNA, 362 bp, Homo sapiens
  misc_feature 7: m=a or c
  misc_feature 8: h=a or c or t
  misc_feature 337: k=g or t
ctgaagmhcaaacttggtttcattgatttcctctattgtttttctattctctaatatgtttatttctgatttaatctctcttattcctctcttctgctagctttggggttagttctttgtctagtttcttaatatttcgatttaggttgttgattcgggacattaccttctttttttttcttctttttttattttttattatacttttaagttctgggatacatgtgcagaagtgcaggtttgttacataggtagacttgtgccatggtggtttgctgcacccatcaacccgtcatctatgttaggtatttgtcctaacgctacccctccccttgckccccacccccaacagcccacagtgt

SEQ ID NO: 17686 - DNA, 314 bp, Homo sapiens
tagtcttgttgagaactaagttttatgcagataaataaactagaaagtgtatggtgaattgccgaaagagagaacaaaagtactgtcagtgcgcagtaactgggaagaaaacagtagtccaaagtagaggggccaaactttgaggaggaggctttggagtctggaagtgaggaaagagtgggaagggcattttatgctctgacagctacaagagcagagtcagagatatttgtaactcccagttaggagatttgaataacagaagtactctttagtatatggtgacaaacctttattttttatttactattttt

SEQ ID NO: 17687 - DNA, 386 bp, Homo sapiens
  misc_feature 34: d=a or g or t
  misc_feature 332: k=g or t
tgtcccttgcaccagatttgggaagatttctgtdattatttatctgataatgaagacatttcagccttgctatcttagtcttctctttatgggactctgatgatagggcttttagatcttttgttctgtcttacagtccctgagtctctctgttcattttgttgttgttgtctatttactttatttttttaattttattttttattttaagttctggggtacatgtgcacaatgtgcaggtttgttacacagataaatgtgcaccatggtggtttgctgcacctatcaaaccatcatctagctattaagcccagtgtgcattaactgttttkcctaatgctctcccttccaccaccccacccccggaaaggcctccatgtatgttg

SEQ ID NO: 17688 - DNA, 154 bp, Homo sapiens
aaaggaatcaacccgagtggaatggcatgcaatggaatggaatggaatggaatggaacagaatggtacggaaaagaatggaaaggaatcaacccgagtggaatggcatgcaatggaatggaatggaatggaatggaacagaatggtacggaaaa

SEQ ID NO: 17689 - DNA, 237 bp, Homo sapiens
  misc_feature 111: w=a or t
cagctcactgtaagctccgcctcccgggttcacgccattctcctgcctcagcctcttatgtagccgggattacaggcacccactaccacgcctagctaattttttgtagtwttagtagaacgggtgtttcatcatgttagccaggatggtctccatctcttgacctcgtgatccacccacctcggcctcccaaagagttgggattataggcatgagccaccgcgcccagcccctcct

SEQ ID NO: 17690 - DNA, 78 bp, Homo sapiens
atttgagtcggagtctcgctctgtctcccaggctggagtgcggtggcgctgtctcagctcactgcaggtccacctccc

SEQ ID NO: 17691 - DNA, 375 bp, Homo sapiens
  misc_feature 169: b=c or g or t
  misc_feature 330: n=a, g, c or t
  misc_feature 342: w=a or t
gcctggcctccgaggtgtctgcagcgtgctgccttcgccggggcttttcagaatgggccggggcctcgggggtcttcatccccaaggaagcctcttgatttttggcaccgcctttgtttttgggccggaagccgttgtgcggctgtcttctgtgttcgtggcggctgtbgccctttcccagtggctcggcttcattcccactgccctgcgacttggcaggcccatttagcctgttgttatgatactgtggattaaatctccgtctttggttagaagatccattctaccaaaaaagaaaagagataagtatcagatgccagcaagccactnatgacaccagtwgacatcaggaaaaccaaatctctaagccacagt

SEQ ID NO: 17692 - DNA, 86 bp, Homo sapiens
  misc_feature 25: s=g or c
  misc_feature 37: v=a or c or g
  misc_feature 68: n=a, g, c or t
ctgtgtgtggtctggtatgtgtgtstgcatgtgagtvgtatgtgggtatgtgtgagggtgtgtgtgtntgagtctgtggtgtagcg

SEQ ID NO: 17693 - DNA, 89 bp, Homo sapiens
atcatccggaatggaatggaatggaatggaatggaatggaatggaatggaatggaatcaacccgagtgcaatggaatggagtggacacg

SEQ ID NO: 17694 - DNA, 66 bp, Homo sapiens
tttaaacctgaaaagtaggaagcagaagaaaaaagacaagctaggaaacaaaaagctaagggcata

SEQ ID NO: 17695 - DNA, 60 bp, Homo sapiens
gaatgaaattacagatattaaaagtatttttagacattaaatgactaaaactaaatatga

SEQ ID NO: 17696 - DNA, 94 bp, Homo sapiens
  misc_feature 25: b=c or g or t
  misc_feature 65: k=g or t
gaaatgctactggattttgtatgtbgattttgatcctacaaccttactgaatttgtttaccagtkcaaatagctttttggtggagtcttcaggt

SEQ ID NO: 17697 - DNA, 256 bp, Homo sapiens
  misc_feature 44: s=g or c
  misc_feature 45: s=g or c
actttccaaggacgcgctggatccgcgacagccggctaccagcssccgaatccccatcctggtccctcgtccccgccagccgcgccagcgtccaagaggagcctaggggaacccgcagctggagaaggctccgcgaaggatcgcaacccgagccaggggttgcggacgaggatcagacggcctgaaactccggactgtgggccacctagtccggcaggatcttccgccagcgcctccaccttcagatgtacctacc

SEQ ID NO: 17698 - DNA, 322 bp, Homo sapiens
  misc_feature 37: v=a or c or g
  misc_feature 176: b=c or g or t
caaatacaaaaattggccgggcttggtggcgcatgcvtgtaatctcagctacttgggaggctgaggcacgagaactgcttgaacctgggaggcagaggttgcagcaagtcactgcactccagcttgggtgacagagactccatctcaaaaaaaagtcttcactttctctgtgtgtbttacaatctaagaaaggcactacttttggagaatgggtgcagaggacactcccacgaagcttgggatcccccccagtcctcctaccccaagccccaccactgggccacactggcctccttcctattccttaaataaatccatccac

SEQ ID NO: 17699 - DNA, 205 bp, Homo sapiens
cagactgcagtggcgcaatctcggctcactgcaagctccgcttcccgggttcacgccattctcctgcctcagcctcccgagtagctgggactacaggcgcccgccaccgcgcccggctaattttttgtatttttagttgagacggggtttcaccttgttagccaggatggtctcgatctcctgacctcatgatccacccgcctcg

SEQ ID NO: 17700 - DNA, 335 bp, Homo sapiens
  misc_feature 8: w=a or t
  misc_feature 57: b=c or g or t
  misc_feature 219: y=c or t
tatctgcwagccgtatgtatgtcttcttttaagaaatatctaaattcaaagtgaatbagagatttaaatgtaagatcggaaactatgaaaatagtaggaaaaaaacataggagaaaagctctgtgacattggtctagacaaggcttaaaccttgaaagcacagagaacaaaagcaactatagacacatggcattaaattaaactaaaaagcttctgcayagcaaaggaaacaatcaagagagcacaacaacctacagaatgggagaatatatttgcaacctatacatctgataaggggttaatatataaagaactcaaacaactcagcagcttaa

SEQ ID NO: 17701 - DNA, 229 bp, Homo sapiens
  misc_feature 83: n=a, g, c or t
aataaggtctgttttgccctgagatggggactgcccaactctccctataaaataccaagtgaagtaccccagatgaagcagtnaatatgtttcttatgcaagccatgttggactagctttatgataattgggatatcctctcacctaatatatctattacccagatcatggtaaatttggggattaaggaggcccctttttcatggtgcccctcccacagaatcattgt

SEQ ID NO: 17702 - DNA, 341 bp, Homo sapiens
aagtatttttccacaataaatgagcaaatttaccctctcagcaatgtctgaaagttcctctcatttcacatctttgtcaacccttggcattatccgtctgttccattttagccttctggtgactaggtagctgagctgtgcctttttactcaggcatatcttcctggtgaatagctatagtgcaatgcaaagatgcttcactggagtcccatcccttcagcctctcagctgctgcttccagaatcagcaaatatctccgtgggaaaattgaccccgaatactgggcccacttctctagacctgttctttcccaaaccttggcctggtaattcttcactacc

SEQ ID NO: 17703 - DNA, 153 bp, Homo sapiens
cagatcacaaggtcaagagatggaggccatcctggccaacatggtgaaaccccatctctactaaaaatacaaaaattagccaggcacacctgtagtcccaactactcaggtgtgcctggctaattttttgtatttttagtagagatagggtct

SEQ ID NO: 17704 - DNA, 178 bp, Homo sapiens
atggtgaaacctcatctctactaaaaatacaaaattaggtgggtgtggtggtgcacgcctgtggtcccggctactcgggaggctgagacaggagaatcacttgcaaccgggaggtggaggttgtggtgagcagagatcatgccgttgcgctctagcctgggtgataagagcgaaacct

SEQ ID NO: 17705 - DNA, 181 bp, Homo sapiens
ctgttgcctaggctggagtgcattgatgcgatctcagctcactgcaacctccacctcccaaagtgctgagattacaagaatgagccaccgcgctcggcctacgatacgatattattaactatagtcctcatgaagcatattagagctctagacttagtacataactgcaagttcataccat

SEQ ID NO: 17706 - DNA, 132 bp, Homo sapiens
ctgttacccaggcagtaatgcagtggcacaatcatggctcactgaagcctcaaactcctgggctcaagcaatctccctacctcagcctgctgactagctgggaccacaggtgtgcacaaccataccccgcat

SEQ ID NO: 17707 - DNA, 141 bp, Homo sapiens
cctcagcctacagagtagctgggactacaagcgcccagcaccaccatgcccggctaattttttgtatttttagtagagatggggtttcaccatgttagccaggatggtctcgatctcctgacctcatgatccacccgccct

SEQ ID NO: 17708 - DNA, 225 bp, Homo sapiens
  misc_feature 216: k=g or t
cctcaagtgatccacccgcctcagtctcccaaagtgttgggattacaggcatgagccaccacccccagcctcacatcctttttaagtcctgtgctagcctgcatttctctttccatcctctcgcatatcccagaagaaagaggtacttgaagagtttgcaagagatattagtagtacccgtggcggcctgaatgtggctgttttttcctctctgtkaccacccct

SEQ ID NO: 17709 - DNA, 397 bp, Homo sapiens
  misc_feature 375: w=a or t
  misc_feature 384: y=c or t
  misc_feature 396: w=a or t
aaatagcatagttttcttttgttgatgttgctgttgttcttacttgggtttgggtttttttcttttttcttttgctttcttgctttatttctcttctctaatattgctatatgactcaagttgtctcaacatttttttctcaagtgatccacctgccttggactcccaaagtgctgagatgagaggtgtgagacaccctgcccagccttcattcccttttagaattgcgtaacactctacattgtggatgtacccacgagtttcttttccattttttattttaatagagaaataaaagctcaatttaaaaaagttaatttaacttaaaggtaaacattgaaaataactgtgggtacatccacaatgtagagtgtwacgcaattytaaaagggaatwa

SEQ ID NO: 17710 - DNA, 218 bp, Homo sapiens
  misc_feature 171: b=c or g or t
ccgccacacccagctattttgtatttttagtgggaacggggtttcaccgtgttggccaggatggtctcgatctcttgacctcatggtctgcccacctcggcctcccagagtgctgggattgcaggagtgagccaccgcgcccggcttatccgactttgaagcaaacaagtbagtctatcatagtctatcatattctcaaggatcatggcagaaggcac

SEQ ID NO: 17711 - DNA, 192 bp, Homo sapiens
  misc_feature 95: r=a or g
tgcatacatgaatgacatcagcaaaaaaaaaggactgcccaaaagagaaatgggcatcagatgtgaacaggcaacagacaaaacaagcttatgaraagatgctcagtcttattaataagctggaaaatagaaattaaaacaagacttccttttcttttttcttttctttctttctttctttttttttttttt

SEQ ID NO: 17712 - DNA, 79 bp, Homo sapiens
aatgtggtatgcttgttacaaacgatgaaccaatgtaggtaggttattctgacctaaagtccgtaatttactttttttt

SEQ ID NO: 17713 - DNA, 93 bp, Homo sapiens
  misc_feature 24: m=a or c
  misc_feature 25: s=g or c
agtgacgtcgtgggctgcagcgcmsagcacccaacgcagtgagtaccttgatctcctgcgtggcctcgtccctggtcttagttccaccggaca

SEQ ID NO: 17714 - DNA, 367 bp, Homo sapiens
gtctctaaagtccattatatcactctaaatgcctttgtgtactcatagctcagctcccacttataagtgagaacatatgatttttggttttccacttttgtgttatttcacttagaataatgtccttcagctccatccaagttgctgcaaaagacattatttcattcctttttatggctgagtaatattccatggtgtgtatataccacactttctttatctgctcattagttgatgggcacttaagttggttccacatctttgcaattgtgaattgtgctgctatgaacatatgtgtgcatgtgtctttttcatataatgactcccttccctttgggtaaatacccagtagtgggattgctgaatc

SEQ ID NO: 17715 - DNA, 322 bp, Homo sapiens
  misc_feature 248: y=c or t
  misc_feature 281: m=a or c
  misc_feature 297: k=g or t
  misc_feature 316: m=a or c
tttttgtatttttagtagagatggggtttcaccatgttagccaggatggtctcgatctcctgacctcatgatccacctgccttggcctcccaaagtgctgggattacaggcatgaaccaccgcgcctggccagcatcttagttttttcttggaacaattactattatagttcttttttttttgagacagagtcttgctctgttgcacaggctggagtgcagtggtgcgatctcggctcaatgtaagcyccgcctcccgggttcatgccattctcctgcctmagcctccccagcagckgggattacaggtgcccgcmacctga

SEQ ID NO: 17716 - DNA, 124 bp, Homo sapiens
  misc_feature 47: y=c or t
  misc_feature 88: s=g or c
atgcaaaaattagccgggcatggtggcatgcgcctgtggtcccagcyatttgggaggctgaggtgggaggatcacttgaacccagctsagccgagcttgcgccactgcactccatcctgggcac

SEQ ID NO: 17717 - DNA, 74 bp, Homo sapiens
caggttcacaactaatctcctggctcagcctcccgagtagctgggagtataagcgcccaccagcatgcccaaca

SEQ ID NO: 17718 - DNA, 234 bp, Homo sapiens
  misc_feature 12: s=g or c
  misc_feature 104: s=g or c
  misc_feature 207: w=a or t
aatgcaatggasatggaatcaacccgagttcaatgaaatggagaggaatggaatggaatggaatggaaactacccgaatggaatggaatgtaatggagtgtaasggaattgaatagaatcaatccgaatgtaatggaatggaatggaacggaatggaatggaatggaatggaatggaatggaatggaatggaatgcaatggaatggwatcaacccgagtgcaatcaaatggaag

SEQ ID NO: 17719 - DNA, 136 bp, Homo sapiens
ttttagggtacatgtgcacaatgtgcaggttagttacatatgtatacttgtgccatgctggtgtgctgcacccattaactcgtcatttaacattaggtatatctcctaatgctatccctcccccctccccccacgc

SEQ ID NO: 17720 - DNA, 251 bp, Homo sapiens
  misc_feature 16: n=a, g, c or t
  misc_feature 108: y=c or t
cttcctagcagtgatngtctttacaatttggcatgtttgtgcagtggctggtaccagttgttccttttcatatttagtgcttccttcaggaactcttgtaaggctggyctggtggtgacaaaaaatctctcagcatttgcttgtctgtaaaggattttatatctccttcacttatgaagcttcgtttggctggatatgaaattctgggatgaaaattcttttctttaagaatgttgaatattggccccttc

SEQ ID NO: 17721 - DNA, 116 bp, Homo sapiens
  misc_feature 13: s=g or c
atgcagtggtgtsatcttggctcactgcaaactctacctcccggattcaagcaattccctgcctcagcctcctgagtagctgggattacaaggcgtccgccaccatgcctggctat

SEQ ID NO: 17722 - DNA, 103 bp, Homo sapiens
  misc_feature 13: k=g or t
agtcccagctackcgggaagctgaggcaggagaatcgcttgaacccaggaggtggaggttgcagtgagccgagatcacactgctgtgctccagcctcccgagc

SEQ ID NO: 17723 - DNA, 141 bp, Homo sapiens
aagttttagggtacatgtgcacaatgtgcaggtttgttacatatgtatacatgtgccatgctggtgtgctgcacccattaactcgtcatttagcattaggtatatctcctaatgctatccctccccactccccccaccact

SEQ ID NO: 17724 - DNA, 117 bp, Homo sapiens
  misc_feature 9: k=g or t
  misc_feature 11: k=g or t
tttcttttktkttggagacagagtcttgctctgttgcccaggctggagtgcagtggcgcgactggagctcactgcaacctccacttcccgggttcaagtgattgtcccaccccagcc

SEQ ID NO: 17725 - DNA, 122 bp, Homo sapiens
cataggtgctcaatgagagatactagtatccccttcgcaaattaaccttttgttaatatagtagcagtacttcttgattgccaagagtacataaatggacaatcttgtgtgctactggtgga

SEQ ID NO: 17726 - DNA, 132 bp, Homo sapiens
  misc_feature 8: y=c or t
ttgttttyttcgagacagagtttcactcttgtcacccaggctggagtgcagtggcactgtctcggctcactgcaacctccacctccgaggttgaagtgatccttctacttcagcctcctgagtagctgggac

SEQ ID NO: 17727 - DNA, 168 bp, Homo sapiens
  misc_feature 12: h=a or c or t
  misc_feature 22: k=g or t
  misc_feature 26: w=a or t
aagtaacatgghagtacctcakgcawaaatggcattagtcctaagctccccactgtggaaacctgtcttcaggcatcaggtttgtccagagttggaattagaagcaagctggcccactcacccacaccggaatagtaaggagggtgaagtctaactcctcaatgtgac

SEQ ID NO: 17728 - DNA, 428 bp, Homo sapiens
  misc_feature 11: r=a or g
  misc_feature 12: m=a or c
  misc_feature 354: b=c or g or t
  misc_feature 355: r=a or g
  misc_feature 417: m=a or c
cttgggaagcrmgtgtttgctgggaactcgaaacgcccaagcatcagatctattgagcaatcctgtttctaaagctccttccccgtggttcccaaatacccctgaccaaggaggaggatggagcaagtagactttagggctgggggctgtgacatgctgggtatggcttgcagccaagagtcaatcttcccttcactccccctagagtactagctactcagaatgagcctctgttagaagcttcgtgggtcattaattacatgtctgccgtgtcctgcgtgcacggctgggtcagtggctgtgttcgtagaaccggaagacccatgttgtccttgcacagggcaggggcagagbrtcccaggaacctggtgggttctgggttaaatgctctctttttccccctcctgtgacctcgcmtgcatcggtga

SEQ ID NO: 17729 - DNA, 209 bp, Homo sapiens
cttgaatgggagagagtgaagagacaatcaggcagggagattttctgtctttgcataaatgtcactgaaagagttttagagatcggaggggtgaggtgaagttggttaggcaattagtgataactcaaggaccagttgaaagactggaggaccctccactgctgactgtgggatcagatccttttatcctggggatgagaaaggctgaa

SEQ ID NO: 17730 - DNA, 160 bp, Homo sapiens
  misc_feature 148: w=a or t
  misc_feature 154: s=g or c
attttaacttttattttagattcagggggtacacgtgcaggtttgttacatgggtaaattgcgtgtcatgggggtttggtgtacagattattttgtcacccaggtaatgagcatagtatctgataggtagtttttcaaccctcatccwggtacsaccccc

SEQ ID NO: 17731 - DNA, 161 bp, Homo sapiens
  misc_feature 54: r=a or g
atctcatcctgaaaccatcctcacagacacacccagaaataatgattaatctaracacactgtgactagtcaaactgacaaataaaattaaccatcacacatccacccattgtcaacttggcagccatacacctattcttcttctttcttttttttttttt

SEQ ID NO: 17732 - DNA, 66 bp, Homo sapiens
  misc_feature 12: m=a or c
  misc_feature 47: m=a or c
  misc_feature 48: m=a or c
tttaaacctgamaagtaggaagcagaagaaaaaagacaagctaggammcaaaaagctaagggcata

SEQ ID NO: 17733 - DNA, 204 bp, Homo sapiens
  misc_feature 18: y=c or t
ctaacagggtgaaacctytctctactaaaaacacaaaaattagctgggcgtagtggcaggtgcctgtaatcccagctacttgggaggctgaggcaggagaatcgtttgaacctgggaggcagaggttgcagtgagccgggattgcaccaatgcactccagcctgggtaacagagcgagactccatctgaaaaaaaaaaaaaaaa

SEQ ID NO: 17734 - DNA, 157 bp, Homo sapiens
  misc_feature 24: w=a or t
tataaatcttctatgattagtgtwtttatgttctgcttacaagaggtcacattggtctgttttccatcttaaattaatatttgtgtaccgtatgaagtagatagaagttaaggttattttttgccccatatgaataaccagttgactaagcctacct

SEQ ID NO: 17735 - DNA, 148 bp, Homo sapiens
  misc_feature 65: r=a or g
  misc_feature 66: r=a or g
  misc_feature 86: m=a or c
  misc_feature 98: r=a or g
  misc_feature 99: v=a or c or g
  misc_feature 103: r=a or g
  misc_feature 104: r=a or g
  misc_feature 129: k=g or t
  misc_feature 130: s=g or c
gagggactgtttaactctacaagtttagactgtcttattcttgtcaggtcaactagttttccaarrtatgcataaattttaaatamtgtataatgatrvcagrraacagaaatgcatccctgtttcccksccctcagccccttgccca

SEQ ID NO: 17736 - DNA, 158 bp, Homo sapiens
  misc_feature 7: v=a or c or g
  misc_feature 9: w=a or t
  misc_feature 10: m=a or c
  misc_feature 11: k=g or t
cctatgvtwmkcttttattcatatttttaaaaattgaggtataatttaagtatggtaaaattcaccttttgtgcatacttctgacttttgacaaagactcataatcatgtaaccattgccacaattgagaattaggatagttccatcacctccccaaa

SEQ ID NO: 17737 - DNA, 104 bp, Homo sapiens
gaaggcccttgttcttgtggcatccttttgcagtgattccctgccaggcaaggcagtaaacctgggattgcctgcccaggactgtaatcacattgatgtcccaa

SEQ ID NO: 17738 - DNA, 87 bp, Homo sapiens
acaaaattagccgggcgtagtggcgcatgcctgtaatccctactcgggagcctgaggcaggagaatcgcttgaacccaggaggcggg

SEQ ID NO: 17739 - DNA, 142 bp, Homo sapiens
  misc_feature 25: m=a or c
ctcaagactgtaggtttatgggagmtatatagtggattagttcttctggcagccttgctctttagaccacataatcttccggtcttagcatttagcctcttgattcagactctaatgactaaattcatctggaagcccctga

SEQ ID NO: 17740 - DNA, 83 bp, Homo sapiens
catttcatatcagttcatacagatgttttctttttaacctctggatagttttttctttttttttatcccttatctccctcgaa

SEQ ID NO: 17741 - DNA, 185 bp, Homo sapiens
  misc_feature 21: k=g or t
  misc_feature 43: k=g or t
  misc_feature 44: k=g or t
  misc_feature 53: r=a or g
  misc_feature 54: s=g or c
ctcatcaaattttttcttttkttttattttttatttttatttkktttattatrstctaagttttagggtacatgtgcacattgtgcaggttagttacatatgtatacatgtgccatgctggtgcgctgcacccactaacgtgtcatctagcattaggtatatctcccaatgctatccctccccca

SEQ ID NO: 17742 - DNA, 132 bp, Homo sapiens
  misc_feature 121: n=a, g, c or t
ccacgctggccttgaactcctgacctcaggtgatccgctcgccttggcctcccaaaatgctgggattacaggcttgagccaccatgcctggcccctttaacaataagtaatgtggccaggnatggtggctca

SEQ ID NO: 17743 - DNA, 139 bp, Homo sapiens
tcagaaacgaaaaaggagacattacaactgataccacagaaatacaaagaatcattagagactactatgaacaactatatgctaacaaactgaaaaatctaatggaaatggataaattcctggacatataccaccaacc

SEQ ID NO: 17744 - DNA, 226 bp, Homo sapiens
  misc_feature 168: m=a or c
  misc_feature 169: m=a or c
  misc_feature 184: r=a or g
  misc_feature 185: w=a or t
tgggcaacaacagtgaaacaccgtctcaaaataaataaataaataaatatatgaaaattagccaggtatggtggcacacacttgtaatgccagctacttgaatggctgagacaggaaaatcgcttgagcctgggagacagaggttgcagagagctgagagcacaccammgtactccagcctggrwgacaaagtgagaatccaactcaaaagaaaaaaaaaaattaa

SEQ ID NO: 17745 - DNA, 229 bp, Homo sapiens
attctaaggagaaatcctggcagtactcaggtctgggcaccaagagcttatccatctggaatgagatggaaggaaaagaggttaccaagtgatatgtagaattggcctaaaaagcgagtgttctttaattttgagcaggccatcgtttctagcatagagagccaaacacagaacaaagactaagaccaaacaaaattaaaatgacaagataaatggaaggggcccagca

SEQ ID NO: 17746 - DNA, 84 bp, Homo sapiens
  misc_feature 82: w=a or t
taaaactggaacaactcttttaaatatatatacacacacatatatatgaagtatttatatatttaaaagagttgttccagtwtt

SEQ ID NO: 17747 - DNA, 63 bp, Homo sapiens
tagtaaaatgttaaagttgatcttacttttttcgctcctcatctctattgtttgtatgatttt

SEQ ID NO: 17748 - DNA, 91 bp, Homo sapiens
  misc_feature 62: n=a, g, c or t
ttttgtgttcccaccagcagtgtacaaaggttttaatttctccacatccttggcaacgcttnatctttttgtttttttttttttttttttt

SEQ ID NO: 17749 - DNA, 220 bp, Homo sapiens
aggaggtacgttggttccatcccccgccggcctcctcgcaccagtttgggtgaccgaggaacccccaggccggcagaggctgagccctcgggttcgagtccgtgttttcactttttgtcagactgcgggcgcagaagacgggatttgggtcaagacattcggctctggccccctggccggccgggggaaccctggaaccccatggagacagcaggtgcaa

SEQ ID NO: 17750 - DNA, 199 bp, Homo sapiens
  misc_feature 66: y=c or t
  misc_feature 99: w=a or t
  misc_feature 116: s=g or c
tatctttcctaaagaaatacctgcttacctcagttaacttttttttttatatttatactttaagtyctagggtacatgtgcacaacatgcaggtttgtwacataggtatacatgtsccatgttggtttgctgcacccatcaacttgtcatttacattagatatttctcctaacattattcctcccctaaccccccacgt

SEQ ID NO: 17751 - DNA, 153 bp, Homo sapiens
  misc_feature 149: n=a, g, c or t
ttacaggtgcacgccaccacacccggctaatttttgtatttttggtggagatgggtttcaccgtgttggtcaggttggtcgtgaactcctgatcttaggtgatccgccccccttggcctcccagagtgctgggattacaggcgtgagcnacca

SEQ ID NO: 17752 - DNA, 102 bp, Homo sapiens
ctggagactatccgccatttagttccatggcggattatggtcttggttctagcaacctgctgaagaacaaacctggtggtttattttctttctttttttttt

SEQ ID NO: 17753 - DNA, 127 bp, Homo sapiens
  misc_feature 10: y=c or t
tttttgtgtytttggtagagacagggtttcaccgtgttagcctggatggtctcgatctcctgacttcatgatccgcccgcctcggcctcccagagtgctgagattacaggtgtgagccaccccgccc

SEQ ID NO: 17754 - DNA, 68 bp, Homo sapiens
tttttggttggctatgttcctttgtttaggtacaggtaaggacctgaagcactttttttttttttttt

SEQ ID NO: 17755 - DNA, 151 bp, Homo sapiens
  misc_feature 9: v=a or c or g
  misc_feature 10: h=a or c or t
  misc_feature 24: d=a or g or t
  misc_feature 129: r=a or g
  misc_feature 141: k=g or t
tctctatgvhtctaactcctctadagactgcatataagtggaatcatacagtatttgtgcttttgtgtctggcttctttcacttagcataatgtcctgaagtttcgtccatgttatagacggcaccacratttcgatcttktttttttttt

SEQ ID NO: 17756 - DNA, 210 bp, Homo sapiens
tgctttcatacagccaacgcccagtttcctgtattcgtataacatgtctctaatttcctacttctagtactgagcacagtgtttgacatgaagtcctgttcttttgttcccctttgactaatctttggcttatactatgcagcattttttcattgatattttctttccacaaatatattgatgcctgagtgccaggcaccagacctgggc

SEQ ID NO: 17757 - DNA, 180 bp, Homo sapiens
cagtttgaaactttattttgcctttagcgttttgctattgttttttcgttgtcttttgtttcgtttcgttcctaagttctggggtatatgtgcaggatgtgcagatttgttactaaggtaaacgtgtgccatggtggtttgctgcacctgtcaacccatcacctaggtattaggcccagc

SEQ ID NO: 17758 - DNA, 205 bp, Homo sapiens
tactaccatccaagttttagagctgtgcctttcattacagaagccactagtgggcaggcacgatggctcatgcctgtaatcctagcactttgggaggccgaggctggtggatcacttgaggccaggagttggataccagcctggccaacatgacgaaacccagtctctactaaaaatacaaaaattagccgggtgtggtggcacc

SEQ ID NO: 17759 - DNA, 173 bp, Homo sapiens
  misc_feature 12: m=a or c
  misc_feature 96: k=g or t
  misc_feature 120: w=a or t
  misc_feature 128: s=g or c
caaagtgttgamagtatagataacttcttttttcttttaaaaatatcccttaaaaagatccatccatgttcactcatgtctttttttagtgactaktaagacgttgtgggcagatgggawaattaaasttatgtctgtgatcaagatagaattatcaacactcctgagtatga

SEQ ID NO: 17760 - DNA, 227 bp, Homo sapiens
cattttctttatccagtctagcattgatgggcatttaggttaattccatgtctttgatattgtgaattgtgctgtagtgaacatacacatgcatgtgtttttacaataggacaatttatactcttggggtatattcccagtaatgggattactgggttgaatagtgtagcaattcttcaaagacttaaagaaagacatactattcaacccagtaatcccattactgg

SEQ ID NO: 17761 - DNA, 138 bp, Homo sapiens
tttagggtacatgtgcacaatgtgcaggtttgttacatatgtatacatgtgccatgctggtgtgctgcacccattaactcgtcatttagcattaggtatatctcctaatgctatccctcccccctcccaccaccccac

SEQ ID NO: 17762 - DNA, 227 bp, Homo sapiens
caatttgacatgtttttgcagtagctggtaccagttgttcctttccatgtttagtgcttccttcaggagctcttttagggcaggcctggtggtgacaaaatctctcagcacttgcttgtcagtgaaggattttatttctccttcacttatgaagcttaatttggctggatatgaaattctggattgaaaattcttttctttaagaatgttgaatattggcccccatc

SEQ ID NO: 17763 - DNA, 233 bp, Homo sapiens
caacacgagtggaatggcatggattggaatagaatggaatggaatcaagccgagtacaggggaatggaatggaatggaatgcaatggaatggaatcatccgtaatggaatggaaaggaactgaatggaatcgtcatcgaatgaattgaatgcaatcatcgaatggtctcgaatggaatcatcttcaaatggaatggaatgtaatcatcgcatagaatcgaatggaattatcat

SEQ ID NO: 17764 - DNA, 76 bp, Homo sapiens
cctgtaatcccagcactttgggaggctgaggagggcggatcacgaggtcaggagatcgagaccatcctggctaaca

SEQ ID NO: 17765 - DNA, 145 bp, Homo sapiens
aataaaatatgtttattgatctttaggaaagacatttcacaaataatccttcaatgccatattaccaagtaaaattttcctctaactcaatgactaattccgcttctcgaccacagaaaaaggttgaatatgctattgtgtgcaa

SEQ ID NO: 17766 - DNA, 189 bp, Homo sapiens
  misc_feature 8: b=c or g or t
attgagtbtaaggatgaaagtgttaaaacagtaagataactgaatttgaatttggaggttgagtgtataaggctaggtactaagggtgttaactgagggatctggagctagaagtagtgaaggatggggttcaggctcccgccaggccagggaaatgctggagttggaggaatcagatacatgcaggtc

SEQ ID NO: 17767 - DNA, 165 bp, Homo sapiens
acgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccatcc

SEQ ID NO: 17768 - DNA, 250 bp, Homo sapiens
  misc_feature 167: w=a or t
accatgctgttttggctagtatagctctgtagtataatttgaagtcaggttatttgattcttctaattttctccttttgctttggattgctttggctattcaggctctttttttggttccatatgaacgttagaatacggttttctaattctgtgaaaaatgatgtwggtagtttgataggaatagtgttgaatctataaattgctttgggcagtatgaccattttaatgatcttgattcttccgatcca

SEQ ID NO: 17769 - DNA, 104 bp, Homo sapiens
  misc_feature 12: w=a or t
  misc_feature 24: m=a or c
  misc_feature 104: r=a or g
aggggccatggwtttaagtgtggmataaaatgggaaatctttggaagtttggcttttttcccactctgatttatttattaatttagtcgcagcacgggccggar

SEQ ID NO: 17770 - DNA, 117 bp, Homo sapiens
  misc_feature 61: v=a or c or g
cctgtaatccgagctatccaggagactgagacaggagaatcgcttgaacctggaggcagtvagccaagatcgcaccattgcattccagcctaggcgacagagcaagactctgtctca

SEQ ID NO: 17771 - DNA, 121 bp, Homo sapiens
ccttgggcaactaagggaaattaagtgtaggtggataatagaaatccacagataattttagctgtaactcttagcctgaagttttcatatattaggacaattaaatgtcatgtcacccacc

SEQ ID NO: 17772 - DNA, 138 bp, Homo sapiens
  misc_feature 34: s=g or c
  misc_feature 35: r=a or g
  misc_feature 38: n=a, g, c or t
tactttaagttctagggtacgtctgcacaacgtsrggntttgatacataggtatatatgtgccatgttggtttgctgcaccatcaactcatcatttgcattaggtatttctcgtaatgctatccctctgccagcccct

SEQ ID NO: 17773 - DNA, 140 bp, Homo sapiens
  misc_feature 38: s=g or c
attacattttaagttttagggtacgtgtgcacaacgtsaggtttgttacatatgtatacatgtgccatgttggtgtgctgcacccattaactcgtcatttaacattaggtatatctcctaatgctatccctcccccctct

SEQ ID NO: 17774 - DNA, 169 bp, Homo sapiens
  misc_feature 13: m=a or c
  misc_feature 18: w=a or t
  misc_feature 36: r=a or g
  misc_feature 37: s=g or c
  misc_feature 39: m=a or c
  misc_feature 62: m=a or c
actttctcatcamtgcgwtttctaatgagaaggacrsamtgtactgtgtgcttctcccaacmactttttaaatgactcctatagcttgaagaaagagcagaacttttctaggtgtttattcactgatacctggaagtagtcgcttactcatttctcttttttttttttt

SEQ ID NO: 17775 - DNA, 131 bp, Homo sapiens
  misc_feature 14: w=a or t
  misc_feature 66: r=a or g
agacaccagttgtwtttttcttctttttttctatttttttgtttttatttttgagacaccatttaraaaatgcttttaatacactttgttttcaaatttttttgagacatattcttgctgtgtcaccctta

SEQ ID NO: 17776 - DNA, 93 bp, Homo sapiens
tacaattcaatgatttttagtaactttaccgagtgatgcagctgtcaccataaatcagctttagagtacttcacctcccctgcaagatccttt

SEQ ID NO: 17777 - DNA, 61 bp, Homo sapiens
gtggatcctgtattttattatactgtattgctgaataggttgaaactggtttttttttttt

SEQ ID NO: 17778 - DNA, 124 bp, Homo sapiens
acactatctccaatggagcatctctgcagaggtggcactgcctctccttcctcccggcattcctctgccttgcttggagacccctcttctcctgcttctcttcctgcagcttcccccccccctt

SEQ ID NO: 17779 - DNA, 58 bp, Homo sapiens
atcttatctggaaagacttcatttctccttcacgtataaaggagaaatgaagtctttc

SEQ ID NO: 17780 - DNA, 56 bp, Homo sapiens
agatttggggagactatccatgaacatcagatgcctttctgtttatttaggtcttt

SEQ ID NO: 17781 - DNA, 111 bp, Homo sapiens
tgataagattcaagcccagaaattctggctccacaatctgagtgtttaaccattgccctttgttgcttctcaatatattaaaaataaatcctgttttccactcccccactt

SEQ ID NO: 17782 - DNA, 107 bp, Homo sapiens
aacatgtgccatggtagtttgctgcatccatcaacccatcatctaggttttaagccccacatgcattaggtatttgtcctaatgctatccctccccttgccccccat

SEQ ID NO: 17783 - DNA, 190 bp, Homo sapiens
  misc_feature 105: w=a or t
  misc_feature 181: r=a or g
  misc_feature 182: r=a or g
gagatgggctgaggcctctgagccatggccgagcctgggtttggatgttggtgtgacttcaaatctctttgtacctgcaggccgcattgacaggaagattgagtwccccctgcctgatgaaaagacgaagaagcgcatctttcagattcacacaagcaggatgacgctggctgatgatgtrrccctggac

SEQ ID NO: 17784 - DNA, 134 bp, Homo sapiens
aactgtgctgtttttcctctctatgccttgcttgacagtgtgccccctgcctgaattgacttttcctctccgcttctgtgggcgtactcccttaagacactcagcacttagctcctccaacccacaccccaaat

SEQ ID NO: 17785 - DNA, 100 bp, Homo sapiens
  misc_feature 69: h=a or c or t
gtctcaatctcctgaccttgtgatctgccggtcttggcctcccaaagtgccgggattacaggcgtgachaccgcgcccagcctttttttttttttttttt

SEQ ID NO: 17786 - DNA, 75 bp, Homo sapiens
ttccatctgcatgtgtacattttattttttttagcttccatatatgagtgatatttgtctttctgtgcctggctc

SEQ ID NO: 17787 - DNA, 90 bp, Homo sapiens
acacctttgcccctgctgctatgaccctgtcgccacttctgctgttcctgccaccgctgctgctgctgctggacgtccccacggcggacg

SEQ ID NO: 17788 - DNA, 118 bp, Homo sapiens
  misc_feature 38: v=a or c or g
  misc_feature 39: w=a or t
  misc_feature 80: w=a or t
  misc_feature 85: m=a or c
  misc_feature 100: w=a or t
atccaaatgatttttattatcttaacactattgaatavwtaactatttcacaactgattcgaaaggctccaagatgattwaagamgtgcagcagtgattwtttatttatttattttat

SEQ ID NO: 17789 - DNA, 113 bp, Homo sapiens
caaaattaaactggttttgaaaaaataaacaaatggacaaacctttagctagatcaactaagaaaaaaagagataagacccaaataaataaaatcagaaatgagaaaggaaca

SEQ ID NO: 17790 - DNA, 95 bp, Homo sapiens
gcatgatgtaatctgtagctaatgatcacgacttctgtattgtacccacctatgaaaagagaacaactccagtatgagaagtcctcctcccctga

SEQ ID NO: 17791 - DNA, 206 bp, Homo sapiens
atactaccatccaagttttagagctgtgcctttcattacagaagccactagtgggcaggcacgatggctcatgcctgtaatcctagcactttgggaggccgaggctggtggatcacttgaggccaggagttggataccagcctggccaacatgacgaaacccagtctctactaaaaatacaaaaattagccgggtgtggtggcacc

SEQ ID NO: 17792 - DNA, 111 bp, Homo sapiens
  misc_feature 16: w=a or t
  misc_feature 41: m=a or c
  misc_feature 110: r=a or g
  misc_feature 111: m=a or c
aactgtcctttttggwaccaaacctgaggtcttttggaagmtaatgtagaaaaccactacctattgaaggcctgttttggctaatctgtgcaaactctgatgatacctarm

SEQ ID NO: 17793 - DNA, 78 bp, Homo sapiens
agcagttggaagcggccccacgaccgccccacctcccaccttccacttttgggagaaaacaagacttttagcggctga

SEQ ID NO: 17794 - DNA, 92 bp, Homo sapiens
acgtcagatggaacagattgtggaaggaattaagcaaagtagaatgaagatggaaaagaaaaagcaagagaacaaaatgagaagagaccacg

SEQ ID NO: 17795 - DNA, 145 bp, Homo sapiens
tcccttgttgtgggctatactcaaaactatcagcttttcaggtcatggttaatgagttggcatagcacacccaaatgagatacatgttgcctacaaagagaccgagtagggattatacctcttttgtggtcataggagggccaaa

SEQ ID NO: 17796 - DNA, 260 bp, Homo sapiens
  misc_feature 57: w=a or t
  misc_feature 196: m=a or c
  misc_feature 255: m=a or c
tataaaaaaaaaagcctcagatttcaaaagttaaaatccaaaagatgtgtcacatawtaaatgaaatatactatttcattattataaatgagattcattcaggccttgaatggtggctcacgcctgtaatccctgcactttgggaggccaatgcagttggatcacgaggccaagagttcaagaccagcctagttamcatggcgaaaccccatctctactaaaaatacaaaaacttagctgggcatggtggtgggmacctg

SEQ ID NO: 17797 - DNA, 144 bp, Homo sapiens
cttgaagtccttgcttatcttttacagcttttttctttccttcatatccagttagttgcatgatcccttctgaacctctccaaaccttttttacacaaaagctatttttggtttaaaaatcctagaagatcatgtcggttccct

SEQ ID NO: 17798 - DNA, 77 bp, Homo sapiens
ggacaattctgaagagaagaaaatggtccagttttgcattagtattttttgtttgtttgcttttttttttttttttt

SEQ ID NO: 17799 - DNA, 208 bp, Homo sapiens
agagaaggaaatcaggcaggtagtggcccctgacacaatgagttttcccagaattggattgcttggaaatgccgctcaaagagtgtggtaaactccatcgaaggctaaataccaacgtgacagtgataataaacaagtactttatgggaaagttttttttttaattatttttaaaaagagagaaattgtactggagaaaagaggaatt

SEQ ID NO: 17800 - DNA, 104 bp, Homo sapiens
tgaggaatttagttcttttccaagtcccattctggttctctgtgggactcttagctaaggaatttcctttggagtcatttttggcattgcttgggtactgccac

SEQ ID NO: 17801 - DNA, 140 bp, Homo sapiens
  misc_feature 38: k=g or t
  misc_feature 56: m=a or c
  misc_feature 67: r=a or g
  misc_feature 78: r=a or g
  misc_feature 103: r=a or g
  misc_feature 111: r=a or g
tcaaggtgaatttgttagaattactgttgcattggatkgggagtatacagaaagamaagagtcacargtgagccctargatttttggcttgagcaattggaarttagggaratgtcattaattgcgatggaaaaacgtat

SEQ ID NO: 17802 - DNA, 269 bp, Homo sapiens
cgtttgtatttggatatctttaaaatagaagtaaattgagaagtcagcagaatatgtgaaattggaggtaattttgaaggagaaacaatttggagggggattggatcaaggtgtttagagtttcctcaaaatactgaatctaacccttatctgaagatcagttttgggtagagaaggagggggatgaagtttgctggaaaaaacagaacctttagttaggtgttctttgccttttggcatagactttagtgatagcagtagtgggacgc

SEQ ID NO: 17803 - DNA, 89 bp, Homo sapiens
ttttgttttgttttgtttgggtagaaacggggtctcactatgttgcccaggctggtctctagctcctgggctcaagcggtcccccacct

SEQ ID NO: 17804 - DNA, 218 bp, Homo sapiens
tttgttccaaaggttccaattattcaagactgcctttggcttcttttacaacatggatgattctatgttatgggcactgaaactaaaagaaactgtggaaggattggtaccttagagaaatgaaaaagcaaaaacatcagaaattatggtgtatttctgtaaagttagtgacactgagtgtgcccacctctcttgcctcctctttaacctcccctaca

SEQ ID NO: 17805 - DNA, 193 bp, Homo sapiens
ataaagtttttgattcaatattcatgtatcattatttattttatgtttattttattttttttgagacacagtctcactttattctcaggctgaaatgcaatggcacgatcttggctcactccacctcctgagttcaagcgattctcccgcctcagccccctgagtagctgagattacaggcacacaccacaaa

SEQ ID NO: 17806 - DNA, 72 bp, Homo sapiens
caagaatccagaaacactaaatttaaacatgaatgaattgacgttgtttgttttatagacatttaattaaaa

SEQ ID NO: 17807 - DNA, 177 bp, Homo sapiens
  misc_feature 16: h=a or c or t
  misc_feature 27: k=g or t
  misc_feature 153: k=g or t
atgcggggacggtgghgagccgcaggktgagctcctcgtggaaacgtggacgggacgggccccttcctgatgccgggcttcgaaggcttcttgcactgatgccctggggaacccctcaggaggcctctagctagcttgggtcctgtgtgaatkttttgccactttggaagcggccca

SEQ ID NO: 17808 - DNA, 97 bp, Homo sapiens
agaatgcagaaggtagtggagcgtggtggctcacacctgtggtcctagccactcgggaggttgaggcgggaggatggcttgagccaaggagggccgc

SEQ ID NO: 17809 - DNA, 147 bp, Homo sapiens
  misc_feature 132: k=g or t
  misc_feature 133: w=a or t
atttccatgattagtcatcttgaaaccccgagtgttctcagcccctgtacattcgaggaaattttgcttccctgagggtcttggcatttgcaaaggcccttggatgaaggattatgagtctgaatgtgaatkwgtcagagcagctat

SEQ ID NO: 17810 - DNA, 163 bp, Homo sapiens
ccgttggcatccgctttcaggcaggctggagacaggaggagacatttctctctgtctccggaatgtctcccatcagagacatcccctgagctgacagagctcccatctccccagctctccctcaggttctatccaagtcccttcttttgaaacccagagccca

SEQ ID NO: 17811 - DNA, 179 bp, Homo sapiens
  misc_feature 20: r=a or g
  misc_feature 54: w=a or t
  misc_feature 55: w=a or t
  misc_feature 57: k=g or t
  misc_feature 58: r=a or g
  misc_feature 76: m=a or c
  misc_feature 77: w=a or t
  misc_feature 129: r=a or g
tcttttctttcattcattcrttctttctttctttcctttctttctttctttctwwckrtctttctttctttctttmwttctgtttcgtccttttgagacagagtttcactcttgtttccacggctagargtgcaatggcgcgatcttggctcaccgcaccttccgcctcccgggttcga

SEQ ID NO: 17812 - DNA, 168 bp, Homo sapiens
  misc_feature 21: k=g or t
ccctccactttacaagcagtkaaggagttgtctaaggatttaatgctcctctgtatgactcacttttctattttcctctcattttccagatgaactttttattttaaactttatcctttgtctactcaaagcatcctcatattccacggactggagagtgccctcaga

SEQ ID NO: 17813 - DNA, 216 bp, Homo sapiens
tcttatttctccttcatttatgaagcttagtttggccagatatgaaattctgagttgaaaaatgcttttctttaagaagaaaagaaggttcttttaagaaggttaaatatcatcccccaatcttttctggcttgtagggtttccactgaaaggtctgctgttagtctgatgggatttactttgtaggtgacctggtctttctctctggctgccctt

SEQ ID NO: 17814 - DNA, 69 bp, Homo sapiens
acccgagtggaatgccatggaatggaatggaatggaatggaatggtacggaatagaatggaaaggaact

SEQ ID NO: 17815 - DNA, 169 bp, Homo sapiens
ggccaacatgatgaaaccctgtctctactaaaatacaaaaaattagctgggcgtggcagtgtgcgagtgagctactcgggaggctgaggcaggataattgcttgcacccaggaggcagaggttgcagtgagccgagatggtgccactgcactccaccctgggtgaaaga

SEQ ID NO: 17816 - DNA, 77 bp, Homo sapiens
gcagaggttgcagtgagccaagattgcaccactgcactccagcctgggtgacagagggggactctgtctcaaaaaaa

SEQ ID NO: 17817 - DNA, 121 bp, Homo sapiens
gttattggtctgttcagggtatctaattcttcctgatttaagctaggagggttgtatttttccagaaattcatccacctcttctaggatttcttattctttttattttctttctttctttc

SEQ ID NO: 17818 - DNA, 150 bp, Homo sapiens
  misc_feature 49: s=g or c
  misc_feature 50: m=a or c
actggtctttaacaagaagtgacaggataggtgaaaatgtattttgggsmaaagtattttgagttttgctgaattaatatggttggtaaatctctctctgtgtaggatcactgtttaatgaaataatgcatattttttttctgccaccct

SEQ ID NO: 17819 - DNA, 129 bp, Homo sapiens
  misc_feature 123: m=a or c
tgtatttatttatttttgtacatgagtaagttctttagcggtgatttctgattttggtgcacccatcacttgagtagtgtacactgtacccaatgtgtagtcttttatctctcgccctcctcmcgcccc

SEQ ID NO: 17820 - DNA, 115 bp, Homo sapiens
  misc_feature 100: r=a or g
  misc_feature 115: w=a or t
agtagctgggattacaggcacatgccactgtgtctggctaatttttgtattttcagtagagatggggttttacaatattggccagacacagtggcatgtrcctgtaatcccagcw

SEQ ID NO: 17821 - DNA, 201 bp, Homo sapiens
  misc_feature 21: r=a or g
cgtttctcgcggtcctgctaraacgctgtcaacctggcgctccaccagaggccccttggcttctcgggaggcgaccgaggagctctgggggcggggaggcttttacaacaagcgaaaagacggcctcaggggtggccgggaacagcctggaatcagctggaggacgtcagcaggactgaggaaagggctaccaccagctta

SEQ ID NO: 17822 - DNA, 212 bp, Homo sapiens
  misc_feature 65: s=g or c
gagaacccacagggagacccacagacacatatgcacgagagagacagaggaggaaagagacagasacaaaggcacagcggaagaaggcagagacagggcaggcacagaagcggcccagacagagtcctacagagggagaggccagagaagctgcagaagacacaggcagggagagacaaagatccaggaaaggagggctcaggaggagcccc

SEQ ID NO: 17823 - DNA, 178 bp, Homo sapiens
ccaccacgcccggctaattttttgtatttttagtagagacggggtttcaccgtgttagccaggatggtctcgatctcccgacctcgtgatctgcccgcctcagcctcccaaagtgctgggattataggcatgagccaccgcgcccagccggctctgaatctttgcaagctccacccaa

SEQ ID NO: 17824 - DNA, 128 bp, Homo sapiens
  misc_feature 19: r=a or g
  misc_feature 77: k=g or t
gttctaggtccttgaggartcggccacactgtcttccacaatagttgaactagtttacgctcccaccaacgtgtaakagtgttcctatttctccacatcctcttcagcacctgttgtttcctgacttt

SEQ ID NO: 17825 - DNA, 204 bp, Homo sapiens
  misc_feature 6: r=a or g
  misc_feature 32: r=a or g
tttagracatctctacatattccagggttttracttttttacctttccagctttttttaagttactctaagatgaaaaaggaagttgtcaaaactcctaatgtcttggtgtttatctggttctaccaagtattagcattgatactatttaagacagcgtgtcactagcacacatcccaggtggctcagcaaaagagaatgggca

SEQ ID NO: 17826 - DNA, 164 bp, Homo sapiens
  misc_feature 12: m=a or c
  misc_feature 13: m=a or c
  misc_feature 50: v=a or c or g
  misc_feature 76: k=g or t
  misc_feature 101: s=g or c
  misc_feature 152: r=a or g
  misc_feature 153: s=g or c
agacaatggggmmaatgtcacacatcacagaccaagaggcctaggaggavaagatggttttgtgggctgggcccakggtccccctgctgtgtgcagcctasggacttggtgccctgcatcccagatgctctagtcaaggcttgaggcttgcrscttctgaagcc

SEQ ID NO: 17827 - DNA, 284 bp, Homo sapiens
  misc_feature 68: s=g or c
  misc_feature 240: b=c or g or t
  misc_feature 244: w=a or t
  misc_feature 245: w=a or t
  misc_feature 246: r=a or g
gcatgaagggttgttgaattttgtcaaaggccttttctgcatctattgagataatcatgtggtttttstctttggttcggtttatatgctggattacatttattgatttgcgtatattgaaccagccttgcatcccagggatgaagcccacttgatcatggtggataagctttttgatgtgctgctggattcggtttgccagtattttattgaggatttttgcatcattgttcatcaagbatawwrgtctaaaattctctttattggttgtttctctgcccggg

SEQ ID NO: 17828 - DNA, 127 bp, Homo sapiens
  misc_feature 7: y=c or t
gtatttytagtagagacggggtttcaccgtgttagccaggatggtctcgatctcctgatcttgtgatctgcccgcctcagcctcccaaagtgctgggattacaagcgtgaccactgcgcccggccat

SEQ ID NO: 17829 - DNA, 163 bp, Homo sapiens
  misc_feature 21: k=g or t
  misc_feature 53: r=a or g
  misc_feature 54: s=g or c
attaacctttttttctttttkattatacttttaagttttagggtatatgtgcrsaacgtgcaggtttgttacatatgtatacatgtgccatgttggtgtgctgcacccattaactcgtcatttagcattagatatatctcctaatgctatctctccctcctct

SEQ ID NO: 17830 - DNA, 141 bp, Homo sapiens
actccttttgtaagattttgttccctcagcttgaggaacaacttcatcttcaactttttatttctccctgatgttacagtttggtagatttcaaactggaatagctagcatgtgcttgctaaataattttatgccagacca

SEQ ID NO: 17831 - DNA, 142 bp, Homo sapiens
ctttgaggaggtacttttattatctctatatatgtggaaactgaggcatgggagtttgatttgcctgaggttaaaccgctgggaagtgtccagttggtattgaaaccactctcaaagttctctagtgttagaaagggctgac

SEQ ID NO: 17832 - DNA, 240 bp, Homo sapiens
gcatgaaaaataatataatcagcaattattggatatagtattctgtttatcagtagggtcaatatttttctttctttttatttatttatttattatactttaagttctagggtacatgtgcacaacgtgcaggtttgttacatatgtatacatgtgccatgttggtgtgctgcacccattaactcatcatttacattagatatttcccctaatgctatccctctcctatgcccctacccc

SEQ ID NO: 17833 - DNA, 123 bp, Homo sapiens
cctcctaaaatgagttagggaggagtccttctttttttattgtttggaataatttcagaaggaatggcaccagctcctctttacacctctggtagaatttggctgtgaatccgtctggtcctg

SEQ ID NO: 17834 - DNA, 285 bp, Homo sapiens
agcatgaagggttgttgaattttgtcaaaggccttttctgcatctattgagataatcatgtggtttttgtctttggttcggtttatatgctggattacatttattgatttgcgtatattgaaccagccttgcatcccagggatgaagcccacttgatcatggtggataagctttttgatgtgctgctggattcggtttgccagtattttattgaggatttttgcatcattgttcatcaaggatattggtctaaaattctctttattggttgtttctctgcccggg

SEQ ID NO: 17835 - DNA, 129 bp, Homo sapiens
  misc_feature 58: w=a or t
agaaaaacatttgcaggagatagcaagataatagagatttgataaggtcgaagaagtwggaatcctcaaagaagattgaatagtcagtcttggatagtaacatctttcactgaaatagggacaagggga

SEQ ID NO: 17836 - DNA, 179 bp, Homo sapiens
  misc_feature 9: k=g or t
acctgagtkagaatctctaggtatagggcccaggtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttt

SEQ ID NO: 17837 - DNA, 309 bp, Homo sapiens
  misc_feature 212: w=a or t
cccagctaatttatttatttatttagagacagagtttcgctcttcttgcccaagctggagtgcaatggtgtgatcttggctcactgcaacctccgcctccctggttcaagcaattctcctgcctcagcctcccaagtagctgggattacaggcatgcgccaccatgcctggctaattttgtacttttagtagagatggggtttctccatgtwggtccagttggtcttgaactcctaacttcaggtgatcctcccaccctggactcccaaaatgctgggattacaggtgtgagccactgtgcccggccgc

SEQ ID NO: 17838 - DNA, 161 bp, Homo sapiens
  misc_feature 57: w=a or t
tttttgtccttactctcttattttattttttatttcgttttattatttttttgagawggagtctcgccctgtaacccaggctggagtgcagtggcgcgatctcggcttactgcaagctccgcagcccgggttcacaccattctcctgcctcagcctcccga

SEQ ID NO: 17839 - DNA, 166 bp, Homo sapiens
  misc_feature 38: w=a or t
  misc_feature 64: k=g or t
  misc_feature 111: k=g or t
tatatctgtaagattcatccatgtcgctggatgtagtwatagtttgtacattctcattgctatktcccatttcatttcatgaatatcccactctttattcattcccctgtkaacagtcatttggtttgttcaccgtttggggcttctatgaatagtgctagtctgt

SEQ ID NO: 17840 - DNA, 94 bp, Homo sapiens
attttgtttaggaattaaatttttttgtgagagctccaaaatgatgaaatttgaaaataagctctattaagtatactactaagtaaaaagagca

SEQ ID NO: 17841 - DNA, 162 bp, Homo sapiens
  misc_feature 4: k=g or t
  misc_feature 122: m=a or c
  misc_feature 128: s=g or c
  misc_feature 134: m=a or c
  misc_feature 141: w=a or t
  misc_feature 143: v=a or c or g
tttktgtccttactctcttattttattttttatttcgttttattatttttttgagatggagtctcgccctgtaacccaggctggagtgcagtggcgcgatctcggcttactgcaagctccgmagcccsgggttmacaccawtvtcctgcctcagcctcccga

SEQ ID NO: 17842 - DNA, 107 bp, Homo sapiens
acgcaacagctctgtacccctgcccagaacttggaactcccaggaatgctgccttccttcagcccagcctccagtcctgggttccctcaggaattcgaagaccctgg

SEQ ID NO: 17843 - DNA, 78 bp, Homo sapiens
cagtggaacagacacgatcactgatggcaccgccagtggaaaaaaacttcgtccatttcagaaatccttttttttttt

SEQ ID NO: 17844 - DNA, 118 bp, Homo sapiens
cagtgagcattacagaaatagacacgtgtgtccaacgtgggatgtgatggcgttgccttgtgggtcagtagagaagagcggccagttcagagaaggggtccggaggggcaggaagcga

SEQ ID NO: 17845 - DNA, 103 bp, Homo sapiens
atgggtggagagttaaaaaccgcagctgagctcgtgttgctgtttccaatggacagagcccggaagcaccgctttttttagttcagaaaatatggcccccatc

SEQ ID NO: 17846 - DNA, 203 bp, Homo sapiens
tagtgtgatctccactcactgcaacttcctcctcctgggttcaaacacttctcctgcctcagcctccagagtagctgggattacaggcacccaccagcatgctggctaatttttgtatttttagtagggacggggtttcaccatgttggccaggctggtctcgaactcctgacctcaggtgatccacccacctcagcccccct

SEQ ID NO: 17847 - DNA, 362 bp, Homo sapiens
  misc_feature 9: w=a or t
cctggccawcatggtgaaaccccatctctactgaaaatacaaaaattagccaggcatggtggcaggcacctgtaatctcagctactcaggaggctgaggcacaagaattgcttgaatccgggaggcggaagttgcagtagtgcaatctcggctcactgcaacttccgcctcccaggttcaagtgattctcctgcctcagtctcctgagtagctgggactagaggcatgtgccaccacactcagctaatttttgtattttttgtagagaccgggtttcagcatgttggccaggatagtctcaatctcttgacctcgtgatccgcccacctcagcctcccaaagtgctgggattacaggcgtga

SEQ ID NO: 17848 - DNA, 185 bp, Homo sapiens
ctactgatttccaacttaattccgtgtgatcagagaatattcttttaaaaacatccaaggtcctaatgctccgggatctacaggcgccggaggtgagattcagatctgtccagctggccccacagctgcaactttttgccctataatgtataatgttccctcccgtttctctttttttttttttt

SEQ ID NO: 17849 - DNA, 251 bp, Homo sapiens
cttcctagcagtgatggtctttacaatttggcatgtttgtgcagtggctggtaccagttgttccttttcatatttagtgcttccttcaggaactcttgtaaggctggcctggtggtgacaaaaaatctctcagcatttgcttgtctgtaaaggattttatatctccttcacttatgaagcttcgtttggctggatatgaaattctgggatgaaaattcttttctttaagaatgttgaatattggccccttc

SEQ ID NO: 17850 - DNA, 313 bp, Homo sapiens
  misc_feature 290: y=c or t
gagacaaggtctcactatgttgcccaagctggtctcaaactcctagactgctgccatcctctcctcggcctcccaaagtgctgggattacaggtgtgagccacggcacttggcactcaactaagaattttttttttttcagttataatggttacttttttaaattttattattattatactttaagttttagggtacatgggcacaatgtgcaggttagttacatatgtatacatgtgccatgctggtgtgctgcacccattaactcgtcatttagcattaggtatatcycctaaagctatcccacccccctc

SEQ ID NO: 17851 - DNA, 121 bp, Homo sapiens
tgagcgagaacaagcggtgtttgggtttttgtccttgagatagtttgctgagaatgatggtttccagcttcatccatgtccctacaaaggacatgaactcatcaatttttgtggctgcaca

SEQ ID NO: 17852 - DNA, 132 bp, Homo sapiens
  misc_feature 119: y=c or t
cattgacttatagaacccctaataatttccatggcctataccatgaggatgtgaaaaggccacttatcagtagtagtagcagtagtagtaatagagctgttttttcttttttttttttyccctttttttttt

SEQ ID NO: 17853 - DNA, 182 bp, Homo sapiens
tggagtccttgttattgcctatgtccagaatattatgttcggggcttttgtctagggtttttatggttttaggttttacatttgggtctttgatctatcttgagttgatttttttaataagttggaaggaagttgtccattttaaatcttctgaatatggctaaccagttatcctaggtacc

SEQ ID NO: 17854 - DNA, 132 bp, Homo sapiens
ctatccagagatacaatcatgggctatggtacaacctccaatataaaaaggttttattcttcagtcctataattttcttttttaaactggaaacatttttgttcctgatttctttctttttttttttttttt

SEQ ID NO: 17855 - DNA, 199 bp, Homo sapiens
  misc_feature 115: r=a or g
  misc_feature 116: w=a or t
  misc_feature 126: r=a or g
  misc_feature 137: w=a or t
  misc_feature 138: r=a or g
  misc_feature 167: w=a or t
tccacattcttaccaacacttgttattgtctgtctgtgatttagagccattctagtgggtgtgaagtggtatctcattgtagttttgatttgcattaccctaatgactaattatrwtgagtttgtrtgtgtgtgtgwrtgtgtatgtgtgtgtgtgtggtggccttwtatttttttttatttttttgagataggttctc

SEQ ID NO: 17856 - DNA, 240 bp, Homo sapiens
caacctctgcctcccaggttcaagcaattgtcctgcctcagcctcccaagtatctgggactagaggcatgcactaccacacctggctaatttttttgtatttttagtagagatagggtttcaccatgttggtcaggctggtctcaaactcctgacctgaaatgatccacccacctcggcctcccaaagtgctgggattacaggcgtgagccactgcccccagtgaaggtttttttttttt

SEQ ID NO: 17857 - DNA, 81 bp, Homo sapiens
gcatgagttatattatctattaaaaagtcacaatcaggcagtgcatacccctaaaatattcatattctttttttttttttt

SEQ ID NO: 17858 - DNA, 295 bp, Homo sapiens
  misc_feature 295: h=a or c or t
tgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgcch

SEQ ID NO: 17859 - DNA, 245 bp, Homo sapiens
  misc_feature 112: m=a or c
ctattttcagtagatacggggtttccccatgttagccaggatggtgtcatctcctgaccttgtgatctgcccacctcggcctcccaaagtgttgggattacaggcgtgagcmaccacgcccagccctatattctaatagtttttatttattatgtttatttaaaatttttcatctgtctcaatacttctgcttcagatattatatgttacccagtgtaggaggcggcctccaatatagccccccc

SEQ ID NO: 17860 - DNA, 187 bp, Homo sapiens
actcattatgaatttttttcttttttttaattttattattattatactttaagttttagggtacatgtgcacattgtgcagtttagttacctatgtatacatgtgccatgctggtgtgctgcaccccttaactcgtcatttagcattaggtatatctcctaacgctatccctcccccctcccccaac

SEQ ID NO: 17861 - DNA, 188 bp, Homo sapiens
ttggcatctgttcatatttttgggggtgataggggaggtttgagataggatctccctcggtcaccaaggctggaatgcagtggtgcaatcacagctcagtgaagccttgagcttctgggctcaagctgtcctcccgcctcagcctcctgagtagctgggactacaggcgtgcgaccaccataccgggc

SEQ ID NO: 17862 - DNA, 220 bp, Homo sapiens
  misc_feature 137: n=a, g, c or t
  misc_feature 138: h=a or c or t
cacgaggttaagagtttgagactagcctggccaagatggtgaaaccttgtctctactaaatatacaaaaattagctgggcgtggtggtgggtgcctgtaatcccagctagttaggaggctgaggcaggagaatcacnhgaacccaggaggtggaggttgcagtgagccaagattgcaccactgcccatctcaaaaaaataaaaaataaaaaaataaattc

SEQ ID NO: 17863 - DNA, 347 bp, Homo sapiens
  misc_feature 295: h=a or c or t
ttctattcttggggtgatagtggtagggaagaaggtaggaaacagaccatgaagtaggagagagatgaatgtgtatgcattatcatggaacacagacttttggtctgagagcaatgcttaatatattctattccctctgtgttatcccacttatctctacatatgtctagattaggagttggcaagcattttttaggaaggaacagttagtaaaccttttaggctttctgggtcaaatagtctctgttttaatcatttaactctgccactgtagccatagacaatatgtaatcahatgcatatggctgtctttcaacatgacaatagtatacatatgtaacaaacct

SEQ ID NO: 17864 - DNA, 269 bp, Homo sapiens
  misc_feature 262: n=a, g, c or t
gtatttttagtagagatggggtttcaccatgttggccagactggtcttaaactcctgacctcaggtgatctgcctgccttggcctcccaaagtgctgggattacaggtgtgagctaccacacccagcctggatgtgggcatctttaaggggtccattattctgctactacaggggcctacggccatggagtggatggtaacttgcccatcataaagactaggtcctattgctgaggtgttacctgcagcaatgttgcctacnggcagca

SEQ ID NO: 17865 - DNA, 131 bp, Homo sapiens
agtttccgggactggtgagtagtgggcgatttaaaaacccgcgagtgtagttgtgaccttcgcggtaggtgccggttggggccggctgtgattgttatcttggtgctgcagaggacagcagaagaggatgt

SEQ ID NO: 17866 - DNA, 150 bp, Homo sapiens
gaatttaacattttaggctggttgtggtggctcactcctgtaatctcagcactttcggaggctgaggtgggtaaatcacttgagctcaggagtttgagaccagcctgggcagcatggtaaaacctcatctctaccaaaaaaaaaaaaaaa

SEQ ID NO: 17867 - DNA, 344 bp, Homo sapiens
  misc_feature 342: m=a or c
cacatggtaagaagatctgagcagtgactgacacccatatgaaccttgttttataagggtttacataccatcttcttctattcagtctacagccagtagatcaaatctaacctaaggtctattttttaatagcctattaagaatggtttttgcatttctaaaggactgtgaaagaaaaaagaaagagaaatatgcgagagagatcatatgtggcacacagccttaaaatatttactgtctgaccttcacaaaaaacgatttgaaaaagttggtttagtaggatgaaaggaattaaagttaacttcagattgttgcctaaaggagaagaaaatatagaccacmtg

SEQ ID NO: 17868 - DNA, 332 bp, Homo sapiens
ttttcaaagaggtcaccagtgatgcagcatagaggtgaaagaggactaaagaaatgtggactctcacactgcacgaaagaaaaaaatccctccccattcagtatcttaaaaatcttaataatactttaaaaaaaatcagactattgcacagaactctagatttcaggcttctcttgaagtcagatctaacaactctgaccctgaatcccacccacatggcaataatttattacaatggagcaccagctgcactctttagaaaggcaagtgttcttgatttgctatagtccacacagagacttttacctcagtcaggtcatcttcctggtccc

SEQ ID NO: 17869 - DNA, 197 bp, Homo sapiens
  misc_feature 135: m=a or c
  misc_feature 148: y=c or t
  misc_feature 155: r=a or g
  misc_feature 195: y=c or t
agtcccagctactcaggaggctgaggcaggagaatcgcttgaacccagaaggcagagcttactgtgagccgagatcaccctactgcactccagcctgggcagcagagcgagactccgtctcaaaaaataaaagamaaaaaaaagagayctggaaraggagggttgaggatctgctgcagggttcaaagtcctgtycc

SEQ ID NO: 17870 - DNA, 169 bp, Homo sapiens
tgctgacagaacctccattttcttgaggaatttaagcccttcagtggttccccattgggcaaagaccaaactcctcaccatggctgtgtcccagccccaggtggctgcagactccagccactctgacattcttccagttccttggaagggagttgctcccctacctgca

SEQ ID NO: 17871 - DNA, 101 bp, Homo sapiens
caggttaattacatacgtatacatgtgccatgctggtgtgctgcacccactaactcgtcatctagcattaggtatatctcccaaagctaccccctacccaa

SEQ ID NO: 17872 - DNA, 182 bp, Homo sapiens
aatctattcttttagcgtttatgctggagggccttatagttcctttaaaagtacactgaaaatactttatatcacagcttattctaaccactggttctcaaattaaaaggtatatttcagtgcatatttcatagccacattgcagaactaatatttgaaaactcttgggggaaattttgtta

SEQ ID NO: 17873 - DNA, 199 bp, Homo sapiens
  misc_feature 22: r=a or g
  misc_feature 23: r=a or g
  misc_feature 87: s=g or c
  misc_feature 182: r=a or g
ggttggctgggcgtggtggcgrrcgcctgtggtcccagctactcaggaggctgaggcaggagaatggcgtgaacccaggaggcggasttgcagtgagccaagatcgagccactgcattcctgggggacagagtgagactccaactcaaaaaacaaaaaaacaaacaaaaaaacaaacaaagraatcatttcgaggccat

SEQ ID NO: 17874 - DNA, 69 bp, Homo sapiens
  misc_feature 12: m=a or c
acccgagtggamtgccatggaatggaatggaatggaatggaatggtacggaatagaatggaaaggaact

SEQ ID NO: 17875 - DNA, 151 bp, Homo sapiens
  misc_feature 25: w=a or t
gaatttaacattttaggctggttgwggtggctcactcctgtaatctcagcactttcggaggctgaggtgggtaaatcacttgagctcaggagtttgagaccagcctgggcagcatggtaaaacctcatctctaccaaaaaaaaaaaaaaaa

SEQ ID NO: 17876 - DNA, 182 bp, Homo sapiens
  misc_feature 22: w=a or t
  misc_feature 23: w=a or t
  misc_feature 27: w=a or t
cctgaaacctcagttaatttgwwtgtwagctttaagttttgtaggggattctttgggattttctatacagaagatcattttgtctgaaaataaagataatatactgttttaactgccattttgaaagtggttccagaatgttttgataaaataagggagaaatggcagactctgatcggtaa

SEQ ID NO: 17877 - DNA, 52 bp, Homo sapiens
caatcctgccctcctcctccatatttccttcctatctgtgtggattcttttt

SEQ ID NO: 17878 - DNA, 199 bp, Homo sapiens
gactcaaataaatcaatcagaaatgagacattacaactgataccacagaaatgcaaaggattgtaagaaactactatgaataggccgggcacggtggctcaagcctgtaatcccagcactttgggaggccgaggcgggtggatcatgaagtcaggagatcaagaccagcctggctaacacggtgaaaccccgtccccac

SEQ ID NO: 17879 - DNA, 154 bp, Homo sapiens
  misc_feature 2: k=g or t
  misc_feature 3: w=a or t
  misc_feature 4: w=a or t
  misc_feature 112: n=a, g, c or t
akwwtggaatggaaagaattggaatggaatggaatcgaatggaatggtatggaaaggaatggaatggaatggaatcaacccgagtgcaggggaatgtaatggaacggagtgnaatggaatggaatggaatggaatggaatggaatggaatgtag

SEQ ID NO: 17880 - DNA, 143 bp, Homo sapiens
ccacgaccctcaaactagaacaacactggctcctccccagtcctccagctccatgacccttaaactagaacaccaccaccagcttctcccctggtctccagctccataaccctcaaactagaaaacactggcaccacccacga

SEQ ID NO: 17881 - DNA, 171 bp, Homo sapiens
atttttttttctactaacatatcactaagaatcctccctattgcctgtcactgaagttcatttgctttgactgctttataatctttgtataaatgtaccacagttcagtcatccattactattgctgtctttgaggtcgttccatgttttttttgttttgttttttttttt

SEQ ID NO: 17882 - DNA, 124 bp, Homo sapiens
ggaggccaaggcggatggatcacttgaggtcaggagttcaagatcagcctggccaatacggtgaaaccctgttggccaggatggtctctatctcttgacctcgtgatctgcctgccccggcctc

SEQ ID NO: 17883 - DNA, 168 bp, Homo sapiens
  misc_feature 115: w=a or t
actctgtctcaaaaaaataataaaataaaataaataaaaaatcagacatgacataggtcctcaaaaagcgttgttgaattaatttgcttttcatctccttttattcatttttctwtatttttctccacctcctgttttaattttttttagaaactgggcctcactctt

SEQ ID NO: 17884 - DNA, 140 bp, Homo sapiens
  misc_feature 111: w=a or t
  misc_feature 136: s=g or c
atgatttgccggcgactgtagcgccggtcccggccacaagctgtcggctcggttcggtcgcgttacagggcaggcgccggggccaaggcagggagggatcttaggagagawcgtagggtgagccacagctgcgcasccaa

SEQ ID NO: 17885 - DNA, 274 bp, Homo sapiens
  misc_feature 146: w=a or t
  misc_feature 215: s=g or c
  misc_feature 222: y=c or t
  misc_feature 224: m=a or c
  misc_feature 240: k=g or t
  misc_feature 248: m=a or c
  misc_feature 254: k=g or t
  misc_feature 259: m=a or c
  misc_feature 261: s=g or c
  misc_feature 264: m=a or c
ctctgtcgtccaggctggagtgcagtggtgcaatctcggctcactgcaacctccgcctccagggttcaagcaattctcccaccttagcctcctgagtagctgggactacaggcacgtatcaccacacccagataattttttttttwattcttagtagagacggggtttcaccatgttggccaggctggtcttgaactcctgacctcaggtgatcsgcccgcytmagcctcccaaagtgckgggattamaggtgkgagtmastgmacccggccga

SEQ ID NO: 17886 - DNA, 356 bp, Homo sapiens
tagtggggttgtgttcttgatttcactctcagcctggatgttataggtgtatagaaatgctactgctttttgtatattgattttgtgtcctgaaactttatttttttatttttatttttttcagacaaggcctggctctatcactcaggccagagtgcagaggtgctatctcaactcactgcaacctccgcctcacagcctcaagccattctcccaactcagcctcccaagtagatgggaccacaggattgtaccaccacactcggaaaatttttgtgtttttggtagagatggtgtttcgccatgttgcccaggttggtctccaactcctgagctcaagcgatctgcccgccact

SEQ ID NO: 17887 - DNA, 176 bp, Homo sapiens
cccatattcattagctcaattaacaaaagggaaattatataactccctataatctcctcataaacaaataaataaccatacctttacattcttttataatactatgagcttgttctggcaaatctgccttcttcatattaacaaaaagggataaaatttcaagtcctttttccttt

SEQ ID NO: 17888 - DNA, 112 bp, Homo sapiens
agaaccttcctgccgtcgcgtttgcacctcgctgctccagcctctggggcgcattccaaccttccagcctgcgacctgcggagaaaaaaaattacttattttcttgccccac

SEQ ID NO: 17889 - DNA, 272 bp, Homo sapiens
  misc_feature 257: v=a or c or g
tttgtttgttttctttaatcctcgtcaactggacatggtgcggttaagagaggcaagtatgtgtgagcctggacagctttccagctctaggggcagaggaggtttgatagcccttcatggcagggtgcatgcgatgagttttgcttgccggcatagataaacttgactatgtctgttctactcaatttgatgtatagtttgaaaggtaatgctgtattacgaataaaataatgggtatatctacctaaaaaggagavattacaatggggtgc

SEQ ID NO: 17890 - DNA, 336 bp, Homo sapiens
  misc_feature 285: k=g or t
  misc_feature 295: b=c or g or t
ttttattttattatttatttatttatttattttgagatggagtctcactctttcgcccaagctggagtgcagtggtgtgatctcggcttgctgcaagctccacctcccgggttcacaccactctcctgcctcagtctcccgagtacctgggactacagggaccatgcctggctaattttttatatttttattagagacaggttttcatagtgttagacaggatggtgtcggtctcctgaccttgtaaaactgccccacccctatcttccttgctggctctctttkcagcctcagbccacctgcacccaggtgattaaaaagctttattgcggccag

SEQ ID NO: 17891 - DNA, 195 bp, Homo sapiens
gtgaattgccaattaatttccctttttttcttttactttaagttctgggatacatgtgcagaacgtacaggtttgttacgttggtatacatgtgccatggtggtttgctgcacctatcaacccgtcatctaggttttaagccccacatgcattaagtatttgtcctaatgctctccctctccttgccccccaaaa

SEQ ID NO: 17892 - DNA, 277 bp, Homo sapiens
tttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaact

SEQ ID NO: 17893 - DNA, 193 bp, Homo sapiens
tctttccatgaaacttctaattcatggactatatgttgaaatcttttgctttttaaattgtccaaagcggtttatttgctgtgtctgccatcccattacccaccagatatataccacccctgtgttactctctctgtcctgttcatctttctaactcttagtgcaatttaggattacagcagactcccccatg

SEQ ID NO: 17894 - DNA, 168 bp, Homo sapiens
  misc_feature 157: y=c or t
gaattggaagtggtgggaatagtaatgcaaagactttgtgtcaaaaatcagtttggggattttcaaggaattacaagaaggctagtgtgccagagttgggagagtgctggggtatgaagtggtggtggtggtggtgcatgctagtaggaaatgagaytgagaattggc

SEQ ID NO: 17895 - DNA, 57 bp, Homo sapiens
cttttactttatgaattggaaaaattaaatttgcatgtagtttgtaaaaaaaaaaaa

SEQ ID NO: 17896 - DNA, 314 bp, Homo sapiens
  misc_feature 126: k=g or t
  misc_feature 134: b=c or g or t
cttcaaggaacatccctctatctagtagagggagattgtatgcatgaacatatataaaaatgaaagtgtaagtgtatgtagaactatatatggagtggttggaagtacaaaagagggagtgttttkttcttctbatggggtaggggggtaatatcagaaatattcatagagggggtgactcttgaaggatcagttttctctggaaggttatggcctttgaaataaaaattattccagatagagcaccaggagtgaaggccttgagatgtaagatagcctaggcatgttggggcccatagtactgctggagtaag

SEQ ID NO: 17897 - DNA, 116 bp, Homo sapiens
  misc_feature 4: m=a or c
  misc_feature 12: m=a or c
tgamaatgatcmaatgggctgggtgtggtcccagcactttgggaggccaaggcgggtggatcgccggacgtcaggagtttgagaccagcctagccaacatggtgaaaccctgtcta

SEQ ID NO: 17898 - DNA, 64 bp, Homo sapiens
attggaaagtgttgagtataccagtttattttatttatttatttatttatttatttatttttat

SEQ ID NO: 17899 - DNA, 111 bp, Homo sapiens
ttgccacactgtcttccagaattgttgaactaatttgcattcccaccaatagtgtaaaagtgttcctatttttccacagcctcaccagcatctgttgtttcttgactgttt

SEQ ID NO: 17900 - DNA, 146 bp, Homo sapiens
tgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgg

SEQ ID NO: 17901 - DNA, 84 bp, Homo sapiens
aagactatactttcagggatcagttctatagtgtgttactagagaagtttctctgaacgtgtagagcaccgaaaaccacgagat

SEQ ID NO: 17902 - DNA, 148 bp, Homo sapiens
  misc_feature 12: s=g or c
tacatttgccasgatttggagggcaggggtagtcctgttgttatgaatactcagtggctccagttagctgggtctgggcctttctctggagatataatcttgggatggacccaagttctggcttggccattgaagaagcgaggcccaa

SEQ ID NO: 17903 - DNA, 153 bp, Homo sapiens
ctgaggatactttccatggatacgattaagagctgacaataggccgggcatggtgactcacgcctgtaatccccgcactttgggaggctgaggcaggcggatcatgaggtcgggagtttgagactagcctggccaatgtagcgaaaccccgtc

SEQ ID NO: 17904 - DNA, 123 bp, Homo sapiens
cttggcaaaattggatttcttcaaaaatacatgtaaaggtctgttgttgaattgtactctgcccctggaagcagatacagatggctgcctgctgctcggctttgcttttgcttttcccaccgc

SEQ ID NO: 17905 - DNA, 300 bp, Homo sapiens
taacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccacctcc

SEQ ID NO: 17906 - DNA, 195 bp, Homo sapiens
ataattcccacatgttttggtagggacttagtgggagatgattgaatcacggggtgggtcttttccatgctgttctcatgatagtgaatgagtctcatgagatctgatgcttttaaacatgggagtttccctgcataagtcctctctttacctgctgtcatccatgtaaaatgtgacttgctcctcctggcctcc

SEQ ID NO: 17907 - DNA, 154 bp, Homo sapiens
tattattattatactttaagttttagggtacatgtgcacaatgtgcaggtttgttacgtatgtatacatgtgccatgttggtgtgctgcacccattaactcgtcatttagcattaggtatatctcctaatgctatccctcccccctccccccac

SEQ ID NO: 17908 - DNA, 289 bp, Homo sapiens
  misc_feature 34: y=c or t
ataaataggccgggggcggtggctcacgcctgtyatcccagcactttgggaggccgaggtggacggatcacggggtcaggagatcgagaccatcctggctaccacagtgaaaccccatctctactcaaaatacaaaaagttagccgggcacggtggcgggcgcctgtagtcccagctacttgggaggctgaggcaggagaatggcgtgaacccggaaggcagagcttgcagtgagcggagatcgcgccacagcactcccgcctgggcgacagaacgagactccatctca

SEQ ID NO: 17909 - DNA, 162 bp, Homo sapiens
atctcatcctgaaaccatcctcacagacacacccagaaataatgattaatctaaacacactgtgactagtcaaactgacaaataaaattaaccatcacacatccacccattgtcaacttggcagccatacacctattcttcttctttctttttttttttttt

SEQ ID NO: 17910 - DNA, 381 bp, Homo sapiens
  misc_feature 57: w=a or t
  misc_feature 275: r=a or g
  misc_feature 277: n=a, g, c or t
  misc_feature 352: n=a, g, c or t
  misc_feature 354: n=a, g, c or t
  misc_feature 355: m=a or c
  misc_feature 366: n=a, g, c or t
aaaaaaacaaaaaaattagctgggcatggtgacgggcacctgtaatacccacctacwagggaggctgaggcaggataatcgcttgaactcgggaggccgaggttgcagtgggccaagattgcaccattgcactccagcctgggcaacagcatgatcttgactcactgcaaccaccgcctcccaggttctgcctcagcctccagagtagctgggattacaggcgcccgtcaccacacccaactaatttttatacttttagtagagacggagtttcrcnatgttggccagggtggtctagaactcatcctgacctcaggtgatccgcccgcctcagcctcccaaagtgctgaantnmaggcatgaacnattgcaccccgccaa

SEQ ID NO: 17911 - DNA, 109 bp, Homo sapiens
ggatgtgagggcgatctggctgcgacatctgtcaccccattgatcgccagggttgattcggctgatctggctggctaggcgggtgtccccttcctccctcaccgcccct

SEQ ID NO: 17912 - DNA, 332 bp, Homo sapiens
  misc_feature 317: s=g or c
gtgagccactattctggcctgcctgacttcatcagccggtgaaccagggcaggtgtgggaggctgcgtacgcatgggatatctgcacggctggctgtgggcagttatggttgtgggtgtaacctgtgagcacagggctctaggactcagcacagagggagccctggggtcaccctgcatctcttgctgacctgagacattgagaaagtagattgtaagacactcagcgtcactccaaaacagccaagtacggaactcctaagtgttcacccaagttgggcagggtaaggagggccatgttcaactccaggtggggasactatgtagaccccc

SEQ ID NO: 17913 - DNA, 119 bp, Homo sapiens
gtacatgtgcacattgtgcaggttagttacatatgtatacatgtgccatgctggtgcgctgcacccactaatgtgtcatctagcattaggtatatctcccaatgctatccctcccccct

SEQ ID NO: 17914 - DNA, 215 bp, Homo sapiens
  misc_feature 120: r=a or g
  misc_feature 122: m=a or c
tcaagaccagccaacatggcgaaaccccgtctctactaaaaatacaaaaattagctgtgtgtggtggcacacacctgtaatcctagctacttgggaggctgaggcaggggaatcgctggramctggaaggtggagattgcagtgagccgagatcgtgtgactgcactccatcctgggcttcagagtgagactgtcttaaaaaaaaaaaaaaaaaa

SEQ ID NO: 17915 - DNA, 152 bp, Homo sapiens
  misc_feature 102: k=g or t
cagccctcagtcctcccaggatgttcttcccagcactgctgcctcgtgcggattttcccgtaacctcagtaactggcttcttgtccccctgcttcctaccakggaagccttcctgtccgcgtctgtggtttcccaactctgatatttgctca

SEQ ID NO: 17916 - DNA, 188 bp, Homo sapiens
  misc_feature 118: r=a or g
  misc_feature 126: r=a or g
gggagaatcacttgaacctgggaggcagaggttgtagtgagccaagatcctgccactacactccagcctgggcgacagagcaagactctgtctcaaaaaaataaataaaaatttaaaratttaaaraaagtccaaataattggggtatgatttaaagatagctatatgagaccttgttcaggggtacc

SEQ ID NO: 17917 - DNA, 191 bp, Homo sapiens
  misc_feature 120: s=g or c
  misc_feature 177: m=a or c
agtcgtgagccactgctcctggccggcagtcgatttttttaaattttaagtgtcttcctgttagtgccttatgatcacatcttagtaaaggagagttattagttttaagagtatctgggscatggaaattacttttattatttaatatacattttccttctgtgtagacagaaggamtccttctgtgtaga

SEQ ID NO: 17918 - DNA, 125 bp, Homo sapiens
aaaacaacccgagtacaggggaatggaatggaatggaatacaatggaatggaatcatccgtaatggaatggaaaggaatggaatggaatggaatggaatggaatggaatggaattaacccgaaat

SEQ ID NO: 17919 - DNA, 275 bp, Homo sapiens
ctcaaaaaataaaaaaaatttggggtaataaaattatcagggctattgtaggaatttttataaaggaagaattgagggaaatatctaggtttgcatcctcagcaatgtggtagatactgctgccatttactgagatggacaaaagcaggaggacagcagtttgtgaggactaccaaaaattccgtgtagaaatgagggcttgaatggaaatgtaaacgctttttggttctaacatacaatagggcattggtctgaagtgatgtcacccagctcgc

SEQ ID NO: 17920 - DNA, 93 bp, Homo sapiens
tttttttaagagacaaggttttactctgtcacccaagctatagtgcaatggcatgatcacatctcacttgaactcacttctggtttcaagtga

SEQ ID NO: 17921 - DNA, 267 bp, Homo sapiens
  misc_feature 110: k=g or t
tttctttgatgtctgtagtttattcagattatttggggaggtttcagttttgagaatctgtatttttctagaacttgaccattttgtatagattttaaaatacatttttktttcttttttttgagataagagtcttgctctgtggcccaggctggagtgcagtggcgctatctcggcttgctgcaagctccgcctcccaggttcacgccattctcctgcctcagcctcccgagtatctgggactacaggccctcgccaccacgccca

SEQ ID NO: 17922 - DNA, 224 bp, Homo sapiens
cattttctgtcacttctctgctgaactctagtgttctttcttagaggctgtactcaaagtttcattatccattcagtatttttattcttctttgtggaggtggcaagtgctaggtgcctctagtcaatcatcttgaagccccctgttatgttaaagtctttaatggaaaaagaagacaacatgcatgaccaggcagatactttgagcagagtcataggaaccac

SEQ ID NO: 17923 - DNA, 200 bp, Homo sapiens
  misc_feature 46: y=c or t
  misc_feature 47: y=c or t
  misc_feature 68: s=g or c
atcccttctctcttccttggtgcttctttttcctgctcggtgagtyygtttgtttgtttgtttttgasacagagtctcactttgcttcccaggctggagtgcagtggtgcgatctcagcttactgcagcctccgcttccggggttcaagcgattctcctgcctcagcctgccaagtagctgggactaccggcgcccacct

SEQ ID NO: 17924 - DNA, 86 bp, Homo sapiens
ctgtgtgtggtctggtatgtgtgtgtgcatgtgagtggtatgtgggtatgtgtgagggtgtgtgtgtttgagtctgtggtgtagcg

SEQ ID NO: 17925 - DNA, 170 bp, Homo sapiens
gaacaacgattgccaagagctggcttcggggaagttctcggggctgggctggaggagctacagtgtctgaatcccgcctggaaggacgctcgagaccaccctgccggttctcccagccttctccgagctgagctgtggttggggacactggggttggggagggggcagct

SEQ ID NO: 17926 - DNA, 76 bp, Homo sapiens
cagtgagccaagatcgtgcctctgcactccagcctgggtgacacagcgagacttgatctcaaaaaaaaaaaaaaaa

SEQ ID NO: 17927 - DNA, 122 bp, Homo sapiens
tagagacggggtttcaccatgttggccaggctggccttgaactcctgacctcaaatgatccacccgcctaggtctcccaaagtgctgggattacaggcatgagccatcacgcccggctgcca

SEQ ID NO: 17928 - DNA, 242 bp, Homo sapiens
gtggtgcatgcctgtaatcccagcactgtgggagaccaaagcaggaggactgcttgtgcccaggtgctttagaatagcctaggcaacatagcaagaccccatctctacaaaaaatttaaaaattagctggttgtggtggtgcacacctgtaattccagatacttaggaggctgaggtgggaggatcacttgagcccaggagtatgaagctgcagtgagtcgtgttcacaccactgcactcca

SEQ ID NO: 17929 - DNA, 56 bp, Homo sapiens
attgaactcaaaaaaaaaaaaaaaaaaaaaaaaaaaaaaaaaaaaaaaaaaaaaaa

SEQ ID NO: 17930 - DNA, 105 bp, Homo sapiens
ttcagtcttggcagtttgtatatgttgagtagtatatccatcttctaggttttccaatttgttggcatgtagttgttcataactgtttctaatgattccatttct

SEQ ID NO: 17931 - DNA, 138 bp, Homo sapiens
  misc_feature 43: y=c or t
  misc_feature 48: n=a, g, c or t
ctgttgttccttgactttttttttgtttgttttgagacgaagytcgcntctgttgccaggctggagtgcagtggagcgatctcggctcactgcaacttatgcctccccagttcaagcaattcttctgcctcagcccaa

SEQ ID NO: 17932 - DNA, 93 bp, Homo sapiens
  misc_feature 4: k=g or t
  misc_feature 7: y=c or t
tttkttyaagagacaaggttttactctgtcacccaagctatagtgcaatggcatgatcacatctcacttgaactcacttctggtttcaagtga

SEQ ID NO: 17933 - DNA, 112 bp, Homo sapiens
  misc_feature 12: y=c or t
tgaggaagtcayattgtaaggttttctgattaggattaggatgatttttaaataatagaatggaatacaccaagtagagaaataaatggaacaatctgcttgaagcaaaaaa

SEQ ID NO: 17934 - DNA, 274 bp, Homo sapiens
  misc_feature 112: b=c or g or t
  misc_feature 130: h=a or c or t
caaaaccattcacttgaattaattttctccaggcagaggctcgtctgcttgaggaacaacgaagagttcaggtttaccttcatgaaagcacacaagatgaattagcaaggabatgtgaacaagtcctcahtgaaaaacacttggaaattttccacacagaatttcagaatttattggatgctgacaaaaatgaagatttgggacgcatgtataatcttgtatctagaatccaggatggcctaggagaattgaaaaaactgttggagacacacga

SEQ ID NO: 17935 - DNA, 84 bp, Homo sapiens
  misc_feature 73: y=c or t
  misc_feature 82: y=c or t
aaaaaagataggtttaaaatggtaatccttgtttagtggtggattgtgtgtgtgggggatgtcacattgcttycggagaggycc

SEQ ID NO: 17936 - DNA, 217 bp, Homo sapiens
tttgtttttggcttgttttatattagtcaactatcattctaatttctttttcttccattagtttgtatttatatgtacttgtactttttttttactggttatcctagaaatttcaatactcatctctaacctattgtgattaatcttaagttaggatttaaatatttgtcaagtaatgtaagaaccataaaaatgtttaactctgtttacaccccca

SEQ ID NO: 17937 - DNA, 265 bp, Homo sapiens
  misc_feature 41: k=g or t
  misc_feature 42: k=g or t
  misc_feature 43: k=g or t
  misc_feature 47: y=c or t
  misc_feature 168: k=g or t
atttttcgagttggcattggattattcatcaataccatttkkktttyctttcaaatctttacatttcttctggatcccaggccaaagttccatgacttgatcatctgccacttggtcctcagtcatattctaatgctccttactgcagtggatttttttcctcaagtkgtgtttgaatcactgaatttgggaatggctttaaatgtaagctattattttacacaaaaagggtgataagaggcatctccctctgtcccccctggct

SEQ ID NO: 17938 - DNA, 266 bp, Homo sapiens
agccactgcgcccagccttattgatttattctttctacctttgtttaattaccacctcctctatgccaggcactgtacagtgtaggcacaggggtgaagaaaacaggcaagtttccctaccttgatggaggttacagtctggtagattaaatatagaattaaatgaggccatcagtataaatttctcagctcagagcccagcctgcagtaaccaaagctaaggtgactataattagagcaactgaactctaggctcctctgccctg

SEQ ID NO: 17939 - DNA, 106 bp, Homo sapiens
ccacccacctcggcctcccaaattgttgggattacaggtgtaagccaatgtgcctggccaaaggcacttatttttgagatggggtcttgttacataacccaggcca

SEQ ID NO: 17940 - DNA, 327 bp, Homo sapiens
  misc_feature 47: w=a or t
  misc_feature 48: w=a or t
atggtctttacaatttggtatgtttttgcactggctgataccagttwwtcctttccttatttagtgcttccttcaggagcccttgtaaggcaggcctggtagtgacaaaatctctcagcatttgcctgtccttaaaggaatgtatttcgccttcacttatgaagcttactttggctggatatgaaattctgggttgaaaatccttttctttaagaatgttgaatattggcccccactctcttctggctgtagggtttctgcagagagatccactgttagtgtgattggcttccctttgtgggtaacccaccctttctctctggctgc

SEQ ID NO: 17941 - DNA, 133 bp, Homo sapiens
aagcatctttaaagttatgccaccctgcggagtatgtaaatgttgaataataaattctttgttttctttttatgtttgttttagatgatgataattccgaagaaggcttccacactattcattcaggaaggcc

SEQ ID NO: 17942 - DNA, 220 bp, Homo sapiens
  misc_feature 194: y=c or t
  misc_feature 213: m=a or c
  misc_feature 220: s=g or c
acaaaggacagttggaaacttctgctttttgtacaataaaatctgcagtggtcttggtaacgacctttccaattgtggtattattgttttagctctattggttacgaggaagagtcattccaagggagtttattgtgaggttaaaatgggccatcttctggccatcctaggaaaaaaaaaaatcgttgtatagyccatgggctggattaaggmccggacs

SEQ ID NO: 17943 - DNA, 208 bp, Homo sapiens
  misc_feature 20: h=a or c or t
  misc_feature 173: y=c or t
tatggagtctcacgcttgthgcagtggcatgatctcagctcactacaaccccatgtctaccaaaaatacaaaaaattagctgggcatggtggcgggcacctgtaatcccagctactggggaggctgaggcaggagaatcgcctgagcctgggaggcggaggttgtagtgagcygagatcatgccactgcaacaagcgtgagactccat

SEQ ID NO: 17944 - DNA, 347 bp, Homo sapiens
  misc_feature 240: n=a, g, c or t
  misc_feature 244: n=a, g, c or t
  misc_feature 317: n=a, g, c or t
  misc_feature 318: d=a or g or t
  misc_feature 323: s=g or c
  misc_feature 333: k=g or t
  misc_feature 334: h=a or c or t
  misc_feature 340: n=a, g, c or t
  misc_feature 341: k=g or t
gctcactgcaggttccacctacctcccaggctcaagtgatcctcccacttcagcctcctgtgtagctgggactacaggcatgcactaccatgcccggctaattttttattttttgtagagacaagatttcaccatggtgcccaggctggtcttaaacttctaggctcaaggggtccgcctgccttggccctccaaagtgctgaaattacaggcgtgcgtcactgcaaaaaataaaaaatnagcngggcatggtagtgcatgcctgtagtcccagctactcaggaggctgaggcaggagaatggcgtgaacctgggandcggasttgcagtgakhcgagtnkcaccac

SEQ ID NO: 17945 - DNA, 175 bp, Homo sapiens
agagtacctgaaaaccttagagaaccctggggaaatatttatagccaggcttcttggagactctgggaacaggaaagtcaggaaccctgcctttcaggaactgctgtatctcagtcggcttcttcatttcatggtttctctctgtgtagctgctttatttcctcttcaggcttac

SEQ ID NO: 17946 - DNA, 279 bp, Homo sapiens
  misc_feature 266: n=a, g, c or t
  misc_feature 267: h=a or c or t
ctattgtgaataatgctacaatgaacatgtaagtgcatatatctccttgagattctgatttcaatttttttgcaaatatacccaaaagtgggattgcaggatcacatggcagtctttttttattttattttattattattatactttaagttttagggtacatgtgcacaatgtgcatgttagttacgtatgtatacatgtgccatgctggtgtgctgcacccattaactcgtcatttagcattaggtatatctcttaatgctatnhctcccccatctc

SEQ ID NO: 17947 - DNA, 119 bp, Homo sapiens
agagaaagagaaacgggagcaagagagaaggaggcccagacagtgagggcaggagggagagaagagacgcagaaggagagcgagcgagagagaaagggttctggattggagaggatagc

SEQ ID NO: 17948 - DNA, 137 bp, Homo sapiens
accaagtagctgggactacagccatttgacaccccacccagttaatttttgttttttgtttttttgtaaagacaaggtttagccatgttgcccaggctggtctggaacccctgggttcaagcaatcctcccacctca

SEQ ID NO: 17949 - DNA, 164 bp, Homo sapiens
tctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccccctg

SEQ ID NO: 17950 - DNA, 90 bp, Homo sapiens
ggaaaaagatgttcattactgcgacataacatttcttaatacaagtgactcgtctatagcagtaggtagttcctaatttttttttttttt

SEQ ID NO: 17951 - DNA, 159 bp, Homo sapiens
  misc_feature 134: k=g or t
tatagcagtgtgagaatgaactaatacagaaagttggtaccgagagaactggaccactgatttgaagatacctgaaaatgtgaaagcaactttgaaactgttccagcctctgcccattacacagtttcaaagtkgctttcacattttcaggtatcttca

SEQ ID NO: 17952 - DNA, 52 bp, Homo sapiens
actccagcgcgggcaacaagagtgaaactccgtcccaaaaaaaaaaaaaaaa

SEQ ID NO: 17953 - DNA, 417 bp, Homo sapiens
  misc_feature 97: w=a or t
  misc_feature 107: k=g or t
  misc_feature 291: w=a or t
  misc_feature 300: n=a, g, c or t
  misc_feature 301: n=a, g, c or t
  misc_feature 302: m=a or c
  misc_feature 318: r=a or g
  misc_feature 334: k=g or t
  misc_feature 336: w=a or t
  misc_feature 351: m=a or c
  misc_feature 371: m=a or c
ctttgttttgttatctgctcatagtcaatgtggtcaattagaattgcagacttgcttatttcatgttttttaaactttttgtttttgtttttttttwagcccttggkgtgtaagtccaatacaattaataagcgtacagctcctccaggatctggcacctgccaacatgtctttctttttttgagacagtctcactgtgtcaccaaggctggagtacagtggcacaatctcagctcactgcaacctccacctcccgggttgaagtgatcctcctgcctcagcctcccaggwagctgagannmcaagcacgtgccaccraacccagctaattttkgwatttttagtagagamagggtttcaccatgttggcmaggctggtctcgaactcccgacctcaagtaatccaactgcctctgc

SEQ ID NO: 17954 - DNA, 204 bp, Homo sapiens
catctcatctccttaccagtctctctgcctccagagtcttgtttgtctccctcagctgctgtgattctcatctttaaacactcaggttggattcttttacttctgactccataaagtcaagtcccggttccttggtggggttctggtcacagccggccatttctagcttgcacctcttcatgcaccaacagtgaaatgaccaca

SEQ ID NO: 17955 - DNA, 220 bp, Homo sapiens
  misc_feature 12: s=g or c
tcttcaacgctstcacacagggacatttaagtctgcagaagtttccgctgccttttgttcagctatgccctcccctcagagatggagtctacagaggcaggcaggcctcattagctgcggtggactccacccagttcgaccttcccggccactttgtttacctactcaagcctcagcaatggcggacaccacgcccatggagccttggtcactggtagca

SEQ ID NO: 17956 - DNA, 322 bp, Homo sapiens
  misc_feature 306: k=g or t
  misc_feature 307: y=c or t
atcaccttctatggaaaattttgcttataaaaagagattctaactttaaaatgtttgggcggccgggcgaggtggctcacgcctataatcctgacactttcggaggctgaggtgggtggatcacctgatgtcaggagttcgagaccagcctggccaacgtgatgaaaccctatctctactaaaaatacaaaaactagccaagcgaggtggctgacgcctgtaatcccagctacccgggaggctgaggcaggagaattgcttgaacctgggaggcagaggttcaagtgaactgagaccgtgccattkyactcaagcctgggcg

SEQ ID NO: 17957 - DNA, 205 bp, Homo sapiens
acctctttatcattatataatgactttgtctcttttttctaggttttgtcttgaaatatattttgtttacgtacagctacccctgctctttcttggtttccattgacatggaatatcttttttcatccctttttttcagtctatgtgtgtctttataggcgaagtgtgtttttgtaggcaacacatcattgagtctttttttttt

SEQ ID NO: 17958 - DNA, 148 bp, Homo sapiens
  misc_feature 12: y=c or t
  misc_feature 32: r=a or g
tccttacgtgtyacatccagttgatttgagaraatatgattctgaattttccatcaattggattggcagtccctttcagctttacagctttacatcatctacagatttgttaagtatgttctcttggtcttctaattcactgatggac

SEQ ID NO: 17959 - DNA, 169 bp, Homo sapiens
  misc_feature 12: y=c or t
  misc_feature 13: y=c or t
  misc_feature 14: h=a or c or t
  misc_feature 22: y=c or t
gttttttttgtyyhttgttttytgtttttgagatggagtcacgcactgttgcccaggctggagtgcagtggcatgatctcggctcactgcaacctccacctcccaggtttaagagattctcctgcctcagcctcccgagtagctgggactagaggcacgcaccaccacg

SEQ ID NO: 17960 - DNA, 245 bp, Homo sapiens
  misc_feature 217: y=c or t
  misc_feature 218: b=c or g or t
tcaaccatgccatgtgaaataaacacgtcatggggaatggggtacccacccctcaagcctttatcctttgagttacaaacaatccaattatactctttaagttattttaaaatagacaattaagttactattgactatagccatcctattatgctatcaaatagtaggtcttattcattctttttatttttttggtacccgttaaacattcccaacybcaccccaacaccccactacccttccca

SEQ ID NO: 17961 - DNA, 211 bp, Homo sapiens
ctccgaccggatgattctccgaagttacaccatcaacctgtccctctgaagtcaagccgcttctctctaacatccaactgtggtcctgtctactggctgaatatggggtttttatatgtacaggatgggacgggacagggccatgggttgtttaggaaaaggcagtattcgggcgggaaaacagggatataagttctcattttgggcggaa

SEQ ID NO: 17962 - DNA, 190 bp, Homo sapiens
  misc_feature 54: w=a or t
  misc_feature 55: h=a or c or t
  misc_feature 123: w=a or t
caggagttcgaggctacagtgagctgtgatcacacaactgcattccagcctggwhgacagagcaagatcatgtttcaaaaaaaaaataaaatcagtaaacattttaaaattttgcatcattawatggctcttgttgctaaatcataacagccataaaatgatgcaaaattttaaaatgtttactgatttt

SEQ ID NO: 17963 - DNA, 335 bp, Homo sapiens
tatctgctagccgtatgtatgtcttcttttaagaaatatctaaattcaaagtgaattagagatttaaatgtaagatcggaaactatgaaaatagtaggaaaaaaacataggagaaaagctctgtgacattggtctagacaaggcttaaaccttgaaagcacagagaacaaaagcaactatagacacatggcattaaattaaactaaaaagcttctgcacagcaaaggaaacaatcaagagagcacaacaacctacagaatgggagaatatatttgcaacctatacatctgataaggggttaatatataaagaactcaaacaactcagcagcttaa

SEQ ID NO: 17964 - DNA, 170 bp, Homo sapiens
ttttgactgatatcaaattctaggtggaccgagattttctttcagtctttcaaagatattactctattgccttctatcttgcatagtttctgatgagaagtctgttgtatttcttatgtgtttcttcatatgtaacatcttttttctttttttttttttttttttttttt

SEQ ID NO: 17965 - DNA, 82 bp, Homo sapiens
  misc_feature 35: w=a or t
agactatactttcagggatcagttctatagtgtgwtactagagaagtttctctgaacgtgtagagcaccgaaaaccacgagg

SEQ ID NO: 17966 - DNA, 360 bp, Homo sapiens
  misc_feature 322: w=a or t
  misc_feature 341: h=a or c or t
ggcaaaccgagaagagctgcagtgacagaaaaggccacagtagcagggttaatatttaaattggaggccacagattcaagaaattatttaaaggcatatagaaaatccagatataatctgcaattgatatcagagtgtcatctctggcttaagtggcatttccagataggattttccatgcttcctatgcgagaagtaggctcgattatagaactagtttgtaaaagctcattatgtctgtctcttctcaactccgtgttcaatgaggtcaagtttgtgaagtttgtggcttgaaatcagctatggtgcaaatatctacagwatgaatatcagcagcagthacaaatcagtctctagctc

SEQ ID NO: 17967 - DNA, 290 bp, Homo sapiens
atgaaagtgggcaaccttgtataccatatcttagaggaaaggctttcagtttatcctcattctgtataatactagatgtggatctgttgtatgtgacttttattatttttaggtgtgttccttctatactcagtgttttgagagtttttatcttgcgggatgacaaattttattaaatacttttccagcgtcagttggaatgatcatatggtttttgtccttcattctgtgatgtgatgtatcacgtttatggctttgtgtatgttgaaccatccttgcatccctgggat

SEQ ID NO: 17968 - DNA, 150 bp, Homo sapiens
gtgggtgcctataatcccagctagttgggaggctgaggcaggagaattgcttgaacccgggaggtggagattgcagtgagccgagattgtgccactgcactccagcctaggcaatacagtgaggctccgtctctttaaaaaaaaaaaaaa

SEQ ID NO: 17969 - DNA, 146 bp, Homo sapiens
  misc_feature 4: r=a or g
ccarcaatgatagactggattaagaaaatgtggcacatatataccatggaatactgtgcagccataaaaaatgatgagttcacgtcctttgtggggacatggatgaaattggaaatcattattctcagtaaactattgcaagaaca

SEQ ID NO: 17970 - DNA, 223 bp, Homo sapiens
aaaacaggatgttgaattttgtcaaatactttttctgtatctattgagatgaccatatgattgttatcctttattctgttaatatggtgtatcacatttataggttttcatatgttgaaccttgcatcaacatatatccacatccatatggaatctgtccatatctaccccaactttggaaagttttccgcctttgtttctttaaataagctttctgccccat

SEQ ID NO: 17971 - DNA, 182 bp, Homo sapiens
ccaatttcaggaaacttagcataaatacaatactttcaactaaatattgttttggtcaattgcctcggtgatgtcctttggagcagttttattccccagtgcaggatacagtccaggatccttcatgcatttgtagtaaataaaatacagttcatcttttttttttaacttttttttttttt

SEQ ID NO: 17972 - DNA, 124 bp, Homo sapiens
  misc_feature 11: m=a or c
aaaaagagtgmatgggagagggagaggaagaaggagagatagcaggtgtggaccggctgtcttcagggcaggcatttgaacaccttggagttcacagagactctgcagtggtgtgtgggcagca

SEQ ID NO: 17973 - DNA, 83 bp, Homo sapiens
gacacgcttccatttcccagtttctttctctccttctctttttttcttttagtacaattcttttttttttttttttttttttt

SEQ ID NO: 17974 - DNA, 103 bp, Homo sapiens
aacaccaccacgcccggctaatttttgtatttttagtagagacggggtttcaccgtgttggccaggctggtctcgaactcctgaccttgtgatccgcccccct

SEQ ID NO: 17975 - DNA, 83 bp, Homo sapiens
ttgtaattttagtaaagacatggtttaaccatattggccaggctggtctcaaactcctgactttaagtgatctgcccaccgaa

SEQ ID NO: 17976 - DNA, 111 bp, Homo sapiens
ccttagtcatttctgattgtgcttatttggaacttctctcttcttttctttgtcaatctagttattttttctgttatcctttagccaacttttactttcattgtttctttt

SEQ ID NO: 17977 - DNA, 120 bp, Homo sapiens
  misc_feature 72: r=a or g
aactctacaaaatgttttttttgtagaaaaaacaaaaacaaaattttttagaaaaaacaaatacaaaacaaracaaaacctactaggccatggtggcatgcacctgtggtcccagctggg

SEQ ID NO: 17978 - DNA, 315 bp, Homo sapiens
tatacaacaatttttagagtatgtaaaacccctgagaccaaaacacttaagaattattgacttaggggccgggcacggtggctcgtgcctgttaattccagcactttgggaggctgaggtgggtggatcacttgagatcaggagtttgagaccagcctgaccaacatagtgaaaccctatatctattaaaaatacaaaaattagtcaggtgtagtggcgggcgcctgtaatcccagctactcaggagacagaggcaggagaattgattgaacctggtaggcggatgttgcagtgagctgagatcatgaaactgca

SEQ ID NO: 17979 - DNA, 131 bp, Homo sapiens
tcagaggcagaattgcttggactcgggggtggatcgaatgcatggagtgagggaaagggaacacttggaggactcctggtttcctggtttgagaaactaggtggatagttagtaccatttagggggtggac

SEQ ID NO: 17980 - DNA, 155 bp, Homo sapiens
  misc_feature 127: r=a or g
aattggccgggcgtggtggtgcacgcctgtggttccagccgcttgggaggctgaggcacgagaattgcttgaacccggaaggcagatattgcagtgggccgagatcccaccaaagtactccagcctrggtgagagtgagactctatctccaaaaa

SEQ ID NO: 17981 - DNA, 180 bp, Homo sapiens
  misc_feature 8: w=a or t
ttgctgtwactgctgttttttaagaattatgagtgttggccaggcgcggtggctcatgcctgtaatcccagcactttgggaggccaaggcgggtggatcatgaggtcaggagatcaagaccagcctggccaacttggcaaaaccctgtctctactaaaaaagtacaaaaattagcagggt

SEQ ID NO: 17982 - DNA, 176 bp, Homo sapiens
  misc_feature 11: w=a or t
ctaaaaatacwaaattagccaggtgtggtggcgtatgcctgtaatctcagctactcaggaggctgaggcaggagaactgcttgaacccaggaggcagaagttgcagtgagccaagtcgcaccactaactcgagcctgggagacagagtgagactctgtcttaaaaaaaaaaaaaaa

SEQ ID NO: 17983 - DNA, 202 bp, Homo sapiens
ctttcctttatcactctcttctttctttctttcttgtctcgttgtgctacccaggctggagtgtagtggtgcaattatggcccactgcagctcaccctcttgggctcaagtgaccctcccgtcttggcctcctgagtagttgggactacaggtgcacaccaccatgcctgactaattttcttttcttttttttttttttttt

SEQ ID NO: 17984 - DNA, 144 bp, Homo sapiens
ctttatagcagcatgatttatagtctatgggtatattcccagtaatgtgatggctgggtcaaatggtatttctagttctagatccctgaagaatcgctacactgacttccacaatggttgaactagtttacagtcccaccaacg

SEQ ID NO: 17985 - DNA, 110 bp, Homo sapiens
  misc_feature 43: s=g or c
aagtggaaaccgtgggcaaaagttagctggcaggacagcgcastcctccaggcagcggaggcagcgcgtcccggctctcagggacatttccttcccacctcgacccccca

SEQ ID NO: 17986 - DNA, 143 bp, Homo sapiens
ccacaccaggctaattttttgtatttttagtagagatggagtttcaccatgttggccaggctggtcttgaactcctggcctcaggtttccacctgcctcagcctcccaaagtgctgggattacaggtgtgagccaccggcccc

SEQ ID NO: 17987 - DNA, 155 bp, Homo sapiens
gtgtgctccctgctcgggatgggggaattggtttccgtgccacgggttggctacttgccccgcagaggccctccggatgaggagaagagtgactttggtaaacatggaggacgcatagcccaccctggagagagccctgcaggaggacagaggga

SEQ ID NO: 17988 - DNA, 276 bp, Homo sapiens
  misc_feature 12: m=a or c
taaggaagtgamaatatatttactattcattaagtggaagtggattattctaaaggtcttcatcctcgtcgtcttcacattgaataggccgaggaggaggaggaagaggtgggattggtctgctctctcaggaatgggggagctggaagaaaactcatgtataagtgaatccaggcagttcaaacccgtgttgatcatgggtcaacggtaaatgaatgggcgaggctttgttccaatacaaccaacatttatgaaccctgaaatttgaagggcaca

SEQ ID NO: 17989 - DNA, 204 bp, Homo sapiens
gttttatatgtttgtatattttcatgttgctgtttaacagctttcattttaatatgaggaactgtcttaagcatttcttataaagcagtttgagtgctgttgtactccttcagcttttgtttgtgtggaaaagtctttatctcacattttcaaagctaagttttgctgggtatgatattcttggttaaaagttttttttttttt

SEQ ID NO: 17990 - DNA, 107 bp, Homo sapiens
catatggtgttataactatttttgacactccgttcccctcaataggctgtgagcctttcacaaatgggtttttacatatatctgtgttaagtaataataaggctgga

SEQ ID NO: 17991 - DNA, 241 bp, Homo sapiens
tgggtagatgggtaggtagatgggtagatgggtggacggtgggtagatggctgggtggatgggtgaataggtaggtggatgggtagatgggctggccagcgagctggctataccttggagcagtcatccttgcctttgccaaccctatgaggcccaggtgactgcactcccctgtaggccctacatgggcttatttatttcatgtttttgaaaagcactttttctgtgacttcccccgaaa

SEQ ID NO: 17992 - DNA, 143 bp, Homo sapiens
  misc_feature 8: s=g or c
  misc_feature 12: s=g or c
  misc_feature 47: s=g or c
agcgctasggtsgaggcgcgcagagcacggaggaggggaccagccasagagacccacactgggcagcgctatgggaaggggctccatgagaaggaaggagacgccgaggaagagtgggcggccagcacctgcagaccccaact

SEQ ID NO: 17993 - DNA, 232 bp, Homo sapiens
  misc_feature 153: k=g or t
agacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgkgagtgtgagcgagagtgtgtgtgtgtccatctaagtctgtgtgatgaaggtgggataaggctcctctgttagtgcaggt

SEQ ID NO: 17994 - DNA, 186 bp, Homo sapiens
tttagggaatcaagatattctatttaatagagctatagataaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcggg

SEQ ID NO: 17995 - DNA, 65 bp, Homo sapiens
acaagaagaagccaccttccctacatcttattactttattttattttatttcttttttttttttt

SEQ ID NO: 17996 - DNA, 163 bp, Homo sapiens
  misc_feature 69: m=a or c
  misc_feature 126: m=a or c
caatttcaacatattaagtgaatatgtattcttaaaagatccactactttacatttagatgcgttaggmtgtattagaaataaaaacagaagaaaagatttagaatctagtctgtctttgccactmaagctagttaccctctctgagttttatacccccttat

SEQ ID NO: 17997 - DNA, 163 bp, Homo sapiens
  misc_feature 42: k=g or t
  misc_feature 43: k=g or t
  misc_feature 76: y=c or t
  misc_feature 99: w=a or t
  misc_feature 142: w=a or t
  misc_feature 143: w=a or t
tttcgagcagggaaaatggggtgggaagaacaaaaaccccakkactgagtgaagaaaataaatgagaaatcaccayagtgaaagtaaaagacgagagtwcgaactcagcaagttctcatcgaagcagctttcttttttcttwwcttttctttttttttttttt

SEQ ID NO: 17998 - DNA, 193 bp, Homo sapiens
  misc_feature 150: r=a or g
ctgtctttcttgaactcctagagtcctaataattagatattacgtatcctaggctggatcttgtaacttttttttactctgacttcccatttttttctcttatacttttttaaaaaaaaaaatccaatccattaacaggcaactgcagcrgaacaattttcagaattgctaaaacacgagaggaaacagaacc

SEQ ID NO: 17999 - DNA, 107 bp, Homo sapiens
  misc_feature 12: s=g or c
tgagttgtggastgttcctgcctatttgttttctgaaagtgattgtgtagaattggagctattttttactttttttttgagacttagtctcactctgtcacccaggc

SEQ ID NO: 18000 - DNA, 187 bp, Homo sapiens
cagggagggccaggagcccaggagttcgagaccagcctgggcaacagggcgagaccccatcttttttgtttgttttgttttgggtggagtttcgccctgtcacccaggctggagtgcagtggcatgatctcggctcgctgcaaccttcgcctcccgggttcagatgattctcccgcctcggcctccc

SEQ ID NO: 18001 - DNA, 119 bp, Homo sapiens
accttccttctctccttctttccttccctccttcatgtctttctcttcctctctccctccatctctccctccttccctcgcttccttcctccttttgaccttccttccttccctccctc

SEQ ID NO: 18002 - DNA, 158 bp, Homo sapiens
tcacgcctggcctagaccaccctattttaaatggatcaccccatcccactactgccctgcattcagcatgcatgattttctccatcgtacccacccctacgtattatactattttacattgtttttaatgtgtcttgatttttttttttttttttttt

SEQ ID NO: 18003 - DNA, 177 bp, Homo sapiens
taataagtgaaagaagaaagctctctgcagtggagaggggagtcagagtggattgccacttttacagttgaatccacaagcttttatgagaaactgctctccaacacattcaaaagctagcagacagcaagaaacaactaagatcagagcagaattgaaggagatagagacacaacc

SEQ ID NO: 18004 - DNA, 186 bp, Homo sapiens
tggaaacttctgtaatgatggaaatgttctgtgtgtgctaggacgggagccacaagccatgtgtggctactgagcacttgaaatgtgagtagagcccttgagtttttaattttacttggttttgttttgttttgttttgagacggagtctcgctctgtcacccaggctggaacacagtggcacgac

SEQ ID NO: 18005 - DNA, 160 bp, Homo sapiens
tacattcaaggttagtattgatatgcatgtatttgatcctgtcattgtgttgttagctgtttattatgctgacttgtttgtgtggttgctttatagtgttacttgtctgtgtacttaaatgtgtttttgtagtggctagtaatggccttttctttccttt

SEQ ID NO: 18006 - DNA, 179 bp, Homo sapiens
ctccggggagcctgggggactccctctggctttggtgtgcttcagtctgcagtcacaccacaatgaaggctcgcagttgaggcttttagtctcactttccacatttctgtctagggctgtttagagatttcttgatattttacttcctttcccatataaaatttagtgtgcatttcttt

SEQ ID NO: 18007 - DNA, 187 bp, Homo sapiens
  misc_feature 26: k=g or t
  misc_feature 27: k=g or t
actcattatgaatttttttctttttkktaattttattattattatactttaagttttagggtacatgtgcacattgtgcagtttagttacctatgtatacatgtgccatgctggtgtgctgcaccccttaactcgtcatttagcattaggtatatctcctaacgctatccctcccccctcccccaac

SEQ ID NO: 18008 - DNA, 193 bp, Homo sapiens
catcacagtttttgctgtttacctatattttaaactagcttaaaaagttttctaattcatttctttaaaggaagctgtatatcacataaaatctaaatcactcaaaattatgggtttgatgggcttttctaatatacagtttgtattgtatatctaagatcacctccccaaccaatctttgggacacttggct

SEQ ID NO: 18009 - DNA, 147 bp, Homo sapiens
  misc_feature 12: s=g or c
  misc_feature 116: w=a or t
  misc_feature 147: k=g or t
gcaagaaagcasatagcagccctcagccagagttggggctttgtagatggacattatggagagtacaatattggcaagatgtcactgaaacagtgtgctctggaatgtggccctawagatggaaggaagggaagaaagaagaggtak

SEQ ID NO: 18010 - DNA, 106 bp, Homo sapiens
ttatttactgattacttttgtgtcatgaggtttcttcaggaccagtggaagatatgaatatgagtgagattttctgacttcagaagcttatttatcatgggagagt

SEQ ID NO: 18011 - DNA, 85 bp, Homo sapiens
  misc_feature 69: y=c or t
gcctcacatagttcccctgtacctatcacacagacataaattcgttgagcatctatagttttgtttgtytgtttgtttatttgat

SEQ ID NO: 18012 - DNA, 79 bp, Homo sapiens
ttttgtatttttagtagagacggggtttcaccttgttagccaggatggtctctactaaaaacacaaaaaattagccggg

SEQ ID NO: 18013 - DNA, 97 bp, Homo sapiens
tacgagatgtgtgcatatatacacatatgtacaggcatatatatacatatatgtatgtatgcacatgtctgtctgtgtgtatgtaattagagagaca

SEQ ID NO: 18014 - DNA, 120 bp, Homo sapiens
gctctgcacatttttgtttattcctagatgttttacattgtttgttgctatcatgaatggtctgtttttttcttattagatgttctaattgattattgcttctcagagtaatgctattga

SEQ ID NO: 18015 - DNA, 308 bp, Homo sapiens
  misc_feature 137: h=a or c or t
  misc_feature 138: m=a or c
gtggtgtataactcagccctacctcaagagttactgatgtgtaccattggtctaaaactatagtataaaaaattttgcaaactttagtataatttaaacaacttagaattttgacatgaaaatagtatgaaatgtahmttgtaaaacctctaccctttaaatgttttacctcagcaccacaagacagggtgagaaaatagaaaaataaacaaacaaaaatacatgtttcacttcttggtttttctaactgtggtcagtgtcagcatgatttttcatccctggaaaccacagatcagcctctgatagtc

SEQ ID NO: 18016 - DNA, 174 bp, Homo sapiens
  misc_feature 28: k=g or t
  misc_feature 104: w=a or t
gttgaacatcaagaatctcactgcatakacttccccaagggcagtcccacttcacaaaatgaattttcattttccaaagcacatcccttagttggatttctgtwtttcagtgtatttgtttaagctctgatgccatgtccaaaaaagaacatgcccgaacaattcccagcccat

SEQ ID NO: 18017 - DNA, 238 bp, Homo sapiens
ccctgctttcatttcttttgggaatatgcctagaggtggaactgctggatgatctggcagttctacttttaatttttttgtttttgttttgagttggagtcttgctctgtcactccggctggagtgcagtggcgcagtctcggctcgctgcaacctctgccgcccgagttgaagcaattctcttgtctcagcctcccgagtagctgggactacaggcgcgcaccaccacacctggcaa

SEQ ID NO: 18018 - DNA, 341 bp, Homo sapiens
  misc_feature 314: s=g or c
gaactaaagtttttaaacttttagtttgtgacttttagctttcagttttttttgcaagggggtggcttaattttttgtttgtttgtttgtttgtttttgggagacagagtcttactctgtcacccaggctggagtgcagtggcgtgatcttggctcactgcaacctccacctcgcgggttcgagcaattctcctgcctcagcctcccgagtagctgggactaccggtgggtgccaccaggcccagctgatttttgtatttttagcagaggtgaggtttcaccatgttgaccgggatggtctcaatctcttgacstcgtgacccacccaccttggcctccct

SEQ ID NO: 18019 - DNA, 193 bp, Homo sapiens
  misc_feature 21: v=a or c or g
  misc_feature 26: k=g or t
  misc_feature 29: k=g or t
  misc_feature 33: k=g or t
  misc_feature 50: s=g or c
  misc_feature 60: y=c or t
  misc_feature 87: k=g or t
aaggcagagggatcagttgavcctgkgakttckagtccagcctgggcgasatagtgagaycccttctaaaaattaggcaaggtggtkcacgcttatattcctagctacttgggaggctgaggtgggaggattgtttgaatctaggatttgaaggttacagctatgattgtgccactgcactccaacctgggca

SEQ ID NO: 18020 - DNA, 158 bp, Homo sapiens
  misc_feature 1: m=a or c
  misc_feature 4: m=a or c
  misc_feature 8: m=a or c
  misc_feature 12: s=g or c
  misc_feature 94: y=c or t
  misc_feature 95: y=c or t
  misc_feature 96: y=c or t
matmagamacasggcgcctgccaggctgtgtgccgtgtggcaggtgagatcctggctctgagctcatctcgaagggccgtgggcctgtgtgtayyytgagcattgtgcagtaaggggtggggcatgggaggccaggactctggaagccgaagaggtgc

SEQ ID NO: 18021 - DNA, 187 bp, Homo sapiens
aataaaaaaacaaaaattagccaggcgtggtgatgggtgcctgtagccccagctgctcggaaggctgaggcaggagaattacttgaacccaggaggcgggggttgcagaaagcggggatagcgtcattgcactccagcctggaagacagagtgagactctgtctcaaaaaaagaaaaaaaaaaaaaa

SEQ ID NO: 18022 - DNA, 242 bp, Homo sapiens
  misc_feature 12: y=c or t
  misc_feature 233: s=g or c
  misc_feature 237: s=g or c
cttacctttatycataattgtccctaatgaagagacccctgtgcactttaattttctgtgtaattttgttgtgctttgcattttagagcctggcagatgtagacatttaacaaatgttctagaaatgagctaaaattttcctgtgcatttgtttgtttatcactagtctaaaatattgcttggttggggaggggtgttgatgttatgtagtagctttcattttgagaggagasagasagaag

SEQ ID NO: 18023 - DNA, 107 bp, Homo sapiens
  misc_feature 12: y=c or t
ggtgcatatttygcaaatattttctctcattctgtaggttgtctgttcactctgttgatagtttcattcactgcgcagaaagttttttgtgtagttaccatttgtct

SEQ ID NO: 18024 - DNA, 84 bp, Homo sapiens
aggccaaatcactttggtactctgggactctggctagaactacaggcttttgttactgtccagcatccaagtaacttttttttt

SEQ ID NO: 18025 - DNA, 122 bp, Homo sapiens
tagagacggggcttcaccatgttggccaggctggccttgaactcctgacctcaaatgatccacccgcctaggtctcccaaagtgctgggattacaggcatgagccatcacgcccggctgcca

SEQ ID NO: 18026 - DNA, 58 bp, Homo sapiens
gaggcaggagaatcacttgaacccaggaggtggaggttgcagtgagactagatcgcac

SEQ ID NO: 18027 - DNA, 161 bp, Homo sapiens
  misc_feature 10: y=c or t
  misc_feature 13: y=c or t
  misc_feature 14: w=a or t
  misc_feature 24: w=a or t
  misc_feature 145: m=a or c
ttcttttatytaywtatttatttwtccagatggagtctcactctgtcgcccaggctggagtgcagtggcgcgatctgggctcactgcaacctccacctcctgtgttcaagcagttttcctgccttacctcccgagtagctgggamtacagatgcccgccac

SEQ ID NO: 18028 - DNA, 205 bp, Homo sapiens
  misc_feature 28: m=a or c
ccacgtgttgtgggagggacccagaggmagacaattgaatcctgggggtggtttctcccatactattctcatggtagtgaataagtctcatgagatctgatggttttatgtggggaaaccttttcacttggtcctcactctctcttgtctgctgccatgtaagacatgccttttaccttccatcatgattgtgcggcctccccgt

SEQ ID NO: 18029 - DNA, 122 bp, Homo sapiens
  misc_feature 21: b=c or g or t
gtagctgggattacaggtgcbcgccatcacacccagctaatttttgtatttttagtagagacggggttttaccatgttgaccaggctggtcttgaactcctgatctcaggcaatccacccag

SEQ ID NO: 18030 - DNA, 172 bp, Homo sapiens
  misc_feature 37: s=g or c
  misc_feature 53: s=g or c
  misc_feature 159: h=a or c or t
ttttttttttgagacagagtctcgctctgtcatctcsgctggagtgcaggatstctgctcactgcaagctcccctcctaggttcacgccttctcctgcctcagcctcccgagtagcgggcacggtggcgggcgcctgtagtcccagctactcgggagghtgaggcaggagaa

SEQ ID NO: 18031 - DNA, 328 bp, Homo sapiens
  misc_feature 3: w=a or t
  misc_feature 7: m=a or c
  misc_feature 95: w=a or t
  misc_feature 110: r=a or g
  misc_feature 117: r=a or g
  misc_feature 118: w=a or t
  misc_feature 155: y=c or t
  misc_feature 157: r=a or g
  misc_feature 158: r=a or g
  misc_feature 224: y=c or t
  misc_feature 259: m=a or c
  misc_feature 322: w=a or t
ggwtgtmaatttatgagggcaggtgtaaaaaagaagttctcgttcaaaatgacctttttgaaagggattactaaattttatatgtattactgtgwttggctaagtgattrtggtatrwtgatttaaaaacaaacaaacaaatactggtttaggcyarrcttcttttttagaaaatcttattcgggtatcagtgtggttttgatgtagcctagtgagttgctgtytagatgggaacttgagaactctgcattctgatggmacaggccactggctgggttgcctgacttgctgtagaagtgaaccctgagttcctaatttaagwttctaa

SEQ ID NO: 18032 - DNA, 101 bp, Homo sapiens
  misc_feature 80: k=g or t
  misc_feature 97: y=c or t
  misc_feature 98: y=c or t
  misc_feature 100: k=g or t
  misc_feature 101: k=g or t
aacctcggctcactgcaacttccgcctcccaggttcaagcaattctcctgcctcagcctcccaagtggctgggactacakgcgcacaccaccacgcyyakk

SEQ ID NO: 18033 - DNA, 132 bp, Homo sapiens
aggaatcctgcctcctcctccccagccgcagaggacatgcggacatgtgtgggcaggtcccttctgacccatggcaggtccctgttgatggtcaggctggggatcgtgcaggcctttttgttatcccgggct

SEQ ID NO: 18034 - DNA, 146 bp, Homo sapiens
gtaaaagcatttatttgcattatggcttgtaatccctcatcctttaagcctctgctgaattgttttcttctcaacaaagtctattttaatcaagttatttaaaattgcaaactgcacctccctgaaactcctcatctctctcgccc

SEQ ID NO: 18035 - DNA, 104 bp, Homo sapiens
  misc_feature 12: y=c or t
  misc_feature 18: r=a or g
agaatcatgctytgggargccggggcgggccgatcacgaggtcgggagatcgggaccatcctggctggcacggtgaggccccgtctctactaaaaaaaaaaaaa

SEQ ID NO: 18036 - DNA, 136 bp, Homo sapiens
tttgtttgctcttggttctctagttcttttagttgtgttgttagggtgttaatttgagatctttgtagctttttgatgtgcacatttagtgctacaaatttcccttttaacactgcttttgctgcgtcccggagat

SEQ ID NO: 18037 - DNA, 103 bp, Homo sapiens
ttttccaatttataaatttttgcttttgtgggtcacaagtttggtgtcaagtctaaggacatttcgactagccctgtaacccagtgattttccttcttttttt

SEQ ID NO: 18038 - DNA, 102 bp, Homo sapiens
  misc_feature 12: s=g or c
  misc_feature 19: m=a or c
  misc_feature 20: m=a or c
  misc_feature 25: m=a or c
  misc_feature 26: w=a or t
  misc_feature 35: m=a or c
cctcaacgtttsaaactammaggamwaataccggmatattctttcacttctggaccctaccttcccaatactaatcacatcctaattgcttaccccaccgca

SEQ ID NO: 18039 - DNA, 155 bp, Homo sapiens
  misc_feature 7: r=a or g
tcttaaraatgagcaggaatcctcctaccaccagatactcactgtgtttagatttccactgtcttataaatgtctccatgaaatcctgtctgcctgtgtgtaggccttgtttgcatcctgtttcaagcgtcattttaattggtatgccttttttt

SEQ ID NO: 18040 - DNA, 66 bp, Homo sapiens
  misc_feature 12: y=c or t
  misc_feature 14: w=a or t
  misc_feature 41: m=a or c
tgaggcaagatygwgccattgcactccagcctaggcaacamaagtgagactccgtctcaaaaaaaa

SEQ ID NO: 18041 - DNA, 112 bp, Homo sapiens
cagtggtgccatcttggctcactacaacctctgcctcccaggttcaagtaattcccctgcctcagcctcccgagtaactgggactacaattgtgtaccaccatgcccagcat

SEQ ID NO: 18042 - DNA, 121 bp, Homo sapiens
tcccagctactcaggaggctgaggcaggagaatcgcttgaacccaggaggcagaggttgcagtgagccgagatcctgccactgcactccagcctgggtagcagagcaagactctgtctcta

SEQ ID NO: 18043 - DNA, 114 bp, Homo sapiens
  misc_feature 9: k=g or t
actcccaaktagcttcgactacaggcacacaccaccatgcctggataatttttgtatttttagtagaggcaggttttgccatgttggccaggctggtctcgaactcctgaccac

SEQ ID NO: 18044 - DNA, 122 bp, Homo sapiens
tttaaaataggcttttgactgggcatggtggctcacgcctgtagtcccggcactttgagatgctgaggcaggtggatcatttgaggtcaggagttcgagaccaacctagccaacatggtgaa

SEQ ID NO: 18045 - DNA, 80 bp, Homo sapiens
agactatactttcagggatcatttctatagtgtgttactagagaagtttctctgaacgtgtagagcaccgaaaaccacga

SEQ ID NO: 18046 - DNA, 104 bp, Homo sapiens
tgtttttttcgtttgttaagtgttgagagttcattattccagatagtaacctcttagcaagtaaatggtttgtgagtattttctcctcttctgtaggttggctt

SEQ ID NO: 18047 - DNA, 365 bp, Homo sapiens
  misc_feature 12: m=a or c
  misc_feature 149: k=g or t
  misc_feature 152: w=a or t
tgttaggaatgmattttaattttctgtgaaaaggtaggatttttttcaagtgtctaataagaacaaggtaggccaggcatggtggctcatgctgctagtctcagcactttgggaggcagaggcggctggatcatttgaggttaggagtkcgwgaccagcctggccaacatggtgaaaccctgtctctactaaaactacaaaaattagctgagcatggtggcgcatgcctgtagttccggctacttgggaggctgaggcgggagaatcgcttggacctgggaggcggaggttgcagtgagctgagatcgggccactgcactccaacctgggcaacggagcgggactccatctcaaaaaaaaaaaaa

SEQ ID NO: 18048 - DNA, 191 bp, Homo sapiens
cggaggctgggaagtccaaggtcaaggggatgcatctggtcagaacctccttactcatgggaactctgcagaatcctgaggtggtgtggggcatcacatggcaaaggagcagagcatgctagctgaagcctcttttcctcttataaagccactagtctaactcccatgataacccattaatccatgatcat

SEQ ID NO: 18049 - DNA, 219 bp, Homo sapiens
agttttactgttgcaataatttgttatctagagaacactgcctgtttcattgcctcatattgtgcattgctcattttatttctaagacttacaatgcataatttttcaaaaaatcatctattcttaggtcatccacaaaccaaagcttttataactcatgatggatccaatggaatgtatgagagaatctatcatggaatccctagggtggggcttctc

SEQ ID NO: 18050 - DNA, 214 bp, Homo sapiens
  misc_feature 121: y=c or t
  misc_feature 164: r=a or g
  misc_feature 213: r=a or g
gacctcaagtgatccatctgcctgtaatcccaagtactcaggaggctgaggcagaagaatcgcttgaacccaggaggcggaggttgcagtgacccgaggttgcgccactgcgctccagccytgggtgacagggcgagactctgcctccaaaaattaaataagtraataaatagatagatttattaaggccgggcacagtggctcaagcctgtra

SEQ ID NO: 18051 - DNA, 115 bp, Homo sapiens
acaggccaagtgcgctgtgctcgaggggtgccggccaggcctgagcgagcgagctagccagcaggcatcgagggggcgcggctgccgtccggacgagacaggcaaacccgactaa

SEQ ID NO: 18052 - DNA, 113 bp, Homo sapiens
ttttggcttccccaccggcaatggagtggttgacgttgcctctcggcggcgcggcggcggtggacgagtacctggagtaccggagaattgttggtgaggatgatggagggaat

SEQ ID NO: 18053 - DNA, 133 bp, Homo sapiens
cccagctactcgggaggttgaggcaggagaattgcatgaacccgggaggcggaggttgcagtcagccgagatcgtgtcactgcactccagcctggcgacagagtgagactccttctcaaaaaaaaaaaaaaaa

SEQ ID NO: 18054 - DNA, 101 bp, Homo sapiens
acactgtgaaaacttgatcaagttgttgaagagaagagtccttaggctaggtggccattttgagaacagtaaatattagtattttgagatcagtggaccat

SEQ ID NO: 18055 - DNA, 201 bp, Homo sapiens
cttctgaaataacatgggattggggtctacagataaaggttaagattaagtctttattacttgggcatgtccttaaacataatctgaaacatctataaaattgggataatgaggtcatttttatgatcaatcagctgatatgcaaatattgactgaaaaatgtaaaacactacacgaaaagtattaccctttttttttttt

SEQ ID NO: 18056 - DNA, 289 bp, Homo sapiens
  misc_feature 12: y=c or t
  misc_feature 13: v=a or c or g
  misc_feature 27: k=g or t
  misc_feature 38: r=a or g
  misc_feature 39: w=a or t
  misc_feature 61: k=g or t
  misc_feature 88: m=a or c
  misc_feature 104: m=a or c
atgcctgtaatyvtagcactttgggakgccaaggaggrwggatcacttgagaccaggagtktgagaccggcctgaccaacatggtgamacttcgtctctactamaaatagaaaggttggctgggcatggtggcacatgcctgtaatcccagctgcttggctgtttgggtagccgaggcatgagaatcacctgaacctgggaggcagaggttgcagtgagctgggatcacaccattacactccagcctgggcaatagagcgagactctatctcaaaaaaaaaacaacaac

SEQ ID NO: 18057 - DNA, 182 bp, Homo sapiens
caaggaacttaagcaaatttacaagaaaaaacaaaacaaaaacccatcaaaaagtgagcaaaggatatgaacagacacttctcaaaggaagacatttacatggccaggaaacatgaaaaaaagctcaacattactaatcattagagaaatgcaaatcaaaaccacaatgagataccatccca

SEQ ID NO: 18058 - DNA, 221 bp, Homo sapiens
  misc_feature 3: r=a or g
  misc_feature 4: w=a or t
  misc_feature 5: w=a or t
  misc_feature 54: v=a or c or g
  misc_feature 91: k=g or t
cgrwwcagctttggaggcttctaatctataaagtgccttaatttctagcttacvaggttgtttgtggaattgtctttaatgaaaacaagtkatataatcatacatttgcttgcaaaataaatcaagacatttgctgggagcaaagacataataactttactggataaattatacattttatctaagtgaaataccttgatgaataaatagtttactctctt

SEQ ID NO: 18059 - DNA, 140 bp, Homo sapiens
cctaagttttgtatttttaatagagactgggtttcaccgtgttagccagtatggtctctatctcctgacctcaagtgatccacccaccttggcctcccaaaatgttgggattacaggcgtgacaaccatgcctggctaaa

SEQ ID NO: 18060 - DNA, 137 bp, Homo sapiens
  misc_feature 29: w=a or t
  misc_feature 30: r=a or g
  misc_feature 36: k=g or t
  misc_feature 37: y=c or t
  misc_feature 122: k=g or t
  misc_feature 123: k=g or t
  misc_feature 126: s=g or c
atctttccggtgctattctggtgataggwracgaakytcatgagatctgatgggtttatcagtggtttctgcttttgcttcttccacattttctcttgctgctgccatgtaagaagtgcctkkcasctgccgccaaa

SEQ ID NO: 18061 - DNA, 227 bp, Homo sapiens
ctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccccccc

SEQ ID NO: 18062 - DNA, 117 bp, Homo sapiens
  misc_feature 97: r=a or g
tcttgtgggagaaagttcaaacccctattgttaaagggtcaattttgcttacttcccagctaagttagctcacttggggaagtacataatttatgaratgtggaaaagtaaccaata

SEQ ID NO: 18063 - DNA, 115 bp, Homo sapiens
  misc_feature 25: y=c or t
cctcacccggctaactttttttttycatttttagtagagacgacagggtttcatcgtgttagccaggatggtctcgatctcctgacctcatgatccgcctgcctcaacctccctc

SEQ ID NO: 18064 - DNA, 108 bp, Homo sapiens
cctcctgagttcaagtgattctcctgcctgaacctcctgtgtagctgggactacaggcatgcaccaccatgcccagctaatttttgtattttttgtagagatggggac

SEQ ID NO: 18065 - DNA, 208 bp, Homo sapiens
gaaaggaaaaggtttttattgatcttttttagaaatgaaatttgaaatacacaagggacgcatgaattttatctttcatgaacatttgatgagtaagtgtgggtgccccagtaaagattctggcttcctgcaaaggataaggtcagaagtactgtcctgatttatccttgatgtgttcatcacaggttctcttgtctaatggccgcct

SEQ ID NO: 18066 - DNA, 81 bp, Homo sapiens
tgtctgtcaggtccatttggtctgtgatgcaatttgagactgatttttgttgctgttgatttttctatctagatgacctac

SEQ ID NO: 18067 - DNA, 101 bp, Homo sapiens
tagccaggatggtctggatctcctgaccacgtgatccacccacctcagcctcccaaagtgctgacattacaggcgtgagcactacagccggcccccaagcc

SEQ ID NO: 18068 - DNA, 103 bp, Homo sapiens
tatgttcttggagagagctgctgagggctgctcactccccagtgaccatggctgttcccacagggacatctcaggggctgagttctttttttttttttttttt

SEQ ID NO: 18069 - DNA, 186 bp, Homo sapiens
atctgccggaagccttgccctcaatcaaggcggacgtgaagcatctacaaaggaggaatagtcaaagcagcagcggcggcggcggcggcggcagagcagcagcagcaggagaccttctctgatggatgacctctgtgaagcaaatggcacttttgccatcagcttatttaaaatattgggggaaga

SEQ ID NO: 18070 - DNA, 78 bp, Homo sapiens
tgaggaattcatgtttactgttttagtccctaattctaatttatcacagtagtattaacacgtgcttttttttttttt

SEQ ID NO: 18071 - DNA, 168 bp, Homo sapiens
cccatttgacttcctttgttggctgatcaactataactctttattattttaatggttgccttagggtttatagtattttaacttatcacagtttaccttcaagtggtattataccactttacataaagtataggaaccttacaatagtatacttccatccccccctcg

SEQ ID NO: 18072 - DNA, 182 bp, Homo sapiens
atttttggataggtgatgtatatttctttttttattattattatactttaaattctagggtccatgtgcacaatgtgcaggttacgtatgtatacatgtgccatactggtgtgctgcacccattaacttgtcatttacgttaggtatatctcccaatgctatccctcccccctacccccaca

SEQ ID NO: 18073 - DNA, 116 bp, Homo sapiens
ttaccggacttcctcaaaacaaaaaaatgctggcaggagcaaaagaggatgaggcccccacgttccccgtatgccttaatctcccctctactctgaatgttatcagagagggcgat

SEQ ID NO: 18074 - DNA, 337 bp, Homo sapiens
cttctttagggactccacttatcaaatagatcttcttgtcttttttatccatttctttctgattgcttaatgtacttttagtcatatatttcttattgtagttttggacatatctagtctcttttggaccttgtagtttatttcttctttctgaaattatgttattattctgtagtttcttttttgagtttggtctgctctgatttcatatccatgtagtgtttatccagtattattctgagtttttaagttctaagtttgtgatggtccctcatgtttacaattgcttgcttcatgtttaattcttcttggaatatattataataatacctgccaa

SEQ ID NO: 18075 - DNA, 201 bp, Homo sapiens
  misc_feature 37: k=g or t
  misc_feature 65: d=a or g or t
caatttacaaaagaaggaaagaaggaggtctgttgtkttgttttctttgtttttgagatggagtdttgctgttgttgcccaagttggagtgcaatggtatgatctcggctcactgtaaccacctcccaggttcaagcaattctcctgtatcagcctcccaagtaactgggattacaggcgtgtgccaccatgcccggcttc

SEQ ID NO: 18076 - DNA, 103 bp, Homo sapiens
cgtgcaggtttgttacatatgtatacatgtgccacattggtgtgctgcacccattaacccgtcatttacattaggtatatctcttaattctatccctccccct

SEQ ID NO: 18077 - DNA, 403 bp, Homo sapiens
  misc_feature 380: w=a or t
cttccatttatgtggtcaattttagaataagtgtgatgtgatgctgagaagaatgtatattctcttgatttggggtggagagttctgtagatgtctattaggtctgcttgttgcagagctgagttcaagtcctggatatccttattaaccttctgactcactgatttgtttaatattgacagaggggtgttaaagtctctcattgtttttgtgtgagagtctaatgctctttgtaggtctgtaaggacttgctttatgaatctgggtgctcctgtattgggtgcatatatatttaggatagttagctcttcttgttgaattgatccctttaccattgtgtaatggccttgtctcttttgatctttattggtttaaagtcwgttttatcagagactaggattgc

SEQ ID NO: 18078 - DNA, 184 bp, Homo sapiens
  misc_feature 56: b=c or g or t
taggtgactgctctttccttaatacatgtttccacatggatacctgcaagtatgtbcactatgaaattgatgcttgcatggattctgaggcccctggcagcaaagaccacacgccaagccaggagcttgctcttacacagagtgtcggaggtgattccagtgcagaccgactcttcccacctct

SEQ ID NO: 18079 - DNA, 392 bp, Homo sapiens
  misc_feature 300: k=g or t
  misc_feature 374: m=a or c
ttctgaggcactggagcttaggacttcaatatataaattttgggggaaacacgattcagcttatgaaacttggtacttctcctaatttagcacaaatttctagatgtataatatttatttatttgtatcctccagaagactatgtaatttgagaacaagttttgatcatctttgtcttatcatatcactggagcttgatccaatactcagtacatactgatgaataaatgggtatgagttttttcaaaattaattgacatttgctcagatctatactgaaatttattgttcctctatatkacaaaaagtctaccgggagaggtggaggttgcagtgagctgagatcatgccactgcactccagcctgggcgacmagagcaaactctgtctca

SEQ ID NO: 18080 - DNA, 99 bp, Homo sapiens
aaattttgatccttctggaatgtatttcagggcaacaagtgaaatagtggataacctctgctttttaaaaaaaataaacacaaccaaatggccacccgg

SEQ ID NO: 18081 - DNA, 103 bp, Homo sapiens
tagcgccaaaaagattggtttgaaacccatgcaatgttagtgggaaaaatgttctcattcattctaataatttatgaagtcagcttttttttttttttttttt

SEQ ID NO: 18082 - DNA, 140 bp, Homo sapiens
caataccgttattgtactcaggaaagttggcatttcattatttacacaaatgttatctaatatatagcccatgttcaaatttccctagttgccccaataatgtacttgccttaaacaacttttgattttttttttttttt

SEQ ID NO: 18083 - DNA, 324 bp, Homo sapiens
acaactgacatcgtcatccgcatcggcaatactgaggatggggctcctcacaaggaggatgagccatcggtgggccaggtggccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagcccccatcccacccct

SEQ ID NO: 18084 - DNA, 102 bp, Homo sapiens
tgcagacaaatctggtgtctagtgagacctgttcctcatagattttggcttctcattgtgtcctcacagggtggaaaaggacaaataagctcccttgggcct

SEQ ID NO: 18085 - DNA, 224 bp, Homo sapiens
caatttggcatgtttttgcagtggctggtaccagttcctttccatgtttagtgcttccttcaggagctcttgtaaggcaggcctggtggtgacaaaatctctcagcatttgcttgtctgtaaaggattttatttctccttcacttattaagcttaatttgcctggatatgaaattctgggttgaaaattcttgtctttaagaatgttgattattggcccccata

SEQ ID NO: 18086 - DNA, 133 bp, Homo sapiens
tttgtactcttgaacaacacagggtgctaggttggtgattttccagcacattgaggatcttccaccttctcccgccactgctgcctgccgtaagaaatctgctgtcggcctcactgctgaccatccagcgttt

SEQ ID NO: 18087 - DNA, 353 bp, Homo sapiens
  misc_feature 36: k=g or t
  misc_feature 201: k=g or t
  misc_feature 236: k=g or t
  misc_feature 292: w=a or t
  misc_feature 299: w=a or t
  misc_feature 333: w=a or t
  misc_feature 334: d=a or g or t
tgatatcctggaggttttgtatggtatatctctatkccatttgtatcaattaacttttttatttctgtctagattttgcttacacaaaagtcattcaggagtaagttgtttagcttccatggatttgtgtagtttcaagagtttctcttggtattattttctatttttattccattgtggtccaaggagatacttgatatkattttgaatgtttttaatttattgagacttgcttkatgaacaatctagtagtcagtattcaagtacacttatgtgcagatgaaaagactgwatattcwgaggttttgggtacggtattctgtagatgtctawdacatccaattgttaatgtc

SEQ ID NO: 18088 - DNA, 59 bp, Homo sapiens
tatgaatgtcagtttgccatattatctctacttgtttaatatttttctttttttttttt

SEQ ID NO: 18089 - DNA, 107 bp, Homo sapiens
actttctgtctctatgtatttgcctattttagatacctcaattaagtggattcctataatatttatccttttgagtctagcttatttcacttagaataatcttttcc

SEQ ID NO: 18090 - DNA, 107 bp, Homo sapiens
  misc_feature 54: n=a, g, c or t
tatatttatataaatatatataaatacacacatatatatatgtatgtgtgtatntgtgtgtatcttttttgtgcatgtatgtgtgtatgtgcttttttttttttttt

SEQ ID NO: 18091 - DNA, 209 bp, Homo sapiens
  misc_feature 203: m=a or c
  misc_feature 209: d=a or g or t
tatggagtctcacgcttgttgcagtggcatgatctcagctcactacaaccccatgtctaccaaaaatacaaaaaattagctgggcatggtggcgggcacctgtaatcccagctactggggaggctgaggcaggagaatcgcctgagcctgggaggcggaggttgtagtgagctgagatcatgccactgcaacaagcgtgagamtccatd

SEQ ID NO: 18092 - DNA, 125 bp, Homo sapiens
gtaccacaggcaatggggtcaagtgcctgtgaaatagctgtcgggactaaaaggttattattagctctgcctctcgctcttgttctgggctttgaaggctcatcagttcccccaagaaattttct

SEQ ID NO: 18093 - DNA, 129 bp, Homo sapiens
atcattctttcaagtaaaaatggtgttccattaaaaaagcaggtgagatcaatgtacaactcaaagaattacccaagcgctttttatttctttttatttttttgagacagcgtcttgctctgtcaccca

SEQ ID NO: 18094 - DNA, 130 bp, Homo sapiens
ggtggcatgcacctgtggtcccacgacttgggaggctgaggcagaagggaagatcccttgaatctgggaggttgaggctgcagtgagctgttattttgccactgcactccagcctgggctacaggtgcat

SEQ ID NO: 18095 - DNA, 222 bp, Homo sapiens
  misc_feature 220: w=a or t
cctccgcctcccgagttcaagtgattctcctgcctcagcctcctcaatagctgggattacaggcacctgccaccacacccagctaatttttgtatttttagtagagacacagttttaccgtgttggccaggctggcctcgaactcctgacctcgggtgatccgcgtgcctctgcctcccaaagtgttgggattacaagcataagccaccatgcccggccwct

SEQ ID NO: 18096 - DNA, 200 bp, Homo sapiens
aaagctaggccaagggtgataggcttttaaaacaacgagcatcataatgactcaaaagtatccattgtagcatacgcttcacagggtcatttaacttaaaagtctcatcatcttaggagatcattttttgatggctggattgggaaatatagattgttaaaaatatataaatgtctcagttgaacatgtatgaagccgtg

SEQ ID NO: 18097 - DNA, 124 bp, Homo sapiens
ttggtagaggcgcggtttcaccgtgttagccaggatggtcttgatctcctgacctcgtgatccacccacctcggcctcccaaagtgctgggattacaggtgtgagccaccacgtccggcctcgt

SEQ ID NO: 18098 - DNA, 114 bp, Homo sapiens
gttaaaagctcccccagggattataataatagccaaggctgagaacctcctgactggggttgggaatgagggatagaggaaggccttagggccgccctcacctatggagagaac

SEQ ID NO: 18099 - DNA, 153 bp, Homo sapiens
  misc_feature 14: r=a or g
tttgagacagagtrtcactcttgttgcccaggctacagtgcaatggcacggtcttcgctcaccacaacctccgcctcctgggttcaagcgattctcctgcctcagcctcccgagtagctgggattacaggtatgcaccaccacacctggctaa

SEQ ID NO: 18100 - DNA, 59 bp, Homo sapiens
ctgcactctagcctgagcaacagagagagaccctgtctctgaaaaaaaaaaaaaaaaaa

SEQ ID NO: 18101 - DNA, 251 bp, Homo sapiens
  misc_feature 225: s=g or c
ttcttatggccgagtgcggtggctcacgcctgtaatcccagcactttgggaggctgaggcgggcagatcacgaggtcaggagatcgtgaccgtcctggctaacacggtgaaaccccgtctctactaaaaatacaaaaaaattagccaggcgtgatggtgggcgcctgtagtcccagctacttgggaggctgaggcaggagaatggtgtgaacccgggaggcggasttgcagtgagccgagattgtgcccgt

SEQ ID NO: 18102 - DNA, 310 bp, Homo sapiens
  misc_feature 21: n=a, g, c or t
aatatgctttaatagtcatgnattttaataaagtaccaggtatagtgaaataaataataatttgaaacatggattctgttaactttattatccatgcctatattctttatttaccaggcataatttactagctttggtttttgttttgtttttgatagcccatatgctatttgctttattataccttttttaaaagtaagtcagaagtttaggtttctcatgattaaattttagtattagaacagaatcttttaatgctagaaaccaagtgtataagtgcatatttgttctttttttttttttttttttt

SEQ ID NO: 18103 - DNA, 106 bp, Homo sapiens
ctttttggtatacacatggtaatacaaaatacagctggaatctatgtaattctttccaacatggtaccatcctaagaaaaacaacacagtagccattaccaccatc

SEQ ID NO: 18104 - DNA, 171 bp, Homo sapiens
  misc_feature 152: k=g or t
ttttaaaatttttattagagatgggttatcactgtgttgcccaggctgatctccaactcctgcccttaagcgatcctcccacctagatatcctgagtagctgggattacaggtgtaagtcaatgttcttggctatatagtatgttatatctkttttttttttttttttttt

SEQ ID NO: 18105 - DNA, 171 bp, Homo sapiens
  misc_feature 111: m=a or c
  misc_feature 112: m=a or c
ttaatagtagttaaagccataatcatcaagatctgtgttggtggcaacgtaatgctaaaacccaggggctacattctggacactccaaagtttaaatgtggtgaaatgagmmaacactacaaaggagactgagaaagaggtgccagtggggtaggaaggaaaacaggagtc

SEQ ID NO: 18106 - DNA, 223 bp, Homo sapiens
aatggttaagtacacaggacccgcctcgtatcccagctctgtcacattcatgctgtgtggctttgggcaagtggtttcacctctctgaactctactttcttcattggttcagtagggagaataatacctccttggtttgttgagaggatgaagtgagaaatgtaagcagcccacatggcatgagttgatgtacaaatattatttatctttctctcctcctcga

SEQ ID NO: 18107 - DNA, 181 bp, Homo sapiens
agggattctcttgcctcagcctcctgagtagctgggattacaggtgtgagcccccacaccaggctaatgtttggatttgtagtagagacaaggttttgccttgttgtccaggctggtctcaaactcctgacctcaggtaatctacctgccttggcctcccaaagtgctgggattacaggca

SEQ ID NO: 18108 - DNA, 169 bp, Homo sapiens
ttggagctcctctccccaggacctgagcgattttcctggatccggagctgcgcacagagcagctgccgccccaggaatgttacctgccttgtgcggagcccctgcagggcccccttcggctccgggcagttggctgccgacgccccgctgggttccttagccacggcac

SEQ ID NO: 18109 - DNA, 109 bp, Homo sapiens
  misc_feature 73: w=a or t
ttctgaggcaggagaatagcgtgaacctgggaggcagagcttgcagtgagcctagatcgcgtcactgcaagcwctgcctcccaggttcacgctattctcctgcctcaga

SEQ ID NO: 18110 - DNA, 125 bp, Homo sapiens
  misc_feature 2: k=g or t
  misc_feature 3: k=g or t
  misc_feature 8: s=g or c
  misc_feature 10: s=g or c
  misc_feature 125: s=g or c
tkkagtasasactggatttcaccatgttgaccaggctggtctcacactcctgacctcaggtgatctggctgtcttggcctcccaaagtgctgggcttacatgtgtgagccaccccacctggaaas

SEQ ID NO: 18111 - DNA, 266 bp, Homo sapiens
  misc_feature 206: w=a or t
  misc_feature 209: w=a or t
  misc_feature 210: w=a or t
ttttttctcagaattgttttggctattcggggtctttcatgggtccatacaattttaggattgtttatttttatttctgtgaagaatgccattaggattttgagatggattgcattgagtctgtatattgctttgggtaatgtgaacatctaaaaaatattaattcttccaatccatgaactcagggatatgttttcatttgtgtwttwwttcctaatttctttcatcaatgttttatagttttcagtgtatacatggtccccact

SEQ ID NO: 18112 - DNA, 155 bp, Homo sapiens
  misc_feature 91: k=g or t
  misc_feature 92: w=a or t
gtgtgtgcggtgttatgccggacaagagggaggtgaccgtggcggcggcggcggcggctctgtttattgtccctctcggtgtgtgtgtgtkwggaaatcggggctgcagcgaggctaaggctgcctttgaagcagcggcggcgaccgggacaaac

SEQ ID NO: 18113 - DNA, 309 bp, Homo sapiens
  misc_feature 253: h=a or c or t
cccagctaatttatttatttatttagagacagagtttcgctcttcttgcccaagctggagtgcaatggtgtgatcttggctcactgcaacctccgcctccctggttcaagcaattctcctgcctcagcctcccaagtagctgggattacaggcatgcgccaccatgcctggctaattttgtacttttagtagagatggggtttctccatgttggtccagttggtcttgaactcctaacttcaggtgatcctchcaccctggactcccaaaatgctgggattacaggtgtgagccactgtgcccggccgc

SEQ ID NO: 18114 - DNA, 104 bp, Homo sapiens
  misc_feature 93: w=a or t
tacatttaggtctttaatccatcttgagttaatttttgtataatgtgtaaggaagaggtccaagttcagttttctgcttatggctagccagtwctcccggcacc

SEQ ID NO: 18115 - DNA, 160 bp, Homo sapiens
  misc_feature 20: m=a or c
  misc_feature 86: s=g or c
attttaactttcattttagmttcagggggtacacgtgcaggtttgttacatgggtaaattgcgtgtcatgggggtttggtgtacasattattttgtcacccaggtaatgagcatagtatctgataggtagtttttcaaccctcatcctcctaccaccccc

SEQ ID NO: 18116 - DNA, 274 bp, Homo sapiens
  misc_feature 85: y=c or t
  misc_feature 86: y=c or t
  misc_feature 87: y=c or t
  misc_feature 104: m=a or c
agtttaatctgggaggaacttggttgcattacatttaataatatagttgaagtataattccatttcaatgtgcatataaaactgyyyatttaggcaaagaccamggaatgcattgaatactaaaccgtaaacacattgtccatcctgacttggagtgcacaccaacaactgaagagctcttctgcagactttggcaacgagactacatatagcaggtcacagcagcacgagctcacatggaagactgaaagcactgcggaataacaccacccct

SEQ ID NO: 18117 - DNA, 104 bp, Homo sapiens
  misc_feature 12: s=g or c
cccagctactcsggaggctgaggcaggagaatcacttgaacccaggaggcagatgttgcagtgagctaagattgtgccactgcactccagcctgtttcaaaaaa

SEQ ID NO: 18118 - DNA, 175 bp, Homo sapiens
  misc_feature 112: w=a or t
ctctcacttcactgcagctcaacgtccccagaaacatctgactttgctccttttgtctctctttgaagcgctgaacaagaaatccaaacagatcggcagaaaagcagcagawaagaaaagatcttctaagaaggaggcttcgatgaagaaagtggtgcggccccggaccccccca

SEQ ID NO: 18119 - DNA, 74 bp, Homo sapiens
ttctcctgcctcagcctcccgccaccacacctggctaattttttgtatttttagtagagacggggtttcactgt

SEQ ID NO: 18120 - DNA, 75 bp, Homo sapiens
gcactgaattgtgttcttgccactgcattccagccagggtgacagggaggctgtcttaaaaaaaaaaaaaaaaaa

SEQ ID NO: 18121 - DNA, 263 bp, Homo sapiens
atttcactgatgtctagctgtggctctctttttatacctcctatttaataccacatggtctttgaaacctggagacttactgatttcttgagctctagtaaatgttcttttctcatttaattgatcattttctcccatttgttgtctccttacatccccagggcattactattttgtagctatggtattcaggaactgcattttatttattttaacttttttttctcatactttctgtagtaggcagaataaagcccagccct

SEQ ID NO: 18122 - DNA, 216 bp, Homo sapiens
  misc_feature 8: y=c or t
  misc_feature 12: y=c or t
  misc_feature 148: y=c or t
tttgtttytagyagagccggggtttcaccgtgttagccaggatcgtctcgatctcctgagctcgtgatctgcccgcctcggcctcccgaagtgctgagattacaggtgtgagccaccatgcctggctctatttttatttttttgagayagagtcatgctctgtcacccaggctggagtgcagtggtgaaatcttggctcactgtagcccccgccga

SEQ ID NO: 18123 - DNA, 77 bp, Homo sapiens
agctgggaactatgtcaggaaaacctgcctcccattctgttcctatacaagatagctacaaagagtaaagaaaaaaa

SEQ ID NO: 18124 - DNA, 78 bp, Homo sapiens
gtcaggttgtggggcacgtgggctccgaactcaccgcagcgtctaggggctttgcttcagcagctgtaagcattcacc

SEQ ID NO: 18125 - DNA, 92 bp, Homo sapiens
  misc_feature 21: s=g or c
  misc_feature 29: w=a or t
  misc_feature 58: k=g or t
cccagctactcgggaggctgsaggcaggwgaatcacttgaacccaggaggcagatgtkgcagtgagctaagattgtgccactgcactccagc

SEQ ID NO: 18126 - DNA, 175 bp, Homo sapiens
  misc_feature 132: k=g or t
  misc_feature 133: w=a or t
  misc_feature 134: w=a or t
taaaattattactgtgtttaattattgtatcttatcaacatatcttatgttcttttattttctaaattatattggaaaaatcaatcatgcttctttgaaccagaaggtcattgtttaccaactggtaagatkwwaatcaaggatgactagagactttgaggattactgaggcgga

SEQ ID NO: 18127 - DNA, 242 bp, Homo sapiens
  misc_feature 97: m=a or c
  misc_feature 98: s=g or c
  misc_feature 140: r=a or g
ctatttaacatcatataattagttggcttcccaaaaaaaattgagcaagcaaccccttatttttactttatttttatttttattttattttaagttmsgggatacacgtgcagaatgtgcaggtttgtttcataggtaartatgtgccatggtggtttgctgcccctaccaacccatcacctgggtattaagccccgtatgcattagctatttatactgggctctacctccaccccccacca

SEQ ID NO: 18128 - DNA, 208 bp, Homo sapiens
  misc_feature 16: w=a or t
ctcctagcttcagggwaaatttctattcctaatcttgattttccactcaaggtgacctgaaagtctcctgaaatcaaaagttattttaataagagtgccagctttaagagaaatgactgctgcagatcatcactactcttcatcttaaccctgggccagggcttccaagctttgtctcccactgttcccacggtgattcttcctgaag

SEQ ID NO: 18129 - DNA, 156 bp, Homo sapiens
  misc_feature 4: m=a or c
  misc_feature 5: s=g or c
  misc_feature 11: k=g or t
  misc_feature 12: s=g or c
  misc_feature 113: w=a or t
  misc_feature 129: s=g or c
  misc_feature 130: s=g or c
  misc_feature 136: m=a or c
  misc_feature 137: s=g or c
  misc_feature 155: y=c or t
  misc_feature 156: s=g or c
gtamsgatgckstgctggggaggtggtgcttccctaccccctagaaatgctgccttccaactaccactctcccagatgtgacccttgcgattatttcctctgaggtttgaggwtgaagataagttggassgaaagmscagtaactaataggggays

SEQ ID NO: 18130 - DNA, 115 bp, Homo sapiens
atgcctttgtaagcatccctccccgagattcagcaccaaccaaaatcacatttggaaaaattgcttgtttcccaagaagctttggaggatatgattttgtatagaacgggttcac

SEQ ID NO: 18131 - DNA, 53 bp, Homo sapiens
ataaggaatccaagtgaaaagtatttagggattcttgtacctttttttttttt

SEQ ID NO: 18132 - DNA, 369 bp, Homo sapiens
  misc_feature 11: m=a or c
  misc_feature 275: w=a or t
  misc_feature 278: k=g or t
  misc_feature 357: v=a or c or g
  misc_feature 366: n=a, g, c or t
cccaggtatgmaattctgggttggaaattcttttctttaagaatgttaaaatattggcccccaagctcttttggcttgtagggtttccacagagaggtcagctgttagtctaatgagtttccttttgtaggtgacctggccttttctctctggctacccttaacatttttttctttcatttcaaccttggagaatctgatgattatgtaccttgtggttgatcttctggtggagtatcttactggggttctctggatttcttgaatttgaatgtwgtkctttcttgctaggttggggagaatggaaccaagttggaaaacacacttcaggatattatccaggagaacttccccaacvtagcaaganaga

SEQ ID NO: 18133 - DNA, 319 bp, Homo sapiens
  misc_feature 182: r=a or g
  misc_feature 286: s=g or c
tacttatacaccatggagtactatgcagccataaaaaagaacaagatcatgtcttatgagaacacagatgaagttgaagtccattgtccttagcagaccaacacaggaacagaaaaccaaacatcccatattctcagcctttctgttgttcaagttttagagtaagaactattatagcagtragactttctctctctgtctctctctctctctctcacacacacacatacacccacgcacacacttacaatgtaccaggcactgctctatatgtaaaatgtgaatsaacttctataattttcacagcaaccctaagggg

SEQ ID NO: 18134 - DNA, 243 bp, Homo sapiens
  misc_feature 12: r=a or g
  misc_feature 235: w=a or t
  misc_feature 236: y=c or t
  misc_feature 242: w=a or t
  misc_feature 243: k=g or t
atatttattgtrtattatatgtctaatgctatacttctatagcttctgtatttctaaaattgtttagctttttttatttttattttattttttatttttatactttaagttttagggtacatgtgcacattgtgcaggttagttacatatgtatacatgtgccatgctggtgtactgcacccactaactcgtcatctagcattaggtatatctcccaaagctatccctccccccwycccccwk

SEQ ID NO: 18135 - DNA, 253 bp, Homo sapiens
cagacataggagtaattctgcaaagttgcccttccataaggaaacttacatctataaaggaaacatttatttgaaaggatatctccctctcttcaccagcaagagaaggactaaatcgctagagattcttatccatgaagaaggcatcaatttaaatctgcacaacaaaccttacctcttttacagcacgggcgttcaaacttttggcttccctgggccaaactggaagaaaaattgtcttgggccacacgcc

SEQ ID NO: 18136 - DNA, 257 bp, Homo sapiens
tattcccacagacatgcatgcacaaaattcactcctacatgcccattacttctgccctccacccttgcccttcctttcctggccttgcatcacatggtacattgatctggatgcaaatactgtttcttttcagcctatcgattttgtaatgctgaacaccccaatttccccgtgagcccatcccctccaacaccactctcactgagtaagtcaagaccttgttcatccactggacaaaattataggaggccgcagac

SEQ ID NO: 18137 - DNA, 94 bp, Homo sapiens
  misc_feature 61: h=a or c or t
attattaaagagaaaggctgtatcttatttaatttcaatttgcatttctttgattgcagthgaagcaatcaattatgttttattggacccatat

SEQ ID NO: 18138 - DNA, 215 bp, Homo sapiens
ttatttttttctatagtcctagaagcctatgccccatcatgcagtaaatatgatgtaaatatttgtagaaagaaagcaaaatgcctctgaaggtatcttctccagtatctcctactcaccagaatctcactacagcttaggtagcctccccaccaacccttttcttgcctttttctttgctgcttccctccaacctttgcctccataccaccgaa

SEQ ID NO: 18139 - DNA, 154 bp, Homo sapiens
  misc_feature 85: s=g or c
tttgtagagtcagggtcttgctttgttgcccaggctggtcttgaactcctgggctcaagtgatccttctgcctcaacctcctgastagttgggattacacgtgtgagccaccacgcccggccagatacctcctaacacaggcatctccccgtcc

SEQ ID NO: 18140 - DNA, 292 bp, Homo sapiens
  misc_feature 108: r=a or g
  misc_feature 109: w=a or t
  misc_feature 113: n=a, g, c or t
  misc_feature 115: m=a or c
aaattttttagtggaaacggggtttcactgtgttggccgggatggtctcgatctcctgacctcgtgatccgcccgccttggcctcccaaagtgctaggattacaggcrwgacnamcgcacctggcgatttccttcctttttaaggctaatattcaattgtctgtaaattccacatttggctcatgcattccatctgtcgatggacactttggttgctttacctgtttgctattgtgaatgatgctgcaatgggcatacgtgtgcacgtatctcttccagagtcaggtcacga

SEQ ID NO: 18141 - DNA, 198 bp, Homo sapiens
  misc_feature 4: m=a or c
  misc_feature 104: k=g or t
  misc_feature 143: s=g or c
  misc_feature 147: s=g or c
  misc_feature 175: m=a or c
  misc_feature 193: s=g or c
  misc_feature 195: k=g or t
ggamaaattagccaggtgtggaggcatgctcctgtcgtcccagctactctgcaggccgaggtgagagaatcacctgattccgggaggtcgaggctgcagcagtkagccaagatcatgctgctgcactccagcttgggtgacasagtsagaccctgtctcaaaaagaaaaagagamagagagaaagattgagasakagc

SEQ ID NO: 18142 - DNA, 64 bp, Homo sapiens
  misc_feature 12: m=a or c
ttaagcaaatgmatgattgggtgactggatctaactggacctcttagctggtcccattttcttt

SEQ ID NO: 18143 - DNA, 220 bp, Homo sapiens
  misc_feature 99: s=g or c
  misc_feature 167: n=a, g, c or t
  misc_feature 168: n=a, g, c or t
  misc_feature 184: y=c or t
  misc_feature 191: w=a or t
gtcctggatatccttgttaagcttctgtcttgttgttctgtgtaatattgacagtggggttttataatcctccattattattctgtgagagtctaagtstctttgtaggtctctaaggacttgctttatgaatctgggtgctcctgtattgggttcataaagcaagnncttagagacctacaaygagactwagactctcacagaataataatggaggatt

SEQ ID NO: 18144 - DNA, 158 bp, Homo sapiens
agcaaatggatcatttaaatactaaagttctgggtacattctaatcaattacaaagacattgtaagaatttgtattaggccattcttgcattgctgcaaagaaatacccaagactggataatttataaagaaaagaagtttaattggctcatggctct

SEQ ID NO: 18145 - DNA, 183 bp, Homo sapiens
  misc_feature 89: v=a or c or g
  misc_feature 131: w=a or t
ctgcaacctctgcctctcgggttcacgccattctcctgcctcggcctcccaagtagctgggactacaggtgcccgccaccacgcccgtvcacttttttgtatttttagtagagatggggtttcactgtgtwagccaggatggtctccatctccttacctcatgatccacccgcctcggcctcc

SEQ ID NO: 18146 - DNA, 244 bp, Homo sapiens
ccagtactttgggagaccaaggtggttagatcattttaggtcaggagttcgagaccagcttggccaacatggtgagatcctgggttcaagtgattctcctgcctcagcctcctgagtagctggcattacaggtgcctgccaccatgcctggctaattagtagaaacaggatctcaccatgttggccaggcatgttggttcatgcctgtaatcccagcactttgggaggccagggcaggaggatc

SEQ ID NO: 18147 - DNA, 158 bp, Homo sapiens
  misc_feature 140: y=c or t
cattctttgagtcctgaatccttttttttagcctcaaaatatcaatgagatacgcatatcttatttggagtatattattttctaactgtggtcttttagtttaaggaacaacagactgtttgaatgatccttacgatgtytgaacatgttaccggcaa

SEQ ID NO: 18148 - DNA, 119 bp, Homo sapiens
ataggaatgtctgtggggtgactctactgtgctttatcttttaacattaagtgcctttggttcagaggggcagtcataagctctgtttccccctctccccaaagccttcagcgaacgtt

SEQ ID NO: 18149 - DNA, 224 bp, Homo sapiens
cattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataacgac

SEQ ID NO: 18150 - DNA, 134 bp, Homo sapiens
  misc_feature 31: w=a or t
  misc_feature 120: d=a or g or t
ggcacaatggcaggtgcctataatcccagtwacgcgggaggctgaggcaggagaattgcttgaaccccagaggcagaagttgccgtgagacaagattgtgccactgcactcccgacagadcgagagagactccg

SEQ ID NO: 18151 - DNA, 114 bp, Homo sapiens
  misc_feature 17: w=a or t
  misc_feature 44: s=g or c
  misc_feature 45: y=c or t
  misc_feature 46: y=c or t
  misc_feature 47: y=c or t
  misc_feature 61: y=c or t
ctgaagttgctgttgtwttacatttaccttttatttatttgtasyyyttgaggcaggttgygagtgtaagaatgcaatctcggcttacagccgcctcgactttccaggaccccc

SEQ ID NO: 18152 - DNA, 140 bp, Homo sapiens
cggagtctcactctgttgcacaggctggagtgcagtggtgtgatctcggctcactgcaacctctgctgcccaggttcaagcaattctcctgcctcagcctcccaagtagctgggattacaggcacctgccaccgcgccga

SEQ ID NO: 18153 - DNA, 127 bp, Homo sapiens
tatttttagtagagatggagtttcactatgttggccaggctggtcttgaactcctgacctcaggtaatcctcccacctcggcctcccaaaatgctgggattactggcgtgagcaccttgcccggcct

SEQ ID NO: 18154 - DNA, 221 bp, Homo sapiens
  misc_feature 44: m=a or c
  misc_feature 115: r=a or g
  misc_feature 125: d=a or g or t
  misc_feature 138: m=a or c
  misc_feature 156: w=a or t
  misc_feature 175: y=c or t
  misc_feature 176: y=c or t
gtatttgtttagttttaagagccattctttatatttgatatggmttggctctgtgtccccatccaaatctcatcttaaattataatccccatctgttgagggcaggacctggtgrgaggtgattdgattcatgggggmagtttcccacatgctgtwcttgtgacagtgagtgagyyatcacaagatctgatggtttaaaagtgttttgcagtccccaacta

SEQ ID NO: 18155 - DNA, 74 bp, Homo sapiens
aacaaagtgattcttggaaccagtgatctccataatctacctgagtaaaagctgttagtttctttttttttttt

SEQ ID NO: 18156 - DNA, 178 bp, Homo sapiens
ttcaagaccagcctgaccaacatggagaaaatgtctctactaaaaatataaaattagccgggcgtgatggcgcatgcctgtaatcccctcaggaggctgaggcagcagaatcgtttgaacccaggaggcagaggctgtggtgagctgagatcatgccattgcactccaacctggacaa

SEQ ID NO: 18157 - DNA, 147 bp, Homo sapiens
gtttttatttctcttaatgttctataataaacatttcctttagaacaattaggccaactaaaagaaaaagaataaaaagcaatttaaccccctcgcattcctagcattctcagggctttacccagtggtccttgtctacaaccccgc

SEQ ID NO: 18158 - DNA, 147 bp, Homo sapiens
attcctccaccagctcattgcagtggaatcctgagaagaatggagagagaagaatgaggcttctgaaaagcttccaagagatgttgcatgcaaaagagctctgtgtgcagaagatcaccaagcatgaggcattattaagggcaaacc

SEQ ID NO: 18159 - DNA, 202 bp, Homo sapiens
  misc_feature 8: m=a or c
ttgtagamagtaaaaaactatgcaaattgaccactgttaaaagatcattctcagaaaacattgctttttttcaagcttcttgaatttaatgctttgcttttaactatgattacaactccagagaattttcaaatgttgaaacctgtatagcatgttgtaatctgtagtgttatgaataccacataaatttagagacagccaa

SEQ ID NO: 18160 - DNA, 118 bp, Homo sapiens
gaactatgggtttcaacttatgtaatggtaattgtccccaagtatattgatgtgttggctttttgaaatttagaacagactttttctgtactactacaaatacaagttggccccagac

SEQ ID NO: 18161 - DNA, 173 bp, Homo sapiens
  misc_feature 98: k=g or t
attttcacccaggcttactgctgcccgatcttctgattgttaaagagaagctgaaaatctgattcttatctgaaatttctcaactttgaaagtacgtktcagagaattaaaatgcatttaaaaattttaaaaatagtgctgaccaaagagatcacatctgtacactggctccc

SEQ ID NO: 18162 - DNA, 107 bp, Homo sapiens
ggatgtgagggcgatctggctgcgacatctgtcaccccattgatcgccagggttgattcggctgatctggctggctaggcgggtgtccccttcctccctcaccgctc

SEQ ID NO: 18163 - DNA, 133 bp, Homo sapiens
  misc_feature 10: y=c or t
  misc_feature 13: b=c or g or t
agcaagagtygcbtttattaggcctcaagtatagagacacgtctatcatctgaactttaaaagtactttaatagtttactgatgacacgatgttgaaattctgtaacttggccgggcacggtggctcacgcct

SEQ ID NO: 18164 - DNA, 177 bp, Homo sapiens
ttcaagaccagcctgaccaacatggagaaaatgtctctactaaaaatataaaattagccgggcgtgatggcgcatgctgtaatcccctcaggaggctgaggcagcagaatcgtttgaacccaggaggcagaggctgtggtgagctgagatcatgccattgcactccaacctggacaa

SEQ ID NO: 18165 - DNA, 122 bp, Homo sapiens
  misc_feature 29: w=a or t
  misc_feature 36: m=a or c
  misc_feature 43: r=a or g
tttaaaataggcttttgactgggcatggwggctcamgcctgtrgtcccggcactttgagatgctgaggcaggtggatcatttgaggtcaggagttcgagaccaacctagccaacatggtgaa

SEQ ID NO: 18166 - DNA, 328 bp, Homo sapiens
  misc_feature 317: v=a or c or g
ctctcaaatatagaacttgaccccacccctttttgttgatattcctctcccagtgccactaaaattccagtctctcaggtcagaaactttataaacaattcattcttccttttccttcatcaccatatcctcaatctctgatcattgccatatttccttcaatatttctctttttttatgatttttaaaattacactttaaattctgggatacatgggcagaacgtgcaggtttgttacataggtatacacatgccatggtcgtttgctgcatctatcaacccatcatctacattaggtatttctcctaatgctatvcctcccctagc

SEQ ID NO: 18167 - DNA, 111 bp, Homo sapiens
  misc_feature 103: r=a or g
  misc_feature 104: w=a or t
tgatcagttgacaaaaattttgtatcttgagacttatatttgccatagaagaaatgattcagtatttgctaattcagtgttcatggcaacttttttcgttttrwttttttt

SEQ ID NO: 18168 - DNA, 229 bp, Homo sapiens
  misc_feature 163: y=c or t
  misc_feature 164: y=c or t
  misc_feature 166: k=g or t
  misc_feature 167: y=c or t
attgctatagccttcctcttagaactgctttttctgtatcccacaggtctgtagtaatgaattccctcagcccttatttgtctgggagtctttatctctccttcatttttgaaggagagctttgctaggtatagtattcctggttggcagattttttggtgtyytkytctttaaatatatttttcactcagcactttgaatatatcattctactttctcctggcctgta

SEQ ID NO: 18169 - DNA, 87 bp, Homo sapiens
  misc_feature 13: w=a or t
  misc_feature 14: w=a or t
  misc_feature 44: w=a or t
  misc_feature 45: w=a or t
ttctgtctgtccwwctttctctttctttctctctctttctcttwwtctctcttttctttctctcttccttctttctctctcttttct

SEQ ID NO: 18170 - DNA, 95 bp, Homo sapiens
  misc_feature 12: s=g or c
  misc_feature 62: n=a, g, c or t
cctgggctcacstaatccgcccacctcggcctcccaaattgctgggattacaggcgtgagcnaccacacccatcccattgctttttttttttttt

SEQ ID NO: 18171 - DNA, 192 bp, Homo sapiens
gtgacaaagtaccacagactgggtggttgaaacacagaaatttattttctcacaatttcggaggctctagaagtctgagatcaaggtgttggcaggtttggtttattctaaggcctttctctatggcttgtagatggccttctatctctggtgttttcatgcggtctttttcactgtgtgtgtgtgtgtgcg

SEQ ID NO: 18172 - DNA, 280 bp, Homo sapiens
  misc_feature 101: r=a or g
  misc_feature 114: k=g or t
  misc_feature 115: k=g or t
  misc_feature 117: k=g or t
  misc_feature 139: b=c or g or t
  misc_feature 145: s=g or c
gtgtgcctcgccaacctggccccgtctgcctcagccacccagcggccttcctccctgcaccagtcacctaccttgaaggatttttcttttttaaaaatcarcattttttttcckkcktttttttgaaacagggtctcabtctgtsgctcaggctagagggcagtggcgtgatcatatctcactgcagcctcaacctcctgggctcaagtgatccacccacctcagcctcccaagtagcaggaactatggacatgcatctccacactaattccctggctta

SEQ ID NO: 18173 - DNA, 130 bp, Homo sapiens
  misc_feature 99: b=c or g or t
ccttaggttttcagttagcgctggagcaaggagagagctgacaccagagtcttcctggaaggctgggggaattctggaatcccaggctctctccctgtbaccttccttctcatgggcagtgcatccgcca

SEQ ID NO: 18174 - DNA, 111 bp, Homo sapiens
caaaggaagcagcagtttactttcaattggtaagaacagcagacttctcagaggtggtggcatttgagctgagccttgaagggtgagtaggatttagatcacagagaaagg

SEQ ID NO: 18175 - DNA, 152 bp, Homo sapiens
  misc_feature 120: s=g or c
ccatctttcaacgatttctttgtcagaaaaagtaatttttattatttttttgaaacaggattttgttttatcacccaggcgggagtgcagtggcagaatcacagctcactacagcctcasccttccaagttcaagcgatcctcccacctcga

SEQ ID NO: 18176 - DNA, 188 bp, Homo sapiens
  misc_feature 128: y=c or t
actcattatgaatttttttcttttttttaattttattattattatactttaagttttagggtacatgtgcacattgtgcagtttagttacctatgtatacatgtgccatgctggtgtgctgcaccccyttaactcgtcatttagcattaggtatatctcctaacgctatccctcccccctcccccaac

SEQ ID NO: 18177 - DNA, 94 bp, Homo sapiens
atgtatacatgtgccatgttggtgcgctgcacctattaactcatcatttagcattaggtatgtctcctaattctatccctccccgcccccccat

SEQ ID NO: 18178 - DNA, 129 bp, Homo sapiens
aaagggtggccacagccccacgtggtgtgccctggaggcttaggttggtctgaggttggcacctcaatctacaccagagcccagggagtcccagaggcaagtttcacagaattgtcaaatgatcccaca

SEQ ID NO: 18179 - DNA, 236 bp, Homo sapiens
gtgcatacatcatttatatttaatgtgattattgatctgactctattttatctcttgttgacttttacctgcaacttttgtatgtgtatgagtgcatgcatgcatatttttactggttgctttagggtttatagtacacatcttcaatctattatagtttatcttcaagtgagatgataccacttcatgtatagtataaggaccttgtaacagtatagatccatttcctcccttcg

SEQ ID NO: 18180 - DNA, 195 bp, Homo sapiens
tctggggagaagcccaagactctgcatttctgacaagctcccaggcagtgcctgcaccattctccggttctctttccctagcaccttctcttgctgcttgccttgctctccctcaacccagtttcgctaactgaagggcttgttttctgctatgtgataacagaacactggatattagtgattttcccaggcaac

SEQ ID NO: 18181 - DNA, 308 bp, Homo sapiens
ctcctgcacacccactcggcatccaccgcttcacttccctccctctcctgcaggcatccaggcctgccctggccaccatacccatgctaccccgtgaatctcttgctgccctgctctcttttttttctttttttattttattttattttattattattatactttaagttttagggtacatgtgcacaatgtgcaggttagttacatatgtatacatgtgccatgctggtgtgctgcacccattaacttgtcatttagcattaggtatatctcctaaagctatccctccccgctcctcccaccccgat

SEQ ID NO: 18182 - DNA, 76 bp, Homo sapiens
  misc_feature 15: w=a or t
  misc_feature 16: y=c or t
tatagttaataatgwyactgttcatcaccattctaaaatactgttcttccaaccctatcttcaatgaccagtccag

SEQ ID NO: 18183 - DNA, 171 bp, Homo sapiens
  misc_feature 125: s=g or c
cattttcagtggcgatatatcccctttgaccttctcttgatgaaatttacatggtttcctttgagactaaaatagcgttgagggaaatgaaattgctggactatttgtggctcctgagttgagtsattttggtgaaagaaagcacatccaaagcatagtttacctccccac

SEQ ID NO: 18184 - DNA, 261 bp, Homo sapiens
gcatgagccactctgcctggcccaatgtttatttttaaatatgtgattgttaaaggtgtgagataccagacatatgatattatgtatcttgtattttaatagataatttatcttgtacattttttatgtcagttcatttagagccctcattatttttagcagttgcacagtatcccatagcatgaatatttcatgatttacttaatattttcctactaatggacagaaattgtagcagctttcaatttttttttttttttt

SEQ ID NO: 18185 - DNA, 167 bp, Homo sapiens
  misc_feature 37: k=g or t
  misc_feature 95: k=g or t
  misc_feature 97: s=g or c
  misc_feature 146: k=g or t
caaaagattggccgggcgtggtggtgggtgcctgtgktcacggctactggggaggctgaggcaggagaatggtgtgaacccgggaggcggacatktsagtgagccgagatcgcgccactgcacctccatcctgggtggcagacaakactccatctcaaaaaaaaaaa

SEQ ID NO: 18186 - DNA, 267 bp, Homo sapiens
  misc_feature 33: w=a or t
  misc_feature 93: d=a or g or t
  misc_feature 94: k=g or t
  misc_feature 153: d=a or g or t
catataaatcaggtggaatttacccttccaggwgattgaaggggagatatgtaactctcaagctgattatagacaagagtaaatgacccaggdkaagtggagataaaatcatataggaatccctataggagaccccatggctgtgcttaggadgaggactgctggcaatcacgaaagattttagggaggggacagtatttgagttggattttgagtgatgtttgggcatgcgggctgaggacattttgggtactgagtacagacatg

SEQ ID NO: 18187 - DNA, 126 bp, Homo sapiens
  misc_feature 12: m=a or c
  misc_feature 111: s=g or c
  misc_feature 112: m=a or c
  misc_feature 122: n=a, g, c or t
tatttttagtamagacggggtttcaccatgttgaccaggctgctctcaaactctcgacctcaggtaatctgcccgcctcagcctcccaagtgctgggattacaggcgtaasmaccacacccngcca

SEQ ID NO: 18188 - DNA, 79 bp, Homo sapiens
aatttttaggtaggcaggtttgtagtttttcttttggctttgtgtttttttgttgtttttttttcatcttcctcagccc

SEQ ID NO: 18189 - DNA, 110 bp, Homo sapiens
  misc_feature 95: k=g or t
ttttaatttcactgcaatgactttactttgcatttataaaatagtgattttaatttgcatttacctaactactgatgatgttgagcatctttcckttccttttctttttt

SEQ ID NO: 18190 - DNA, 212 bp, Homo sapiens
  misc_feature 132: m=a or c
  misc_feature 184: w=a or t
  misc_feature 200: w=a or t
  misc_feature 202: k=g or t
  misc_feature 203: y=c or t
  misc_feature 212: r=a or g
ctctactaaaaatacaaaaaattagccgggcgtggtggcgggcgcctgtagtcccagctactcgggaggctgaggcaggagaatggcgtgaacctgggaggcggagcttgcaatgagccgagatcacgccamtgcactccagcctgggcgacagagcgagactccgtctcaaaaaaaaaaaaawttttttttaaaaagawtkycccccccar

SEQ ID NO: 18191 - DNA, 121 bp, Homo sapiens
  misc_feature 7: r=a or g
  misc_feature 70: w=a or t
atatttrtttatttatttattgagatgcggttttgctcttgttgccctggctggagtacaatggcatgawctcagctcagctcactgcaacttctgcctcccaggttcaagcgattctcct

SEQ ID NO: 18192 - DNA, 111 bp, Homo sapiens
  misc_feature 91: m=a or c
gatcgagaccatcctggctaacacggtgaaaccctgtctctactaaaaaatacaaaaaattagctgggcatggtggcgggcgcctgtagtmccagctactgggggggctga

SEQ ID NO: 18193 - DNA, 122 bp, Homo sapiens
  misc_feature 54: w=a or t
  misc_feature 55: w=a or t
  misc_feature 87: w=a or t
  misc_feature 88: m=a or c
  misc_feature 95: w=a or t
tttaaaataggcttttgactgggcatggtggctcacgcctgtagtcccggcacwwtgagatgctgaggcaggtggatcatttgaggwmaggagtwcgagaccaacctagccaacatggtgaa

SEQ ID NO: 18194 - DNA, 71 bp, Homo sapiens
  misc_feature 36: w=a or t
cagtggtttgtcttgatacttgtaagtgaagctgtwtctccccaattatgaaatgcggtgatggtggtttt

SEQ ID NO: 18195 - DNA, 168 bp, Homo sapiens
  misc_feature 134: m=a or c
gcctgtgcaacatagcaagaccttgtctctacagaaaaattaaaaattagccaggtgtggttgtttgtgcctatagtcgtagctatcaatggtcactgcagccttgaactcctgggatcacgtgatcctcacamctcagcttcccaagtagctacgactataggcaca

SEQ ID NO: 18196 - DNA, 161 bp, Homo sapiens
  misc_feature 23: r=a or g
  misc_feature 109: m=a or c
  misc_feature 110: m=a or c
  misc_feature 141: m=a or c
actctgtcgcccaggctggagtrcagccatgtgatctcggctcactgcaacctccaccttgtgatctcggctcactgcaacctccacctcccgggttcaagtgattctmmtgcctcagcctcctggagttgctgggactamaaggcacacaccaccacgcc

SEQ ID NO: 18197 - DNA, 93 bp, Homo sapiens
  misc_feature 16: w=a or t
  misc_feature 47: b=c or g or t
  misc_feature 63: y=c or t
  misc_feature 64: y=c or t
ggtgcatattttgcawatattttctctcattctgtaggttgtctgtbcactctgttgatagtyycattcactgcgcagaaagttttttgtgta

SEQ ID NO: 18198 - DNA, 175 bp, Homo sapiens
  misc_feature 61: s=g or c
gggaagtatgtggacaaactcagaataggccccaaatgcaaggatatttgtttcctgtgtsaaagcttatcaaaagctttcttatcaaaagccgtcttctgtaggtaaggctcttaatatttagatggacagcatagcatacactgtggacattgattagcctctttccccagct

SEQ ID NO: 18199 - DNA, 133 bp, Homo sapiens
tttgtatttttactagagacggggtttcaccatgttggttaggctggtctcgaactcctgacctcaaatgatccacccacgtcggctttccaaagtgctgggattacaggtgtgagccaccgcgcctggccgt

SEQ ID NO: 18200 - DNA, 166 bp, Homo sapiens
  misc_feature 161: k=g or t
  misc_feature 162: k=g or t
atggttggttactattaacactttctgttgacttgataaagagaaagtgcatgtgaagaagaaattttaaaatgaacattgaatccaagaactcttgaatctatggatggacataacaaggcaccttggagcagactctactttgggtacttggtgtcctkkccta

SEQ ID NO: 18201 - DNA, 103 bp, Homo sapiens
catgttataatggagacctcattagccttcagtcagatctaggtggaagggacgtgtcttgtctcaaatgagactttggacttgggacttttttttttttttt

SEQ ID NO: 18202 - DNA, 183 bp, Homo sapiens
  misc_feature 7: r=a or g
  misc_feature 19: w=a or t
atcccargtgattcctgtwcggctggtgtgatctcattacatgagcaaggccaaagaggccttccgaatttgtggacttacctcccattgcccattagcccatgagctgccattttctttttgcaagatacgcagtcatcagaagcagcatctgaaatccttataattacatgccacagccgc

SEQ ID NO: 18203 - DNA, 107 bp, Homo sapiens
  misc_feature 10: m=a or c
  misc_feature 12: m=a or c
  misc_feature 41: m=a or c
tttattttgmgmcagaatctcactctgtcgcctaggctggmatacagtggcacgatcactgcatttgaactcctgggctcaagcaattttccctcctcggcccccga

SEQ ID NO: 18204 - DNA, 159 bp, Homo sapiens
ggactacaggtgcacaccaccacacctggcctatttttttgtatttttagtagagtcggggtatcaccatgttcgccaggatggtctcaatctcctgacctcatgaaccacacttaagtacaattttgaaacagcatgaggctgggcgtagtgcctcac

SEQ ID NO: 18205 - DNA, 217 bp, Homo sapiens
ccatcaaataaagaggtaataagattgcaacccacggggcacagatctccaaagagatgctgctgatgtctctgagcccagaggctcccatggggctgggacccaaaccttggagaatgaggcgctgctcagcgttgctggtgctctggctgggtacagaaaagctggttctgtgagtattaaaaagaaaaacaagcaaccccccactccccggcta

SEQ ID NO: 18206 - DNA, 138 bp, Homo sapiens
  misc_feature 2: v=a or c or g
  misc_feature 8: m=a or c
  misc_feature 85: m=a or c
tvccagamcactcacattcacatgttcctctgggagtagggataagtctcattctctacacatgggatggtgtatacccaaatamaatcagggggcaagggtagagaagaatggctgttctgtttttttttgttttgt

SEQ ID NO: 18207 - DNA, 153 bp, Homo sapiens
  misc_feature 123: r=a or g
aactagccaggcatgatggtgcctgcctgtaatctcagttacttgggaggttgaggtggaaagattgcttgagcccaggaggcagaggttgcagtaagccaagattgcgccactgcactccarcctgggtgaaagagtgaaactcccgcctac

SEQ ID NO: 18208 - DNA, 87 bp, Homo sapiens
gatctcgatttcggacggccccctctgcaccgaccgttaccgatccgctcgccgtgcgtgacgaggttagcgatccgaaatcgagat

SEQ ID NO: 18209 - DNA, 168 bp, Homo sapiens
  misc_feature 10: m=a or c
  misc_feature 19: m=a or c
  misc_feature 32: w=a or t
  misc_feature 83: w=a or t
ctgagattgmggtggctamggcagacgttggwatctttcatcccacagcctttgataaatgtaattaaagtgtctgaattggwtggcagaaaaatgggagatgcccagcctgaaatgtttgacaaggtacttttattacattgtgacaaactgatggacgcccagtct

SEQ ID NO: 18210 - DNA, 87 bp, Homo sapiens
tttccatttgttcagggactcttatgtggcctggcttcctgcagaggtaacatttaggcaaagggatctgcctggggtctgccatcg

SEQ ID NO: 18211 - DNA, 186 bp, Homo sapiens
  misc_feature 89: w=a or t
  misc_feature 90: w=a or t
  misc_feature 91: r=a or g
caacacagtgttactaatcatcaggtgtaaatctatttatacttatataacaaggcaggtatcttttccttgtttattcttccttcccwwrgtgcctgcttggctgaatcagatagtgttttcatataaagaacctacagtcttggtaatgggtatataatctgttgttttaggagagaccttgac

SEQ ID NO: 18212 - DNA, 176 bp, Homo sapiens
  misc_feature 13: b=c or g or t
  misc_feature 14: m=a or c
  misc_feature 138: m=a or c
  misc_feature 156: k=g or t
  misc_feature 161: r=a or g
aaaaattgcaaabmaaaagataatacatagattctttggtttagctatgattaacaactggcgcagtgtgaatgtatgtactgtgttgaagtatgcatgtaaatgaataaacaatatgtatagacacaggtacttccmtgtggctgattgtggtakacaaratctgcccaggtgcc

SEQ ID NO: 18213 - DNA, 182 bp, Homo sapiens
catgatgctttacagtattagataagtaataaaaacagtgctacatgtttccatttgctacacacaaccccccgagaggtgagcagtgcttgtcactgcttttcacagatgaggaaatggggaagtggaggaaggagtggctgcccctgggcacttcactagataagatgtgtgaatggcat

SEQ ID NO: 18214 - DNA, 119 bp, Homo sapiens
  misc_feature 10: v=a or c or g
  misc_feature 27: d=a or g or t
  misc_feature 78: k=g or t
  misc_feature 97: s=g or c
cctatggtavatctacttcagtgagtdatagaataaaaattagactatgaaaaaacttaaactatgatctttattttkaaatagcattaaaacagcstgaattgaacaaagcccccaca

SEQ ID NO: 18215 - DNA, 108 bp, Homo sapiens
  misc_feature 46: w=a or t
gagtacatcttggctcactgtgatctccacctctgggctcaagtgwttctcccacttcagcctcccgagtaacttaaattacaggcacgcactaccacgcgtggcttt

SEQ ID NO: 18216 - DNA, 314 bp, Homo sapiens
  misc_feature 296: n=a, g, c or t
  misc_feature 297: r=a or g
catttggcctgtgcatctctgccctttggctgttctcgagttgtatacaaataaataaacagcatccaaattggaaaggaagaagtaaaattatccttatttgaagatgatatgagcttttatttggaaaaacctaaagacgccaccaaaaactattaggactggtaaacaaatttggtaaagtttcaggattcaaaatcaacatacaaatctcagtaacatctctatatgcaaacagtgaacaatttgaaaaagaaataacgaaaaatagtcccatttagaatagacacaaatanrattaaatacctaggaat

SEQ ID NO: 18217 - DNA, 152 bp, Homo sapiens
actggttgacacttaaattcttttttatttttatttatttatttattttttttgagaaggagtcttgctctgtcacacaggctggagtgtagtggtgcaatcttgggtcactgcaacatccgcctcccaggttcaatcaattctcccgctgt

SEQ ID NO: 18218 - DNA, 170 bp, Homo sapiens
tattttatgatcttctataaaataacagcattagtatttcattcataagtgtaataaagtaacatcaaacaagaaaaaaagcagagtccgactctggtgccttagtgaacgcagaaaagcctcacagatcagatttacagtaagccagagaaactcatctccacaccacc

SEQ ID NO: 18219 - DNA, 157 bp, Homo sapiens
gtgtcactctgtcatccaggctggagagcagtggcacaatcttggctcactgcaacctccacttcctgggttcgattgatcctcccacctcagcctcctgagtagctgagactgcaggcataaaccaccacacccagcaccccctcgcccacttttt

SEQ ID NO: 18220 - DNA, 300 bp, Homo sapiens
  misc_feature 122: r=a or g
gccaggcgtggtggctcatgcctgtaatcccagcacttttggaggccgagatgggtggatcacctgaggtcaggagttcaagaccagcctggccaacatggcaaaaccctatctctactaaraatacaaaaattagccaagtatggtggcacacgtctgtaatcccagctacttgggaggctgaggtaggagaattgcttgaacccaggaggtggaggttgcagtgagctgaggtcgtgccattgcactctagcctgggtgacatggtgagacctcggctcactgtaacctccacctcca

SEQ ID NO: 18221 - DNA, 121 bp, Homo sapiens
ccagcactttgggaggccaaggcagacagataacttgaggccaggagtttgagaccagcctggccaacatggtgaaaccctgtctctactaaaaatacaaaaattagccgggcatggtggc

SEQ ID NO: 18222 - DNA, 101 bp, Homo sapiens
  misc_feature 12: r=a or g
cctaagtaagaracttaagcacgtgtgtattttgctgataactcagaagattcagctgtttttattgaaccaacaatcataaattagtcttatttgtaaaa

SEQ ID NO: 18223 - DNA, 108 bp, Homo sapiens
catatatctatcctgacaatatttagcagttcaaaaggtaataagattatgaatatattattttgctttcattcttttcaccctctatttcaagacactatcgaattt

SEQ ID NO: 18224 - DNA, 185 bp, Homo sapiens
tttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttcccccttaa

SEQ ID NO: 18225 - DNA, 146 bp, Homo sapiens
taaacttaatataacatttatcaggtgatggtgtttagggagatgagtacttcttttcttagagcaacctgtgcattttcacaggattggatgtagctttataaagacaaaatgaaagtgtttaaaaagaacctaattttcggaca

SEQ ID NO: 18226 - DNA, 88 bp, Homo sapiens
  misc_feature 71: r=a or g
tctcagcacttcaggaagccgaggtgggaggatctcttgaagccaggagttcgagaccagcctaggcaacrtagtgagaccctgtctc

SEQ ID NO: 18227 - DNA, 165 bp, Homo sapiens
tgtgtaattctagtcttgtggttgtctgaccttccagcagattctttctctctgccagaaaagcttgtttgtttcatttccactttttggctccaactgagaagagaattccaaataactactctttgaagagaaattaacagccaagtctcaccccctccccaa

SEQ ID NO: 18228 - DNA, 81 bp, Homo sapiens
ttctgggtacaactcttttgtcagatatatatactgcaaatattttatcctggtttgtggtctggttttcctttccttttt

SEQ ID NO: 18229 - DNA, 208 bp, Homo sapiens
  misc_feature 7: y=c or t
caatacytttacccagagccaaataaataggtaagtcaggcaatgtattggtccattcttgcatcgctatgaagaaatacccaagactgtataatttgtggagagaggagttttaattgggctcacagttctgcaggctgttcaggaagcataggacttctggggaggccttcggaaactttcagttatgacggaaggtgaaggagga

SEQ ID NO: 18230 - DNA, 206 bp, Homo sapiens
  misc_feature 7: v=a or c or g
  misc_feature 83: k=g or t
  misc_feature 112: m=a or c
  misc_feature 141: k=g or t
  misc_feature 163: m=a or c
atataavaagtgaagtaatagctgttaatgtgttttgctccattagcagaaaaggaatttttttttttctatagtgacgaggkcttactgtgttgcccagcttggcattgamctcctggactcaactaattcccctgcttkgtttaccaaagagctgggattmcaggtgtgagccaccatgcttggccttgaattttttttttttt

SEQ ID NO: 18231 - DNA, 192 bp, Homo sapiens
gtttctaactactgatataaacagttaagtttcctttattttcttttttatactttaagttctggggtacctgtgcagaatgtgcaggtttgttacataggtatacacatcctatgggggtttgctgcactcatcaacccgtcatctacattaggtttttctcctaatgctatccctcccctagcacccctc

SEQ ID NO: 18232 - DNA, 120 bp, Homo sapiens; identical to SEQ ID NO: 17437

SEQ ID NO: 18233 - DNA, 214 bp, Homo sapiens
catcacggtccctcacgacttcccttggctagaggagggagttcctgaccccttgtgctttccagtgaggtgatgccccaccctgcttctgcttgccttctgtgggctgcacctgctgtctaatcagtcccagtgagatgaactgggtacctcagttggaaatgcagaaatcatccaccttctgcattggtcttgctgggagctgcagaccggc

SEQ ID NO: 18234 - DNA, 107 bp, Homo sapiens
cccagtaatgggattactgggtcaaatggtatttcttgttctagatccttggggaatcgccacactgtcatccacaatggtggaactaattcacactcccaccaacg

SEQ ID NO: 18235 - DNA, 111 bp, Homo sapiens
cttatagtagtctgctgtattttaatctactgacaactttatcttattttctttttggatttcctaaaagtttttgcttaggttatttaaataattataaatgaggccgat

SEQ ID NO: 18236 - DNA, 102 bp, Homo sapiens
gagtcagccctcgcgctgggggcgcaggaaacaatagaggccgcgcgcacagagcgagctcttgcagcctccccgcccctcccgcaacgctcgacccccgat

SEQ ID NO: 18237 - DNA, 195 bp, Homo sapiens
ctggttgtctgtcttttgtctgatggccgttataatgggtgtgtgtgatagtttctcattgttgctgtaatttatattttcttttttttatttttattttattttattattattacacctaatgctaaatgacgagttaatgggtacagcacaccagcatggcacatgtatacatatgtaactaacctgcacatt

SEQ ID NO: 18238 - DNA, 158 bp, Homo sapiens
ttgatatatttatctttttattatacaaaaatacaaacccatacctaatggagagagtattggagtgaatgaaggagccccatgatctcatctccttgcttcaacagctcattggcaaattcatttattagttcttcaaaccaccccccccacccccc

SEQ ID NO: 18239 - DNA, 129 bp, Homo sapiens
cctgtaatccgagctatccaggagactgagacaggagaatcgcttgaacctggaggcagtaagccaagatcgcaccattgcattccagcctaggcgacagagcaagactctgtctcaaaaaaaaaaaga

SEQ ID NO: 18240 - DNA, 133 bp, Homo sapiens
  misc_feature 7: m=a or c
  misc_feature 8: y=c or t
  misc_feature 9: y=c or t
ttctccmyyttgaagtagattttttttaagactttttttattttttatttttgagacggagtcttgctctgttgccaggctggagtgcagtggcacaatctcggctcactgcaaactccacctcccgggtata

SEQ ID NO: 18241 - DNA, 112 bp, Homo sapiens
  misc_feature 7: y=c or t
  misc_feature 24: r=a or g
  misc_feature 99: r=a or g
cgggtgyggtgacacacatgagartcacttgaactcgggaggctgagtttgccgtgggctgggatcgcgctgctgtactccagcctgggtgacaaagcragaatctgtctca

SEQ ID NO: 18242 - DNA, 113 bp, Homo sapiens
  misc_feature 95: k=g or t
tgcagtggcacgatcttggctcactgcagcctctgcctcctggttcaagcgattcttctgcctcagcctcctgagtatctgggattacaggtgtktgccaccatgcccggcta

SEQ ID NO: 18243 - DNA, 232 bp, Homo sapiens
  misc_feature 187: s=g or c
  misc_feature 188: r=a or g
ggttaatggcctttaatagctcctcatcaccttcagggataaagtcctggctatttatccagcattcaaggtcctgagtgccagtgcatgtgtgtgtgtgagtgtgtgaatgcatgagtgtgtgtggttgtgtgggtgtaagtgtgtgtttggagtaggggtggaggatatgataggaaatgaggcsrgagaggaagccaagggccaggtgacactcaggaccttgaatgct

SEQ ID NO: 18244 - DNA, 97 bp, Homo sapiens
  misc_feature 7: v=a or c or g
  misc_feature 8: m=a or c
  misc_feature 59: n=a, g, c or t
  misc_feature 63: v=a or c or g
  misc_feature 80: w=a or t
ttgtggvmaaaaatagatattttctctagaattatgctcagtgtgatgagatgcttgtnctgvgaggaggataaggaggwaactaagatcagccaaa

SEQ ID NO: 18245 - DNA, 112 bp, Homo sapiens
  misc_feature 7: s=g or c
  misc_feature 77: n=a, g, c or t
  misc_feature 87: k=g or t
  misc_feature 104: h=a or c or t
  misc_feature 106: v=a or c or g
gtttgtsacatatgtatacatgtgccatgcttgtgcgctgcacccactaactcatcatctagcattaggtgtatctnctgatgctakccctcccccctccccghavccccct

SEQ ID NO: 18246 - DNA, 82 bp, Homo sapiens
agactatactttcagggatcagttctatagtgtgttactagagaagtttctctgaacgtgtagagcaccgaaaaccacgagg

SEQ ID NO: 18247 - DNA, 106 bp, Homo sapiens
acatgtgccatggtagtttgctgcatccatcaacccatcatctaggttttaagccccacatgcattaggtatttgtcctaatgctatccctccccttgccccccat

SEQ ID NO: 18248 - DNA, 271 bp, Homo sapiens
  misc_feature 7: s=g or c
tgagatsggtgtgaggaggaagaacaaatatatggtcaagatgagctccagtctggacatgtggggttgcaatgccccagggacatctaggggatgacgcccagcagctccactgaggtggcttttggctggaaatggaagtttgggaggagtccccaccacatagctggcggctgaggctctggaagggagtgaggtcacccgaggagggcgtgcagaggctccttactgtcttctgggaagtaagggttgctcctcacacggaggtgcg

SEQ ID NO: 18249 - DNA, 338 bp, Homo sapiens
  misc_feature 51: n=a, g, c or t
  misc_feature 52: s=g or c
  misc_feature 83: n=a, g, c or t
  misc_feature 84: s=g or c
  misc_feature 133: v=a or c or g
  misc_feature 134: v=a or c or g
  misc_feature 135: d=a or g or t
  misc_feature 191: s=g or c
gggcagtttgtgagtttttacttcttgtcatgaactggccatagactggtnsagggcctgagctggggaaagttgaatcatcnsgaagaaagcagtaaaaagccgtccgtcatggtcccatctccctggttcvvdcctttctgcctgtgtgacacccactccctcaagagcctcctggcatccgtgcgcastagaactgggggactaaggagggtgaaagaatgccgctagcgagagctgctctcagaagttcccttggtgtgctgggggtttgggtgacattatttccaggcttaagctgctaactggcttcctgataaatcttgtggccgggcttc

SEQ ID NO: 18250 - DNA, 87 bp, Homo sapiens
  misc_feature 2: h=a or c or t
ahattatgaattaagtttttaaaaccatgttattcagatgttctatttctttcttttttaaaatagttttttattttttttttttga

SEQ ID NO: 18251 - DNA, 102 bp, Homo sapiens
tttgtgccaggccctatgatgggtgctttcatgtacatcattacatttttctttttctttttctttttcttttcttttttctttcttttttttttttttttt

SEQ ID NO: 18252 - DNA, 165 bp, Homo sapiens
ttcccttcctggtgcctgtcagatgtttgtaatcttgtttcagttgaattaagaattacagttgaggccaaggtgggaggatctcttgagcccaggagtttgagaccagcctaggcaacacagggaaacttcatcactacaaaaaaaaaaaaaaaaaaaaaaaaa

SEQ ID NO: 18253 - DNA, 168 bp, Homo sapiens
cttgggtgtttctgtcttcctgggcattgaagcaaaaagcagattatcatttatgaaaaagaaaaaagaatgtagatattagattgattcacctaatgtcaaaatagtctaagaagcaatatactcttataagtcttgggcccagtttttttgtccttgaattttttt

SEQ ID NO: 18254 - DNA, 149 bp, Homo sapiens
  misc_feature 19: n=a, g, c or t
  misc_feature 79: r=a or g
tggaatcaacacgattgcnatggaatggaatggaatggaatggaatggaatggaatggaatggaattaaccggaatagratggaatggaatggaatggaacggaatggaatggaatggaagggaatggaatcaacacgagtacaggggt

SEQ ID NO: 18255 - DNA, 188 bp, Homo sapiens
  misc_feature 32: m=a or c
  misc_feature 137: k=g or t
  misc_feature 138: b=c or g or t
  misc_feature 139: n=a, g, c or t
gaagtttctgcttcctgctgcgggaatcggamgccccaggcatatacaagctgagtttcagccatggaaaaactccatgggcatgtgtctgcccatccagacatcctctccttggagaaccggtgcctggctatgckbnctgacttacagcccttggagaaactacatcagcatgtatctacccactc

SEQ ID NO: 18256 - DNA, 150 bp, Homo sapiens
  misc_feature 54: r=a or g
gggttggatgggcgtggtggtgggcgcctgtaatccatcccagctactcgggargctgaggcgggagaatcgcttgaacccgggaggcggaccactgcactccagcagagtgagactccctcccaaaaaaaaagaatccatctatcctgt

SEQ ID NO: 18257 - DNA, 221 bp, Homo sapiens
taggtatgtcgaaatctcatggggagtaggtggtatttcagggaaacaaaagagcaaaggtttggtcccagtgcttaaggaatttgtacattgttaagttatgcagtatacatgtatatgaggatttattcctagaacttcaagtatgaatgtacgaatgtatgtttttattctcattttaatggatatgtagtttagttttctttttttttttttttttt

SEQ ID NO: 18258 - DNA, 86 bp, Homo sapiens
caaaattagccgggcgtagtggcgcatgcctgtaatccctactcgggagcctgaggcaggagaatcgcttgaacccaggaggcggg

SEQ ID NO: 18259 - DNA, 138 bp, Homo sapiens
  misc_feature 120: r=a or g
cctgatattttcaatctttttttcttagagaatgtaaaaaacattattaaatacactttcctggatataaacaccttgtgaatttcttctcccttggcacttttaaattctgttacaacracactccccacacccccc

SEQ ID NO: 18260 - DNA, 146 bp, Homo sapiens
tatcacttctaagagatttctggtgaaacttgtggattttctatacatgacaccatgttttctgcaaatggacaatttgactcctcttttcctatctggatgctttttatttctctctcttgcctgatttatttggctaggatttt

SEQ ID NO: 18261 - DNA, 166 bp, Homo sapiens
tagtagcagttaccatttattgaggactcaatcctctcaagggacctattaggtgagtagtattatgatgcttatttcatgaattagaacgttgagatatggaaattaaataatttgcctataatcatatagacttgggtttcttttttctttttttttttttttt

SEQ ID NO: 18262 - DNA, 102 bp, Homo sapiens
attgacaccaatcactgagaatttatcatgaagcacttttgacttatttcctcatttacttgtcacaacaagcatatgaactttactctttttttttttttt

SEQ ID NO: 18263 - DNA, 225 bp, Homo sapiens
aagggttatttagaaactctctgtattatctaatcaatttttctgtaaacctaaaattgctctaaaaaatagtctattaaatttttaagtcaattaaaattataaataaaagattttaatgaagcagtgaggtttatataaaacatcttatacttacaagagcctattttaagctgctcacttaacttcagttatgtaaaaaaactacacactttagcaccccac

SEQ ID NO: 18264 - DNA, 94 bp, Homo sapiens
  misc_feature 2: v=a or c or g
  misc_feature 23: r=a or g
tvataaggggattgaggaccatragttttattgttatcctttatgcaacttataatgtttcttttataggattctttttttttttttttttttt

SEQ ID NO: 18265 - DNA, 229 bp, Homo sapiens
  misc_feature 5: w=a or t
  misc_feature 7: m=a or c
  misc_feature 8: m=a or c
  misc_feature 126: r=a or g
  misc_feature 191: m=a or c
cagawammtagatatgcttgttttaacagtttagagcattgattctaaaatttgtaaatatttacttcaaaaataattaacagttaatttaaaacattttattataattgcatactagtattagaragtttaggacgtgtggaaggttttaaaactggtggtatatcattaatattttctcattacatcamaatattctctggatatattcaagtgatttgggacaagc

SEQ ID NO: 18266 - DNA, 99 bp, Homo sapiens
ggatgtgagggcgatctggctgcgacatctgtcaccccattgatcgccagggttgattcggctgatctggctggctaggcgggtgtcccctccctcccg

SEQ ID NO: 18267 - DNA, 229 bp, Homo sapiens
  misc_feature 17: v=a or c or g
  misc_feature 75: k=g or t
  misc_feature 115: r=a or g
  misc_feature 153: m=a or c
  misc_feature 172: w=a or t
atgaggaatcccttgavatatacatatatgtcactatctgttatatataatgtcaagacattaattattattatkattattttgagatagagtctcactctgtcacccaggctgragtgcagtggcacgatctcggctcactgcaacctctgmctcctgcattcaagtgatwctcatgcgtcagcttcctgagtagctaggattacaggcacctgccatcacacccagc

SEQ ID NO: 18268 - DNA, 179 bp, Homo sapiens
attttggcttttgttgccattgcttttggtgttttagacatgaagtctttgcccatgcctatgtcctgaatggtattgcccaggttttcttctaggatttttatggacctaggtcttaacgtttaagtctttgatccatcttgagttgatttttctataaggtgtaaggaaggggtcca

SEQ ID NO: 18269 - DNA, 119 bp, Homo sapiens
atgacgcgatctcggctcacagcaacctctgcctcctgggttcaagcgatgctgtcgcctaagactcccgagtagctgggattacaggtgcccaccaccacgcccagctaatttttttt

SEQ ID NO: 18270 - DNA, 212 bp, Homo sapiens
gctcttgttctgcagccgcccgaagcgtcgagtctgcagtcgcccgggcgacggcggggtccgcgcggccaggcgggagtcatggatgtagatgctgaaagagagaagataacacaggagatcaaggagctggaaaggattttggatcccggctcctcgggctcccacgtggagatctcagaatcaagtctcgagtcaggttctgaagcaga

SEQ ID NO: 18271 - DNA, 274 bp, Homo sapiens
ttgtttcgtttgtgtgtcttttgatgttcattttccacactgtcgttcattagctaatctgtgaacacatggatgctcccattcacccctcatcagtcagtgaccgtgtgacctccgcacagctgtaactgtccacagactctgtcgtctcaattgtgagagtcatatgcccacaagattatgttctgtgtctttgtagttgttctgtgttttgaaatgatatgtatcttcttaacacagtggatggacagaaatgtatttccttcccacccaa

SEQ ID NO: 18272 - DNA, 130 bp, Homo sapiens
tgggcggatcacgaggtcgagagatcgagaccatcctggccaatatggtgagaccctgtctctactaaaaaatgcaaagattagctgggcgtggtggtgcacgcctgtggtctcagctgctcgggtggcg

SEQ ID NO: 18273 - DNA, 166 bp, Homo sapiens
  misc_feature 9: n=a, g, c or t
  misc_feature 10: n=a, g, c or t
  misc_feature 11: v=a or c or g
caattagtnnvcttgcaaaagtcagcaaaaagatcactgtgtaaatatttaaaaccacttttagatatgccagaagaaagaaccaccttgaagaattaataaggaatggtcaacatggttatgacttttgtctgttcttgatatttttgctgacttttgcaagggg

SEQ ID NO: 18274 - DNA, 187 bp, Homo sapiens
cctcagcctcccaagtagctgggattacaggcacatgccaccacacctgtctgatttttgtactcttagtagagacaagatttcgccatgttagccaggctggtctcgaactcctgacctcaggtgatctgccagcctcagcctcccaacatgctaggattacaggtgtaagccaccgcgcccagga

SEQ ID NO: 18275 - DNA, 237 bp, Homo sapiens
  misc_feature 2: v=a or c or g
  misc_feature 49: m=a or c
  misc_feature 127: k=g or t
  misc_feature 128: w=a or t
  misc_feature 132: w=a or t
tvcatatcctctccagcatctgttgtttcctgactttttaatgattgcmattctaactggtgtgagatggtatctaattgtggttttgattagcatttctctaatgactagtgatgatgagcttttkwtcawatgtttgttgtctgcataaatgtcttcttttgagacgtgtctgttgatatcctttgcccactgtttgatgaagttttttgtttatttgttgtaaatttgtttgag

SEQ ID NO: 18276 - DNA, 209 bp, Homo sapiens
  misc_feature 8: m=a or c
  misc_feature 42: d=a or g or t
  misc_feature 132: b=c or g or t
  misc_feature 133: h=a or c or t
  misc_feature 134: y=c or t
  misc_feature 145: r=a or g
tgaaatcmctcagaactggaaacattcattccactatttgtdgcttttttgataaacaaggataaattgaagttttaatagactggggctacatttgttgctccaggttcctgaagatcattatttttagtbhyacttaaattcrcacacacatgcatacacacacacacacacaccagatgccagtgtaaaaaatgggaggggggctc

SEQ ID NO: 18277 - DNA, 195 bp, Homo sapiens
  misc_feature 182: s=g or c
gccattctcctgcctcagcctcctgagtagctgggactacaggcacctgccaccacgcccggctaatttttgtatttttagtagagacggggtttcactgtgttagccaggatggtctggatctcctgacctcgtgatccgcctgcctcggcctcccaaagtgctgggattacaggcgtgascactgccccacga

SEQ ID NO: 18278 - DNA, 228 bp, Homo sapiens
attgctatagccttcctcttagaactgctttttctgtatcccacaggtctgtagtaatgaattccctcagcccttatttgtctgggagtctttatctctccttcatttttgaaaggagagctttgctaggtatagtattcctggttggcagattttttggtgtttttttttaaatatatttttcactcagcactttgaatatatcattctactttctcctggcctgta

SEQ ID NO: 18279 - DNA, 130 bp, Homo sapiens
  misc_feature 117: w=a or t
tggtgagatagatggtgaaagctgattcaatccacacgtctggagccaaagttcatttaacgagttttggggaagggacagcagagttgacttcatcaccgataaattgtacctcgwgggccgagcaact

SEQ ID NO: 18280 - DNA, 282 bp, Homo sapiens
  misc_feature 50: r=a or g
  misc_feature 114: r=a or g
  misc_feature 199: m=a or c
  misc_feature 200: v=a or c or g
ctcctattatattcaaagtaaaatgtatattagagaagtaggtataagaraatcttcatttagggccaggcacagtggctcatgcctgtaatcccagcactttgggaggcagargtgggtggatcacctgaggtcaggagttccagactggtctggccagcatggtgaaaccccgcctccactaaaaacacaaaaattmvtctgggtgtggtggctcacacctgtaatcccggcactttgggaggctgaggcaggaggactgcttgaggccaggagtttgac

SEQ ID NO: 18281 - DNA, 212 bp, Homo sapiens
  misc_feature 112: s=g or c
  misc_feature 115: v=a or c or g
acccaggctgaacagcaatgaagcaaccttggttcactgcatcctccccctcctgggttcaagtgattcttccacctcagcctcctgtgtagctgggattacagatgctcascavccacgcctgggctaatttttgtatttttagtagagacggttttgccatgttggccaggctggtctcaaactcctgacctcaggtgatccgcctgcca

SEQ ID NO: 18282 - DNA, 244 bp, Homo sapiens
  misc_feature 12: s=g or c
  misc_feature 87: r=a or g
  misc_feature 117: w=a or t
gttgctgcggascaggaggggaagcgatggctgggcccgcgtggatctccaaggtctctcggctgctgggggcattccacaacccaraacaggtgaccagaggttttactggtgggwatcaactttgccaagcttatgtagattactcttagatttaagcagacagttttatagaggaactaagaaaaaaatggaagctctcttgataaaaagtctgattttccctgagtaccaaaacagcgga

SEQ ID NO: 18283 - DNA, 205 bp, Homo sapiens
tttcaagtgattctcctgcctcagtctcctgagtagctgggattacaggtgcatgtcaccatgcccagctgatttttgtatttttagtagagacggggttgtgccatatgggccaggctggtctcgaactcctgacctcaagtgatctgcctgcctcggcctcccaaagtgctgggattataggcatgagtcactgtgcccagcc

SEQ ID NO: 18284 - DNA, 362 bp, Homo sapiens
  misc_feature 8: n=a, g, c or t
  misc_feature 9: v=a or c or g
  misc_feature 335: w=a or t
  misc_feature 337: w=a or t
gctcctgnvtgtaatcacagcacttcgagaggccagggcaggtggatcacgaggtcaggagatcgagaccatcctgactaacatggtgaaatcctgtctctactagaagtacaaaaaattggccgggcatggtggtacgcgcctgtagtcccggctacttcggaggctgaggccggagaatcgcttggacctgggtggtagaggttgcagtgagctgagatcatgccactgcactccagcctgggcagcagagtgagactccatctcaaaaaataaaaaataaaaaaattatttaagtagaacaacattcagtatggacatcaaactgttgatawawaacctgtttcttatttgattgcaag

SEQ ID NO: 18285 - DNA, 238 bp, Homo sapiens
  misc_feature 7: b=c or g or t
  misc_feature 8: d=a or g or t
  misc_feature 9: b=c or g or t
  misc_feature 37: k=g or t
tccatabdbctctccagcatctgttgtttcctgactktttaatgattgccattctaactggtgtgagatggtatctaattgtggttttgattagcatttctctaatgactagtgatgatgagctttttttcatatgtttgttgtctgcataaatgtcttcttttgagacgtgtctgttgatatcctttgcccactgtttgatgaagttttttgtttatttgttgtaaatttgtttgag

SEQ ID NO: 18286 - DNA, 144 bp, Homo sapiens
  misc_feature 63: n=a, g, c or t
  misc_feature 84: h=a or c or t
ctcctgacttcaggtgatccacctgcctcagcctcccaaagtgctgggattgcaacctctgcntccctggttcaagcaattcthctgcttcagcctcctgagcagctgagattacaggcatgagccaccatgccctgctatttt

SEQ ID NO: 18287 - DNA, 198 bp, Homo sapiens
  misc_feature 7: m=a or c
ttacaamaggtagaaaagagtgtggaggaagattatgtgactaatattcgaaataactgctggaaagaaagacaacaaaaaacagatatgcagtatgcagcaaaagtataccgtgaatgatcgactccgaaggaaggcagatgccttgagcatggacaacataatgaaaccccatctctctcaaaaaaaaaaaaaaaa

SEQ ID NO: 18288 - DNA, 141 bp, Homo sapiens
tactggattggccaggctatactcagagccataattctgttctggtttgtttttatttttgttttaaatgaacatacgagataactttttatgaagagcaacaaagggtcattgtcatgacacacatttgagaggagaggt

SEQ ID NO: 18289 - DNA, 137 bp, Homo sapiens
aagtagaatgatggttgcaggggctggagagtgggggaaatagggagttgttcactgggtatagtttcagttttgcaagatgaaaatgtggaggttggttgcacaacactgtgaatatacttaacactactgtacca

SEQ ID NO: 18290 - DNA, 93 bp, Homo sapiens
aaactcctgagctcaggcaatctacccaccttggcctcccaaagtgctaggattacaggtgtgagccaccatgcccgcctttttttttttttt

SEQ ID NO: 18291 - DNA, 354 bp, Homo sapiens
  misc_feature 9: n=a, g, c or t
  misc_feature 10: m=a or c
  misc_feature 39: m=a or c
  misc_feature 79: r=a or g
  misc_feature 80: m=a or c
  misc_feature 248: d=a or g or t
  misc_feature 249: d=a or g or t
  misc_feature 286: m=a or c
ccttttagnmcatggattggaggggccaggcgcagtggmtcatgccggtaatcccaacactttgggaggcccacacggrmggatcacttgaggttgggagttcgggaccggcctggccagcatggtgaggccccatctctactggggatacaaaaatttctctggcctggtggcgggcacctgtaattccagctatttgggagactgaagcaggagagtcgtttgaacccgggagcagaggttgcagddactcaggattgcatcactgcactccagcttgggtgamagagcaagactccgtctcaaaaaaataaaaaagaacttggattggagggagtaagagtagatttgaga

SEQ ID NO: 18292 - DNA, 126 bp, Homo sapiens
tcagcttcatggatttgattgtcaaaccacatgtgggccactgtcatccggttctgagtcagagttccagttttatcagagcagatggtggacgtggaccccaaggaaaaactgcttagtgaagaa

SEQ ID NO: 18293 - DNA, 138 bp, Homo sapiens
gccatgaactccggggcttaagtgatccttctacctcagccccctgagtagctgagactataggtgcaccccactatacctggctaatttttatattgtttttgtagagatgggattttgctatgttgcccaggcttt

SEQ ID NO: 18294 - DNA, 151 bp, Homo sapiens
  misc_feature 11: w=a or t
atcagctactwgggaggctgaggtgggagaatcgcttgagaccagggagttggaggttgcagtgagccgaaatcacaccacagtactcaatcctggcaacagagtgagactccatctcagaggaaaaaaaaagttgagtcttccaatccat

SEQ ID NO: 18295 - DNA, 316 bp, Homo sapiens
gtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacaccgc

SEQ ID NO: 18296 - DNA, 88 bp, Homo sapiens
gctaatttttgtattttttagtagagacaggatttcaccatgttgtccaggctggtctccatctcctgacctcaagtgatctgcccgc

SEQ ID NO: 18297 - DNA, 125 bp, Homo sapiens
gtaaatgcagggaatgaatgctgctgcctgagatttgatctctccgctcctatcccatttagccatctggaaaggagtcagaggccacacacacttgagaatcttatttctaacatgaaggcatt

SEQ ID NO: 18298 - DNA, 341 bp, Homo sapiens
  misc_feature 283: w=a or t
  misc_feature 325: b=c or g or t
  misc_feature 326: w=a or t
  misc_feature 327: n=a, g, c or t
gaatcatatttattgatatgcatgttttgaaccagccttgcaccccaagaatgaagcctacttgatcatggtgaggtaactttttgatgtgctgctggattttgttattatttcattgaggatttttttttggcctatgttaatcaaggatattggtctatagttttcttttatcatcgtgtctttgccaggttttagtatcaaggtgatgctggcttcatagaatgagttaaggaggaatccctcatcttcagtttctgggaatagtttcagtagtattggwacagtttttctttgtgtgtctggtagaatttggctgtatcabwntggtccagggctac

SEQ ID NO: 18299 - DNA, 307 bp, Homo sapiens
  misc_feature 69: w=a or t
  misc_feature 250: w=a or t
  misc_feature 260: r=a or g
caaaggaacaagaatcagcttgacatcaaacttctcaacagcaatatcagatataagacagtgaatttwtttaaatactgaagagatccatttggttagggtgtagacagtcacagaataccaccactgtcactgtaatgttaaaggaacatcatgaagcctatgaaatcctatcttttcacctattaaagagttgaggatgcagagaagttgaggctgttggctgctttcatcctccagccaaatttgwcatgctgcargggcaagcacaatggattgaaatcaagagaagccacagatgcagaga

SEQ ID NO: 18300 - DNA, 149 bp, Homo sapiens
aacaacaaaaaaaagtttaaaaattggaaaccaccaaaaggtagtattaaaagggaaataaaaattactcataatcccagaacgcagtcatatgctatttttagtcttattttattcagccatttttctctttacactaactttttttt

SEQ ID NO: 18301 - DNA, 165 bp, Homo sapiens
aaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaa

SEQ ID NO: 18302 - DNA, 51 bp, Homo sapiens
  misc_feature 23: s=g or c
agtgctgggattacaggcgtgascaccgcgcctggcctccctggctttttt

SEQ ID NO: 18303 - DNA, 109 bp, Homo sapiens
tgaagcagcagtgaaaccaggggctctgcaggtcacttgggacggacgccaccagacttgtctccaaaaatcaccacctttaatactccccggcctgcacacacccacc

SEQ ID NO: 18304 - DNA, 265 bp, Homo sapiens
  misc_feature 34: m=a or c
  misc_feature 45: n=a, g, c or t
  misc_feature 62: k=g or t
  misc_feature 65: v=a or c or g
  misc_feature 189: r=a or g
  misc_feature 200: w=a or t
  misc_feature 201: r=a or g
  misc_feature 252: m=a or c
aaaaaatgaaggctgtactcagtctgctagagtmaaagttttgcnttatctttttacgccakctvtagtcaaaccacagcggagagaataatcgaatgaaaactgaagctttctgctttattccttttctccttctcctttcagtcaggaatttagataatgggctgtgtgcaatgtaaggataaagargcaacaaaacwracggaggagagggacggcagcctgaaccagagctctgggtaccgctatggmatagacccccgag

SEQ ID NO: 18305 - DNA, 159 bp, Homo sapiens
tctttttgataacagccatccgaactggggcgagatgatacctcattgtagttttgatttgcaattctctgatggttagagatgtgagcacattttcacatatttcttgaccatttttatgtcttcttagggaaatgtctattcagatcatttgcattt

SEQ ID NO: 18306 - DNA, 60 bp, Homo sapiens
atgatattttgacctccttccatgaatcatgaatgttctttttttttttttttttttttt

SEQ ID NO: 18307 - DNA, 61 bp, Homo sapiens
cagtgagccaagatcgtgcctctgcactccagcctgggtgacacagcgagacttgatctca

SEQ ID NO: 18308 - DNA, 183 bp, Homo sapiens
  misc_feature 56: w=a or t
  misc_feature 76: w=a or t
  misc_feature 79: r=a or g
catttctaacgagtactgcccaatcatttggtagaatgccccttaactttgggttwgtttgatgtttcctcacagwgaractcaggttaagtgtttttggcagggattacgcagaagcgatctgtgtctgtgtcaatgcatcctagcaagggcacatgatggcgatttatacctttttttttt

SEQ ID NO: 18309 - DNA, 160 bp, Homo sapiens
tgttcattgcagcactattcacaatagcaatggcatgcaatcaacctagatgtccatcaatgataaactggattaagaaaatgtggcacatatatatcatggaatactacgcagccataaaaaaggatgagttcacgtccttaacagggatatgaatgaa

SEQ ID NO: 18310 - DNA, 204 bp, Homo sapiens
aatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaca

SEQ ID NO: 18311 - DNA, 258 bp, Homo sapiens
  misc_feature 12: s=g or c
  misc_feature 101: n=a, g, c or t
tgaagtattttsaagcttagcaaacaattctacataaattataatctttaaattctcacagatagttaaccctatgagatccgataggaactgtgattgcnattggacagatgaagaaatgaagacccagaccggggtagcatctgatcactcatattgcaatccaggattgcgattaagtgctgatccccttttttttggtggtggttaaattttcataggactttattagtgaagtgatttaagagtcaatccact

SEQ ID NO: 18312 - DNA, 170 bp, Homo sapiens
  misc_feature 47: s=g or c
gtgcaaggatttgccgggtgtggtgacgcatgcctgtaatcccagcsactcaggaggctgggacgggagagttgattgagcccgggagacggaggttgcagtgggccaggatccccactgcactccagcctgggcgacagggcgagactccgtctcaaaaaaacacacgc

SEQ ID NO: 18313 - DNA, 216 bp, Homo sapiens
ccatccttttcattaagagaaaacacagggcgggcgcggtggctcacacctgtaatcccaccacgcccggctaatttttgtatttttcttttttttaaatggagacgggatttcaccgtgttagccaggcatggttgctcacacgtgtaatcccaacactttgggaggccaaggtgggaggatcgcttggcccaggagtttgagaccaggctggca

SEQ ID NO: 18314 - DNA, 242 bp, Homo sapiens
  misc_feature 46: k=g or t
  misc_feature 47: y=c or t
agtgggccgccatgttgtcggagtgaaaggtaagggggagcgagakygccaggactttgggaggctaaggcaggaagatcacttgagcccaggagttcgagagcagcctaggcaacatacagagtccccatccctacaaaaaagaaaaataaaaaattagccaggcctggtggttcatacctgtggtcccagctactggggaggctaaggccggaggatcctttgagcccaggaggttgagg

SEQ ID NO: 18315 - DNA, 168 bp, Homo sapiens
  misc_feature 2: k=g or t
akctgctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggcggcgacag

SEQ ID NO: 18316 - DNA, 197 bp, Homo sapiens
  misc_feature 70: k=g or t
agtattttatttctccttcacttatgaagcttagtttggctggatatgaaattctgggttgaaaattctkttctttaagaatgttgaatattggtccccactctcttctggcttgtagaatttctacagagagatcagctgttagtctgatgggcttcccttcgtgggtaacccaacctttctctctggctgcccaa

SEQ ID NO: 18317 - DNA, 200 bp, Homo sapiens
ggcggatcacaagatcaggagttccagaccagcctggccgatatggtgaaactgcatctctactaaaaatacaaaagaattagccgagcctagtggagcgtcactgcaacctccgcctcccggcttcaagcaattctcctgcctcagcctcccgagtagctgagattacaggcacgctccactaggctcggcaggagaat

SEQ ID NO: 18318 - DNA, 184 bp, Homo sapiens
aatcatgtcatctgcaagttgcaaaagtttcatttcttcctttctggtctgtacaatttttgtttccttttcttttcttttttctttttgagacagggtttcactctgtcactgaggctacagtgagccataatcatgccactgcacccagcctcagtgacagagtgaaaccctgtctcaaaaa

SEQ ID NO: 18319 - DNA, 197 bp, Homo sapiens
agtattttatttctccttcacttatgaagcttagtttggctggatatgaaattctgggttgaaaattcttttctttaagaatgttgaatattggtccccactctcttctggcttgtagaatttctacagagagatcagctgttagtctgatgggcttcccttcgtgggtaacccaacctttctctctggctgcccaa

SEQ ID NO: 18320 - DNA, 299 bp, Homo sapiens
  misc_feature 77: m=a or c
  misc_feature 78: w=a or t
aaatctgcaatttaaaaataaacaaaatgcttcataacattaaaaaataaaaatgtgttcaaagtaaaaagtgaaamwgactcccccttccaaattcccagaaattactatcattcatagtttggtgtgctttcttctcctctttactgtgtgtgtgtgtatgcatatgtgtattttttgtgtatacattttactctcaaaaaaatggtctcataccatacataatgatctactcataggctgcttgctttgttacttaatgacttatcctgaatattacctttccccttcagcgcctc

SEQ ID NO: 18321 - DNA, 72 bp, Homo sapiens
  misc_feature 2: r=a or g
  misc_feature 16: d=a or g or t
arttttggcgtttgadgcgagtttctgtctcagtcgggcgcacgccgccagggaaaagaaagggaggaagga

SEQ ID NO: 18322 - DNA, 249 bp, Homo sapiens
  misc_feature 22: n=a, g, c or t
  misc_feature 47: m=a or c
  misc_feature 149: m=a or c
  misc_feature 184: m=a or c
  misc_feature 197: m=a or c
ttctggttattaatcacttgtnaaatggatggttttccaatattttmttcctttctatgtgttgtcccttcaatgtcttgattgttcatttgcagaagaaactttttagcttgatataaacccagttctatatttttgctttggttgcmtgtgctttcgaagtcgtatacaaaaaaaaattgcmaagaccaatgtcmtggagcatttccccaatgttttcttctagcagtttcatgatgtcaggtctta

SEQ ID NO: 18323 - DNA, 113 bp, Homo sapiens
attcctagatatcttgtattgattctatcttatctccctaaactgtaaacattgggatatgccagggcttcattcttagccttttcttttctcttttctatccgtaccccctt

SEQ ID NO: 18324 - DNA, 107 bp, Homo sapiens
  misc_feature 18: n=a, g, c or t
  misc_feature 85: w=a or t
cgagttcaagcgattctnctgcctcagcctccccagtagctgggattgcaggcgtgcaccaccatgccagctaatttttgtattwttagtagagacggggtttcgcc

SEQ ID NO: 18325 - DNA, 166 bp, Homo sapiens
  misc_feature 20: m=a or c
  misc_feature 68: m=a or c
  misc_feature 75: r=a or g
  misc_feature 162: m=a or c
  misc_feature 163: m=a or c
tgggactacaggcgcccgcmacaacacccagctaattttttgtatttttagtagagacagggtttcamcgtgttrgccaggatagtctggatctcctgaccttgtgatccgcccgcctcggcctcccaaagtgctgggattacaggcatgaaccaccgcgcmmgat

SEQ ID NO: 18326 - DNA, 123 bp, Homo sapiens
  misc_feature 73: m=a or c
aaggctggagtgcaatggcacgatcttggctcattgcaccctctgtctcccgggttcaagcaattctccttgmctcagcctcccgagtagctgggactacagacgcatgccaccacacccggc

SEQ ID NO: 18327 - DNA, 122 bp, Homo sapiens
cagttctggattggcttctgttggttgatacttctcattgtcatgggtcatatcttcctgcttctttctttgcatgcatggtaatttttggttagattgagttttactgtattcagggcatt

SEQ ID NO: 18328 - DNA, 203 bp, Homo sapiens
  misc_feature 70: r=a or g
  misc_feature 71: w=a or t
  misc_feature 123: r=a or g
tgtctatgttccaggcaatgtgctgggtagtggaaacaaaaaggtaaatacaacagacacttcttcactrwgtccattaataaattggtaatggctgtaatcccagcactttgggaagccgargcaggcagatcacaaggtcgggagatcgagaccatcgtggccaacatggtgaaaccccgtgtctactaaaatacaaaaaa

SEQ ID NO: 18329 - DNA, 223 bp, Homo sapiens
  misc_feature 15: n=a, g, c or t
ttcagtatccatttncagctaagtttgtgtagcatgattaatgtttctgaggctcaattttagtaatggtaaagttatatcttcctaaaagacagggacacatcccagttttgtgttttttaatttttattttgttttatttttcttgagatggagttttgctcttgttgcccaggctggagtgcaatggtacaatcttggctcaccacaacctccgccccca

SEQ ID NO: 18330 - DNA, 195 bp, Homo sapiens
ttgcccttagtattttaggatgtgagaaaatattcatgttataagcttatactatctctcttttataaattatcattatgaatcctcatttgatctaataaagccattggtcatgacctataagatcactggaaatcagagtggtttggttcgtacgaattcatttgtatgtcaatcatcttctccccgcatcta

SEQ ID NO: 18331 - DNA, 110 bp, Homo sapiens
ataagttgatttggatttttaagcctccagcaatgtttcacttcacttgaccctgcagtgggggctggtgtcagcctttgattttatcttctgcagttctcccacccctc

SEQ ID NO: 18332 - DNA, 181 bp, Homo sapiens
  misc_feature 39: r=a or g
  misc_feature 67: r=a or g
  misc_feature 70: w=a or t
  misc_feature 164: w=a or t
taggctttggtaatcaatcgccgtggggatgaaatgttrtttaatttatagcctgttcatgtttgtrtawggcacttaccatgttatatggggagagagatacacaatctagcccataacagtgaagatataatgtgtttgttgggtgagaggtaacaaaaaawagacaaagggggctatc

SEQ ID NO: 18333 - DNA, 169 bp, Homo sapiens
  misc_feature 19: w=a or t
caggagtggggtgtttgawatcagaggtggaggaatgcagtcatgggtcaggagagggctgggtgtgagcatgggagtgtgtgggggagagggagaggccaggaggagagcgggtcgtgaaactcagatccatcttcatggatcttgaaatcaccaagaaaggacatat

SEQ ID NO: 18334 - DNA, 161 bp, Homo sapiens
  misc_feature 2: r=a or g
artgcacgatcttcttgatgttctgagagttgcggttttctgggaaattgtttcaaaatataaacttggcctctgatagtagccagttggagatgtttggtttgaatgcctgtagtaaagtgaggacacctaacgtctatatttcttttcttttctttttt

SEQ ID NO: 18335 - DNA, 177 bp, Homo sapiens
  misc_feature 14: b=c or g or t
  misc_feature 43: h=a or c or t
tacaggcgcctgcbaccacgcctggctaatttttgtattttthatagagacgaggtttcaccatattggccaggctggtcttgaactcctgacctcaggtgatccacccacctcagcctcccaaagtgctgagtgagattacaggtatgagccaccgtgcctggccttttttttttt

SEQ ID NO: 18336 - DNA, 58 bp, Homo sapiens
  misc_feature 17: w=a or t
cctcagtctcccaagtwgctcggattacacgtgtatgccaccacccctggctattttt

SEQ ID NO: 18337 - DNA, 179 bp, Homo sapiens
  misc_feature 25: k=g or t
gtgtgtgtgtgtgtgtgtgtgtgtktctaattttacttacatatgcattaattgaacaattttgcatgttctcacagtaattttatattacattgtcttcaggagaatcaagtcaaaatactagttggaatatgatctttgaaatagaggaaaactagcttaatatgtagggtggatca

SEQ ID NO: 18338 - DNA, 162 bp, Homo sapiens
  misc_feature 6: r=a or g
  misc_feature 130: s=g or c
acccaragaaccagcctctcaccccagggtccatgtcccaggccccactccagtgttgcccacactcccagctgctggaggagaggggagatgccaaggtgccctgcaggacctccctccgggccacacsctcagctgcctcttcaggaaccggagctcatt

SEQ ID NO: 18339 - DNA, 243 bp, Homo sapiens
cattgaatccatgcaaatcaagtcaagtgtaggcattgtgttaggtattacaagtactctagaggtgtgcataggtgatacgcagatactatgccactttatatcagggacttgaacatccctggcttttggtattcacaggaggttctggagccagttctccatgacagataccaagggagactatacagtgctactgagatgcctttcgaaacttcagaataccctccctccctgccctga

SEQ ID NO: 18340 - DNA, 168 bp, Homo sapiens
gtctatcaattttgttgatcctttcaaaaaaccagctcctggattcattaattttttgaagggttttttgcgtctctatttccttcagttctgctctgattttagttatttcttgccttgtgctagctttttgtattttttcactatttaacatttccctgtgttaac

SEQ ID NO: 18341 - DNA, 310 bp, Homo sapiens
  misc_feature 7: m=a or c
  misc_feature 30: m=a or c
  misc_feature 142: k=g or t
  misc_feature 158: r=a or g
  misc_feature 195: k=g or t
  misc_feature 209: m=a or c
  misc_feature 269: k=g or t
  misc_feature 278: n=a, g, c or t
  misc_feature 279: n=a, g, c or t
  misc_feature 280: r=a or g
  misc_feature 287: w=a or t
aatggamacctaggttgcttccatatctgmgctattgtgaataatgctgcaatgaacatgggagtggagacatctcctaagcatactgatttcagttcctttgggtatatacccagaagtgggatcatgtggtaatcttgtktttacttttttgaggracctccataccattatccatgatggctatagtaattkacattcataccagmagtgcacaagggtctccttttctgtatacacttgccaacacttgttatctttcatttttktgatgctannrattctawcaggtgggaggtggtatctcata

SEQ ID NO: 18342 - DNA, 217 bp, Homo sapiens
ttgcttttcttaggtaattacagctttttaccgacacatgtgattactcaatctaatcatgcaattccagttagcaacttgtaaatatgaggtttggtatatgtactgaacacctgtgatggtatatagcctttttgaacttcacattgtgaaaccatgactttatttattccttcttttcattttcttatatcgcctcacaaccacctccccacac

SEQ ID NO: 18343 - DNA, 63 bp, Homo sapiens
  misc_feature 3: r=a or g
  misc_feature 6: r=a or g
ttrctrggctgggaggatctcttgggcctgggaattcaaggctgcagtgagctatgatcatgc

SEQ ID NO: 18344 - DNA, 159 bp, Homo sapiens
gaatgtaatagaatgggatggaatggaatggaatggaattaacccgaatagaatggaatggaatggaatggaacggaaaggaacggaatggaatggaatggaatggaatggaatggaatggaatggaatcaacgcgagtgcaggggaatgtaatgaaac

SEQ ID NO: 18345 - DNA, 216 bp, Homo sapiens
  misc_feature 70: s=g or c
  misc_feature 81: m=a or c
tcttatttctccttcatttatgaagcttagtttggccagatatgaaattctgagttgaaaaatgcttttstttaagaagamaagaaggttcttttaagaaggttaaatatcatcccccaatcttttctggcttgtagggtttccactgaaaggtctgctgttagtctgatgggatttactttgtaggtgacctggtctttctctctggctgccctt

SEQ ID NO: 18346 - DNA, 111 bp, Homo sapiens
  misc_feature 10: v=a or c or g
  misc_feature 41: m=a or c
  misc_feature 53: r=a or g
  misc_feature 68: m=a or c
ggaggctgavgtgggaggatcatctgagcttgggaagctgmacttgcagtgarccatgatcatgccamtgcactgcagcctgggtgacaggagtgagtcgctgtctcaaaa

SEQ ID NO: 18347 - DNA, 205 bp, Homo sapiens
taacaaagaaaaagataatgttagagtgtctcaggccgggcacggtggctcacacctgtaatcccagaactgtgggaggccaaggcaggcagataacttgaggtcgggagttcgagaccagcctggccaacatggcaaaaccccatctctactaaaaatacaaaaattagctgggcatggtgacacgtgactgtaatcccagcta

SEQ ID NO: 18348 - DNA, 179 bp, Homo sapiens
ctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagaga

SEQ ID NO: 18349 - DNA, 150 bp, Homo sapiens
  misc_feature 36: n=a, g, c or t
tttatgagggagcagaactgcagtatatcatttttnccttggtaggtacataattttatcaccttaagtcatataataattgaattcccacatctcagactgagattttttttaccggcagaaggagctgtcaccagtcacaacagaagc

SEQ ID NO: 18350 - DNA, 193 bp, Homo sapiens
cgagcagtaccacctgaactccgcctcctgtgagatcagtggcagcattagattcttataggagcgtgaaccctattgtgaactgtgcatgcaatctagggatctaggttgccccctccttatgagaatctaatgcttgatgatctgaggtggtacgctttcatcctgaaaccattctcaccacatcccagcc

SEQ ID NO: 18351 - DNA, 275 bp, Homo sapiens
tgtccttccctagttttggtattagggtaatacagacttcatgacataatttagagagaaggccctctttctctatcttttggaatagtgttaataggattggtaccaattcttctttgaatgtctaatagagtttagctatgaatccgtcaggtcctggctagtctaaatccaattattttaaagcaaatcttagaaattagcatctcatctatttcagtatgtacctctaaaggagacaagttttaaatcacaaccacaataccacgataaca

SEQ ID NO: 18352 - DNA, 175 bp, Homo sapiens
  misc_feature 134: w=a or t
  misc_feature 159: s=g or c
gtagctgggagtacaggtgcacactaccacacccggctaatttttatatttttagtagagaatgggtttctccatgttggtcaggctggtctcaaactcctgacctcaggtgatccacccgcctcagcctcccwaagtgctgggattacaggcgtgagscaccactcccggccct

SEQ ID NO: 18353 - DNA, 245 bp, Homo sapiens
ctgtgtttccctaatggctaatgatgttgagcatcttttcatgtggttggtgaacatttgtatgtgtaatctttggagaaatgtccattcaaatgctctgcctgttttttaatgggttgtctttttattggtgttataaaagttgttcatgtattctagattcaagtgccttatcagctgtatgatttgcaaaaattttcttggattctgacatgtcctttcattttcttgatggtgccccttac

SEQ ID NO: 18354 - DNA, 167 bp, Homo sapiens
  misc_feature 81: k=g or t
  misc_feature 82: r=a or g
  misc_feature 148: b=c or g or t
ggatgtgagggcgatctggctgcgacatctgtcaccccattgatcgccagggttgattcggctgatctggctggctaggckrgtgtccccttcctccctcaccgctccatgtgcgtccctcccgaagctgcgcgctcggtcgaagagbacgaccatccccgatagat

SEQ ID NO: 18355 - DNA, 171 bp, Homo sapiens
acgttttgatactaggataatactaacctcatagaataagctaagaagggtttcttctttcttcttttccttcccacctgtccttcaggatcctaactctaaacttgtagtcttttcctgcatcacccattcctgaagagaacattttactttcttctgctgatgcattta

SEQ ID NO: 18356 - DNA, 266 bp, Homo sapiens
  misc_feature 116: d=a or g or t
  misc_feature 117: w=a or t
  misc_feature 119: w=a or t
  misc_feature 120: w=a or t
aacttctggaggtgatggaatgttcattattttgatcgtgatgaccgttctggtgtaaacacatgtcaaaaatcatcaaaatgtacacttttctttttgtttggttttttgttgtdwtwwtggttcttgttgttgttgttgttgttgttgttgttgtttttgagatgtagtctcactctgtcaccaggctggagtgcagtggcacgatctcggctcactgcaacctctgcctcctgggttcaagagattctcctgccccaccctcc

SEQ ID NO: 18357 - DNA, 87 bp, Homo sapiens
  misc_feature 7: h=a or c or t
attttghttatctccactctactctttattatttctgtcctgctagctttggatctagtgtgctctttttcttccagtttctttttt

SEQ ID NO: 18358 - DNA, 115 bp, Homo sapiens
aaattgtaagatgccagctccatgtcttacaattcaatttaattttgatagcaatcaaagttagtcagaccccacaggttaagcactcagtcttgcaagattcctcctctccccc

SEQ ID NO: 18359 - DNA, 314 bp, Homo sapiens
  misc_feature 7: m=a or c
  misc_feature 8: h=a or c or t
  misc_feature 9: y=c or t
  misc_feature 113: r=a or g
atgagcmhyctcacagcacaattgcaactggagtgctgagaaaaggttagtatttctttgcaggctgggtgtggtggctcacgcctggaatcccagcactttgggagaccgargtaggtggaatcccttgaggccaggagttcgagaccagcctggccaacgtggggaaaccccatctctagaaaaaatataaaaattatctggtgtggtggcgtacgcctataatcctagctactaggtaggtggaggttgcagtgagctgagatcacgacactgcactccaacctgggtgacaaagtgagactgtctcataa

SEQ ID NO: 18360 - DNA, 121 bp, Homo sapiens
  misc_feature 7: b=c or g or t
gtccaabatcaaccttccagtagattctgtgtctagtgaggacccactttttgatagatgtccatcttcttctctctctatcctcacatggtagatagagtgaggcagctctctggattct

SEQ ID NO: 18361 - DNA, 91 bp, Homo sapiens
ccagcctggccaacatactgaaaccctgtctctactaaaaatacaaaaaatagctgatgtgggggcacacacctgtaattccagctaccca

SEQ ID NO: 18362 - DNA, 191 bp, Homo sapiens
ctcagcctccccagtagctgggaatacaggtgcccgccaccatgcccggctaattttttgtattttttttagtagagacagggtttcaccgtgttagccaggatggtctcgatctcctgacctcatgatccgcccgcctcggcctcccaaagtgctgagattacaggcgtgagccaacgtgcccggcctca

SEQ ID NO: 18363 - DNA, 60 bp, Homo sapiens
ctttgggggggtgctgggcatggtggctcacacctgtaatcccagcactttaggaggccc

SEQ ID NO: 18364 - DNA, 265 bp, Homo sapiens
tcgtgggaattatggttggtttgggtgtcttctgaacttttggtactaaacatttgccatctgtaaacacttactggacttacaatgattggagaagacacaggcatgtttgtagcaaagggaatataggacagctccaagatccggggcggcttatagtctttgcggaggaggtgagtgaatgctcagactcagtagatggcaattatagacatattttcagtttatagacagaagacagaaggaagcacaaaaagggacagca

SEQ ID NO: 18365 - DNA, 166 bp, Homo sapiens
gccaggcatggtggctcacacctgtaatcccagcactttaggaggctgaggtgggtggatcgtctgaggtcaggagttcgagaacagcctggccaacgtggtacaaccccgtctctactaaaaatacaaaaaaaattagcggggcctggtggcacacgcctgtagt

SEQ ID NO: 18366 - DNA, 175 bp, Homo sapiens
actttggtgaatctgacaatcatgtgtcttggagttgctcttgttgaggagtatctttgtggcgttctctgtatttcctgaatctgaatgttggcctgccttgctagattggggaagttctcctggataatatcctgcagagtgttttccagcttgtttccattctccccatcgc

SEQ ID NO: 18367 - DNA, 145 bp, Homo sapiens
agcactcaaattggccgggcacggtggctcacgcctgtaatcccaacactctgggaggctgaggtgggtgaatcatgaggtcaggagttcgagaccagcctggccaacatggtgaaaccctgtctctactaaaaatacaaaaaat

SEQ ID NO: 18368 - DNA, 98 bp, Homo sapiens
ctaaggttgtatctttcctaagtagatctcttcagcctctgcagctttgtgtgcagcgactgatctggtgaatgggtaattttttttttttttttttt

SEQ ID NO: 18369 - DNA, 164 bp, Homo sapiens
gcctggctccttctaacttttgctctattctcttaaattgcttcatgagacaggatctcacaacagctctcatctgacctccagagacgtgttgatttagcaggttacattctcttttctttgtcttttttttttggaagcaatccaatggatgcaagggccgc

SEQ ID NO: 18370 - DNA, 129 bp, Homo sapiens
tcacctaggctggagtgcagtggtgcagtctcggctcactgcaacctctgcctcccgggttcaagtgattctcctgcctcagcctcctgagtaactgagactacaggcgtgcgccaccacacccggcca

SEQ ID NO: 18371 - DNA, 54 bp, Homo sapiens
  misc_feature 7: s=g or c
gttttasgttgttgtttctgtgagacctctcgtgtctttttttttttttttttt

SEQ ID NO: 18372 - DNA, 87 bp, Homo sapiens
taaggaagaagtctctgggaactatagcctagtgacactgacagcactgatagcatagtgttctagaatatttaaacataaggctga

SEQ ID NO: 18373 - DNA, 65 bp, Homo sapiens
ctcctacctgaacctctcaagtagagctgggactacagtgcactccaccatgcccaggtaatttt

SEQ ID NO: 18374 - DNA, 193 bp, Homo sapiens
actacaagaggtaggtgtttaagaaaactataaaggagttttttttgaaaacaatagatctaaacacaggagattttgcttggttcatgtcatcatgaaggatttttccatcatggttgtcctaagttttctctttccattaatgctataattaaacaatgaatatttttgaaaaatttattatgggagagtg

SEQ ID NO: 18375 - DNA, 257 bp, Homo sapiens
  misc_feature 100: v=a or c or g
agttgccatattctttttatagctgcataatatttattgtgtgaatgtaccatatttaagcagtactctatgaatatccttatacacacatcagtttgcvtttgtatgaggacatctgtatacttatttatttttaaaaatttaattttttaagagcagttttaggttcacagcacaattgagaggaaagtacagagatttctcatatgcccctgtccctgcacaagcacagcctcccccattatcaacacctcccc

SEQ ID NO: 18376 - DNA, 86 bp, Homo sapiens
ctgagaaggatggtttccagcttcatccttgtccctgcaaaagacatgaactcatccttttttatgactgcatagtattccatggt

SEQ ID NO: 18377 - DNA, 196 bp, Homo sapiens
gtttttaccgagagatgaaatgaaattgaattagcataataataagccttcagggccgggtgtggtggcttacgcctgtagtcccagcaccttgagaggtcgaggcaggtggatcacctgaggtcaggagttcgggaccagcctggtcagcatggtgaaaccctgtctctactaaagatggaaaagtcggccgggt

SEQ ID NO: 18378 - DNA, 63 bp, Homo sapiens
cagcctcccgagtaactggaactacaggtgcctgccaccacgtccagctactcggaaggctat

SEQ ID NO: 18379 - DNA, 254 bp, Homo sapiens
taagaaatgataccttattgttttcattttccctcttttttgttaaatgccagtttatgtctggagaagacttttctaaggcaaatccatgtaaagaaggggtcaggttaaaaattgacggaaatggcagcggttccttcatgagtttaggaatacacacgacagattgcttgccgtattccaggcaggaccctctccttgcccccaaaacttagacatcagtgttgagcttagaccaatagaccagggctgag

SEQ ID NO: 18380 - DNA, 163 bp, Homo sapiens
tcccaggttcaagtgattctcctgcctcagcctcctgagaagctgggactacagacacacgccaccacacccagctaattttttgtattttagtagagatggggtttcaccatgttggccaggatggtctctgtctcctgaccttgtgatacacctgccccta

SEQ ID NO: 18381 - DNA, 77 bp, Homo sapiens
  misc_feature 25: r=a or g
  misc_feature 40: w=a or t
  misc_feature 42: m=a or c
  misc_feature 46: m=a or c
tggtaaccttttatttattttctartataatgggggagtwtmgtamtgaggtgtaaagggatttatatggggacgta

SEQ ID NO: 18382 - DNA, 127 bp, Homo sapiens
  misc_feature 36: m=a or c
  misc_feature 107: w=a or t
  misc_feature 110: w=a or t
tgcaaagttgaaaataggaactccactagtaatgcmggatagaagagtgcttcacatttgtagagggagacaagaactaaatatcacaacttctttctgagcctttwggwttgctaacgtgccccaa

SEQ ID NO: 18383 - DNA, 132 bp, Homo sapiens
  misc_feature 55: r=a or g
  misc_feature 61: w=a or t
  misc_feature 107: k=g or t
  misc_feature 112: w=a or t
  misc_feature 117: w=a or t
  misc_feature 118: d=a or g or t
atgtgattatctagttcagcattttgaatgtgtagtttaaggtctgatttagtaraatttwaaagctaaataatctgatgactcttgaaagtttaattggtagtatkacatwtatgwdtttttcccccagac

SEQ ID NO: 18384 - DNA, 226 bp, Homo sapiens
  misc_feature 16: m=a or c
  misc_feature 115: w=a or t
  misc_feature 120: w=a or t
acattgttgagttcamttatgtccttactgattttctgcctgctggatctgtcaatttctgatagagaggtgttgatgtctccaactataatagtggactagtttatttctcttwgctgwtctattagtttttgccgcagatattttgatgttctgttgttaatcacatacacattaagaattgttatggcattttggaaagttgatctctttatcagtatgtgat

SEQ ID NO: 18385 - DNA, 135 bp, Homo sapiens
  misc_feature 27: v=a or c or g
  misc_feature 59: n=a, g, c or t
gtatttttagtagaaatggggtttctvcatgttgcccaggctggtctcgaatgcctgtnctcaagtgatatgtacccctcagcctcccaaagtgctgggattacaggcatgagccaccatgcctggcctaatttt

SEQ ID NO: 18386 - DNA, 334 bp, Homo sapiens
  misc_feature 30: m=a or c
  misc_feature 31: m=a or c
  misc_feature 139: s=g or c
  misc_feature 179: k=g or t
  misc_feature 184: r=a or g
  misc_feature 192: r=a or g
  misc_feature 211: k=g or t
  misc_feature 259: r=a or g
  misc_feature 320: s=g or c
ctctcctgccgagagtggagcacacgtgtmmtgggagctgcatcttgtgtagggtccagctgcttttggggactgcaggaatcatctcccctgggccctggactcggactggggcctccccacctccctctcggctgtscttacggagccccaatccaggcctcctgtggctgttgggktccaratgctgcrgctccatgtgacttccaakcaggccctccgccctccctgctgaatggaggagccgggggtcccccargccaactggaaaatctcccaggctaggccaattgccttttgcacttccccgttcctgtcasatttccccaagccc

SEQ ID NO: 18387 - DNA, 59 bp, Homo sapiens
  misc_feature 23: s=g or c
agtgctgggattacaggcgtgascaccgcgcctggcctccctggctttttttttttttt

SEQ ID NO: 18388 - DNA, 342 bp, Homo sapiens
  misc_feature 76: r=a or g
  misc_feature 101: r=a or g
  misc_feature 105: h=a or c or t
  misc_feature 128: k=g or t
  misc_feature 168: d=a or g or t
  misc_feature 171: d=a or g or t
  misc_feature 172: w=a or t
  misc_feature 182: r=a or g
  misc_feature 186: r=a or g
  misc_feature 216: k=g or t
  misc_feature 317: r=a or g
  misc_feature 318: m=a or c
aagtgactctgtcctttcttagtcggagtcatgggtatttgctctgggaacaacatatttgttctgtttcagtaaragaagtaatgacatatattattgartgahaaaagttctaatttcaacatagktcaaccaccatatagctgttttctattgtaataatttgtdtgdwtttagagaarcaaraaagctactgtcgaacaaatgtacaatttktttaattattattatttttgaacagagtctcgcactgtctcccaggctggagggcagtggcgcgatctcggctcactgcaacctccacctcccagttctarmaattctcctgcctcagcctccctc

SEQ ID NO: 18389 - DNA, 97 bp, Homo sapiens
tgagcctgggaagcggaggctgcagtgggtcaagatcatgccactgcactccagcctgggtgacagggcaagatcctatctgattaaaaaaaaaaat

SEQ ID NO: 18390 - DNA, 185 bp, Homo sapiens
tacctggtgcttctgtctcacagctcttaagattctttccttcatcttaactttggataacctgatgacaatgtgcctacgtgaagatctttttgcaatgaattttccaggtgttctttgtgcttcttgtatttgatgtctaggtctctagcaaggctggggaagttttccttgattacccccct

SEQ ID NO: 18391 - DNA, 397 bp, Homo sapiens
caatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtcta

SEQ ID NO: 18392 - DNA, 272 bp, Homo sapiens
tttttacctattatctaagagcctgatttacaaaagtaaatgtactttgggggatcaggtggcatcattttcttaactttaaaaatataggtcgggcgtagtggctcacgcctgtaatcccagcactttgggaggccgaggtgggcggatcacctgaggtcaggatttcgagaccagcatggccaacgtggcgaggccttgtctctactaaaagtacaagaattggccgggtgtggtggtgcgtgcctgtggtcccagctactcaggaggcc

SEQ ID NO: 18393 - DNA, 436 bp, Homo sapiens
  misc_feature 7: s=g or c
  misc_feature 8: y=c or t
  misc_feature 425: r=a or g
cattacsyacaactgatacaggtatgctagcattaataagctgcatgattaccttttccatttcgtctttctgggcacaaacatagtcatatggtcatgtgactgtgttttaactaatggaatgtgggcggaagtgacatgtgccatctccaggcatggcgataaaatggcccttgtgtcctgtcgcacactctttctttgttcatcaataaactgaatgcagaggacctaagggaggactccaagatggaagaagcctgtatctgtttccatggtagtcgctgaaaacacccaaccagactgtgcctttgggggcaagtaaacctttatcatagcagtaagccactcaaagttgggagttctttgttccatcagctagcattacccccaacgtcttcaggtctgaagagctcctgctatattgraagctatcata

SEQ ID NO: 18394 - DNA, 80 bp, Homo sapiens
  misc_feature 25: n=a, g, c or t
ctttggcactgtctcaccgtctttnctttttcctcggctgtcagcgttttcctgttgcccattggttttgttttcttttt

SEQ ID NO: 18395 - DNA, 197 bp, Homo sapiens
ttcacgccattctccttttcagccttaacgagtagctgggactacaggcgcccgctaccacgcccggctaattgttttgtactttcagtagagacggggtttcaccgtgttagccaggatggtctggatctcctgacctcgtgatccgcctgtctaggcctcccaaagtgctgggattaccactgcgcccggccttc

SEQ ID NO: 18396 - DNA, 56 bp, Homo sapiens
cactccagcctgggcgacagagcgaaactcagtctcaaaaaaaaaaaaaaaaaaaa

SEQ ID NO: 18397 - DNA, 163 bp, Homo sapiens
acttgggggcaaatatcttgtatcctatcttgcaagggttctctgatttcttgaatttgaaagtcaatctctctcacaaggttgcagaaatttttgtggacgatgttctcaagcatgttttctaggttgctctctctccctccctcccttcctccctcccaaa

SEQ ID NO: 18398 - DNA, 150 bp, Homo sapiens
ctccgccggaacccaggctcggaagggtgagggttctgtctttctgagtcgtgggaaggagtttgggaactggggctcccaggtcctagagaggaaggaactgagggtccagattcctggggcctgaaaaagagactgtatggatggagc

SEQ ID NO: 18399 - DNA, 134 bp, Homo sapiens
  misc_feature 15: h=a or c or t
gttcaagcgattcthctgcctcagcctcctgattagctgggattacaggcatgggccaccgtgcctggctgatgtttgtacttttagtagagacggtgtttttccatgttggtcaggctggtctcccactcccc

SEQ ID NO: 18400 - DNA, 181 bp, Homo sapiens
  misc_feature 150: r=a or g
taagatgctaaaatctataggttttggaagtgaaagattctattttttctttttttgtacataatgggaatttcattccagattatattttatttacatattaatttcacagaatattaatatttcttaacttcttaaagtatgctagcrttttatgtatatgtacacatatattcagaca

SEQ ID NO: 18401 - DNA, 279 bp, Homo sapiens
  misc_feature 15: n=a, g, c or t
  misc_feature 40: b=c or g or t
  misc_feature 41: m=a or c
  misc_feature 103: m=a or c
  misc_feature 278: n=a, g, c or t
  misc_feature 279: n=a, g, c or t
tcttgatctgttganctcgtgatctacccgccttggcctbmcaaagtgctgagattacaggcgtgagcatcacatgcagctactctttaaaacaagggaagamggaccttgagggtgattcagagatcatcatggctgccactcccaccgcagactcagagtgcaagggcctggggagcagaactccctccaccttgatttcaaagactagaaccaatgcccagtggacttcaggggctaaggccatgtagcagaggctgggagcataacccccacgnn

SEQ ID NO: 18402 - DNA, 311 bp, Homo sapiens
  misc_feature 68: r=a or g
  misc_feature 69: w=a or t
  misc_feature 86: n=a, g, c or t
  misc_feature 139: n=a, g, c or t
  misc_feature 225: w=a or t
  misc_feature 226: n=a, g, c or t
atatatattatcaaactttctaatctttgtcaatttaacaagtaaaattataatgtttttgatttgcrwttcttttactataaganatcttgaatatttctatgttgtttattggcctttttttattatatagcttgcntttttttattttttatttatttatttttttagacagagtctcgatctgttgccaggctggagtgcagtggcggtgatctcagctcwntgcaacctctgcctcccaggttcaagcgattcttctgtctcagcctcccgagtagctgggactacaggaccccaccaccacaccc

SEQ ID NO: 18403 - DNA, 265 bp, Homo sapiens
  misc_feature 2: n=a, g, c or t
tncaacccacacacaatttccgctattattaacatcttgcattatagtagttcatttgttaacggatgaatcaacactgatgcattattattaactaaggtccatagtttaattagggtttattctgtgttgtacgacgggttttgacaaatgtgcaaggtcatgtatctactattacagtattatacagaatagttttatgatctgaaaatcccttgtgccgctccctcccccaccacccatcaatctctgacccctactgaca

SEQ ID NO: 18404 - DNA, 114 bp, Homo sapiens
gtagctgggattacaggcacatgccactgtgtctggctaatttttgtattttcagtagagatggggttttacaatattggccagacacagtggcatgtgcctgtaatcccagct

SEQ ID NO: 18405 - DNA, 202 bp, Homo sapiens
  misc_feature 138: k=g or t
aagtagctgggattataggtgcccgccaccacgcccagctagtttttttgtatttttagtagagatgaggtttcaccatgttggccaggctggtctggaactcctgacctcaggtgatccacccgcctcggcctccckaagtgctgggattataggcgtgagccactgtgcccgaccacagctgttttcttctaccctacca

SEQ ID NO: 18406 - DNA, 192 bp, Homo sapiens
gtgctgggattacaggcattggccactgcgcccagccccaactcttaatttttaaaggcttctaatcattttataataatatctatatactaatcaattattacataataactagaaaaatatttaccaggtcctcgatattgccatagatattcttcttcatgcctgatgcgcgagtagatacccatccaa

SEQ ID NO: 18407 - DNA, 135 bp, Homo sapiens
  misc_feature 101: r=a or g
  misc_feature 102: s=g or c
gacatggtgcctcacgcttgtaatcttagcactttgggaggccaaggtgggcggatcacatgaggccagtagtttgagactagcctggccaacatggcgarsccatctctactaaaaaaaaaaaaaaaaaaaaaa

SEQ ID NO: 18408 - DNA, 363 bp, Homo sapiens
  misc_feature 7: b=c or g or t
  misc_feature 8: n=a, g, c or t
  misc_feature 9: y=c or t
  misc_feature 102: r=a or g
  misc_feature 291: k=g or t
  misc_feature 292: w=a or t
  misc_feature 293: n=a, g, c or t
  misc_feature 307: n=a, g, c or t
  misc_feature 308: d=a or g or t
  misc_feature 315: k=g or t
  misc_feature 329: w=a or t
  misc_feature 330: s=g or c
  misc_feature 331: m=a or c
  misc_feature 333: w=a or t
  misc_feature 339: w=a or t
  misc_feature 340: m=a or c
tcaaaabnycacattgtgaataattctgatttgaaatgtgatggggacctgaaatctagaaaatttaagaataatgtgggaaacttgacatgtatgcatgargatatctatatcttcacctatggagattttgatttagtaggtctaggtggaaatctgagaatctgcatttttaaaagattagcagatgtttctgttattaaccaggcttgacaaccactgaagtattgtctgtcatctgtcatcttcctccttctctccctccatcccttcttcccccttccctccctkwnttcccttcccctgndaatcctkcccttccttccctwsmcwtccttwmccttccttcccttcccttccttc

SEQ ID NO: 18409 - DNA, 103 bp, Homo sapiens
gctcatgcctgtaatctcagcattttgggaggtcgaggtgggtggatcacgaggtcaagagtttgagaccagcctggccaatatggtgaaaccccgcctcact

SEQ ID NO: 18410 - DNA, 201 bp, Homo sapiens
aaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcacttttttttttttttttttttt

SEQ ID NO: 18411 - DNA, 130 bp, Homo sapiens
  misc_feature 44: r=a or g
ccgaatgtaatggaaaggaatggaacggaatggaatggaatggraaggaatggaatggagtgtaagggaattgaatagaatcaatccgaatgtaatggaatggaatggaatggagtggaatggaatgcaa

SEQ ID NO: 18412 - DNA, 175 bp, Homo sapiens
  misc_feature 83: s=g or c
gttggccgggctggtctcgaactcctgacctcaggtgatccgcctgcctctgcctcccagggtgctgagattacaggcgtgascactggcaccacttttttacactactaattacttttctaacagtgtaaaaccttgctcccttgtcttcaatatatttacttttttttttttt

SEQ ID NO: 18413 - DNA, 372 bp, Homo sapiens
ttcttgcaattgcttttgaggacttagccataaattaattgacaaatatgatgtccagaagagtacttcctatgttttcttccaggatttttatagtcagaagatgtactcttatgtaagaaaagcacaaatatttttatttttttatttttatttttttgagatggagtctccatcacccaggctatagtgcagtggtatgttcttggcttactgcaacctctgtctcctgggttcaagtgattctcctgcctcagcctcctgagtatctgagattacacatgcctgccaacacgccttgctaatttttgtatttttactagagacaggtttcatcatgttggccaggctggtctcaaactcctgacctca

SEQ ID NO: 18414 - DNA, 137 bp, Homo sapiens
tcccagctactcaggaggctgaggcaggagaatcgcttgaacccaggaggcagaggttgcagtgagccgagatcctgccactgcactccagcctgggtagcagagcaagactctgtctctaaagaaaaaaaaaaaaa

SEQ ID NO: 18415 - DNA, 67 bp, Homo sapiens
ctcaaactattaaaccgtattcttttccatgtgttctttttgttctttttttttttttttttttttt

SEQ ID NO: 18416 - DNA, 152 bp, Homo sapiens
acaggtgcaatctcggctcactgcaacctctgcctcccgggttcaagccattctcctgccccagcctcccaagtagctgggattacaggcgtccgccaccaaacacagctaagttttgcatttttagtagagacggggtttcaccatgttgg

SEQ ID NO: 18417 - DNA, 191 bp, Homo sapiens
catgtcatgttatgatggaccatttgtggatcaaccacagaagaattcctgttaaatatatcaaactcattgaagtgaggggaagtatcggaaattgaagtcattttgaattgcattttcttgagttcatctttctgccaccaggggtcagtcctgcatcaagaccttctccaggaacgcccaccagcccc

SEQ ID NO: 18418 - DNA, 235 bp, Homo sapiens
cattcattgatctcatgccactatttctgaaaggaccatcagatgagaggggtcgtattgtatctggtgatggtgtgtgagcctgcattttcttcacttctgtggtagaatctctaaaacaggaatgagactaagattcccccctgcccccagcacttagggagggtgaggtgggcggttcatgaggtcaggagatcaagaccatcctggctaacacggtgaaaccccatctcta

SEQ ID NO: 18419 - DNA, 216 bp, Homo sapiens
gacagagtcttgctatctcccaggccggagggcagtggctcactgcaactaccgcctctggggttcaagtgattctcatgtctcagccacccaagtagctgggactacaagcacgtgctaccacgcccagctaatttttgtatttttagtagagttgagtttttgccatgtaggccaggagttcaagtctagcctggccaacatggcaaaaactca

SEQ ID NO: 18420 - DNA, 273 bp, Homo sapiens
tttgcccgttagtcgatgcagtttctccctagtcttgatggtgtttacattttggcatgattttgcagtggctggtaccggttgttcctttccatgtttagtgcttccttcaggagctcttgtagggcaggcctggtggtgacaaaatctctcagcatttgcttgtctgtaaagtattttatttctccttcgcttatgaagcttagtttggctggatatgaaattctgggttgaaaattcttttctttaagaatgttgaaaattggcccccac

SEQ ID NO: 18421 - DNA, 359 bp, Homo sapiens
aatggacacctaggttgcttccatatctgagctattgtgaataatgctgcaatgaacatgggagtggagacatctcctaagcatactgatttcagttcctttgggtatatacccagaagtgggatcatgtggtaatcttgtttttacttttttgaggaacctccataccattatccatgatggctatagtaatttacattcataccagcagtgcacaagggtctccttttctgtatacacttgccaacacttgttatctttcatttttttgatgctagccattctaacaggtgggaggtggtatctcatagtggttttagtttgcatttccttggtgattattgatgatgatgagcacg

SEQ ID NO: 18422 - DNA, 234 bp, Homo sapiens
  misc_feature 234: r=a or g
ccagtgtgtattttatattgacagcatagttcagtttgaagcagccacatttcaagtgctcagtagccacatgtggctagtgactccatactggactgtgtaggtttagagtttcagtaaatttgtatgcaatagaatctacataaattggcatattatgcagatttctttgtatgcacatcagttcttgcatagcataagtcaggtcatgatgcttttagtctatgaggcgar

SEQ ID NO: 18423 - DNA, 328 bp, Homo sapiens
  misc_feature 327: d=a or g or t
  misc_feature 328: r=a or g
cagcttattctttggaattctatttgggcagtttaagtgaggatagtactatacatcctgtcttttcttatatcaataataataataactcctgtgacttattacatttaactctcataatcaaccctttgtattcaatactgttttgggcaccattttacagatgaggagactgcggcttgaagaggttaagaaacttgctctttagatggtattccagtgtaggcagcctgactccagagctggatgatcttctaacccccccataacagtgctttcaagtcatctggaagaacttattatgcaaattaaaataccctgggcgadr

SEQ ID NO: 18424 - DNA, 106 bp, Homo sapiens
  misc_feature 73: s=g or c
ggatagtctcgattccctgaccttttgatccactcgccttggcctcccaaagtgttgggattacaggcgtgascaccgtgcctggctgcggttttttttttttttt

SEQ ID NO: 18425 - DNA, 142 bp, Homo sapiens
  misc_feature 94: r=a or g
  misc_feature 100: r=a or g
  misc_feature 101: w=a or t
  misc_feature 117: w=a or t
  misc_feature 124: w=a or t
aagatcagattgtaggcatgttttgaatagaaaagttttagagattttgattttgttttgctgttattggggtgtgttatagtgtgtgtctgtrtgtgtrwtttacttttttttttwattttgwatttttcctaccccccca

SEQ ID NO: 18426 - DNA, 137 bp, Homo sapiens
cgactagccactgtggaagagaggaagaaaatagttgcatcgtcacatgatcacggatacacgactctagccaccagtgtgaccctgttaaaagcctcttctcctgcagcctgagatggatggacagacagacacct

SEQ ID NO: 18427 - DNA, 123 bp, Homo sapiens
  misc_feature 7: m=a or c
  misc_feature 8: w=a or t
  misc_feature 52: w=a or t
  misc_feature 117: r=a or g
taaagcmwcatgcattcacacctttgcagcatggtttatgcctcagtgttawgtgcactggaatgttttccacttcacatttccaagtagaaatattagtgttacggaagtgcctartatccc

SEQ ID NO: 18428 - DNA, 253 bp, Homo sapiens
  misc_feature 98: m=a or c
  misc_feature 105: m=a or c
  misc_feature 111: m=a or c
  misc_feature 114: s=g or c
  misc_feature 115: w=a or t
acttgaatctgttcacattatatgtattgaaacatcactatgtaccccatgaatatgtgcaattattatttgtcaattaaaaaataaaattaattggmtgggcamagtggmtcswggcatgtaatcccaacatgtagggagactgaggcaggcagatgatgaggtcagcagttcgagaccagcctgaccaacctagcaaaactccatctctactaaaaatgtaggaattagctgggcatggtagcgggcacct

SEQ ID NO: 18429 - DNA, 312 bp, Homo sapiens
  misc_feature 2: n=a, g, c or t
  misc_feature 51: w=a or t
  misc_feature 52: r=a or g
  misc_feature 111: m=a or c
  misc_feature 113: r=a or g
  misc_feature 114: r=a or g
  misc_feature 116: w=a or t
  misc_feature 127: r=a or g
  misc_feature 128: r=a or g
  misc_feature 129: r=a or g
  misc_feature 301: m=a or c
anaggtgccaatcagacgggtttgactgcatggaagaaagcagagctggcwragcacggtggctcaagcctgtaatcccagcactttgggaggccgaggcaggtggatcamgrrgwcaggagttcarrrccatcctgaccaacatgatgaaaccccgtctctactaaaaatacaaaaattggccgggtgtggtgttgtgcagcctgtaatcccagctgctcggggggctgaggcaggaaaattgcttgaacttgcgaggcggaggttgcagtgagcaagatcgtgccactgcactccagcmtgggtgacgga

SEQ ID NO: 18430 - DNA, 255 bp, Homo sapiens
  misc_feature 121: r=a or g
  misc_feature 127: r=a or g
  misc_feature 134: r=a or g
  misc_feature 229: m=a or c
gtaatcgcagctattcgggaggctgatgcagaatcgcttgaactcaggaggcagaggctgcagtaagccaagatcgcgtcactgcactccagcctggacgagagcaaaactccgtcttcaraaaatrgaaataraaatagaccaggagaggtggctcacgcctgtaatcccagcactctgggagaccaaggcgggtggatcacctgaggtcaggagttcgagaccagcmtggccaacatagagaaaccccagcca

SEQ ID NO: 18431 - DNA, 139 bp, Homo sapiens
  misc_feature 128: r=a or g
cacccagctaattttttgtatttttaatagagatggggttttactgtgttagccaggatggtctcgatctcctgacctcatgatccgcctgcctcggtcccccaaagtgctgggattataggcatgarccaccgcgcct

SEQ ID NO: 18432 - DNA, 151 bp, Homo sapiens
tttattatactttaagttttagggtacatgtgaacaacgtgcaggttagttacatatgtatacatgtgccatgttggtatgctgcacctattaactcgtcatttaacattaggtatatctcctaatgctatccctcctccctcccccccct

SEQ ID NO: 18433 - DNA, 182 bp, Homo sapiens
atctttttggttttatctacctttgttctttgatgatggtgatgtgcagatggggtctggagtggacctccagcaaactccaacaaacctgcacctgaggctcctgactgctagaaggaaaactaacaaacaggaaggacatacacaccaaaaccccatctgcacatcaccatcatcaaaga

SEQ ID NO: 18434 - DNA, 97 bp, Homo sapiens
  misc_feature 7: s=g or c
atgagastcaactggacactggtgcgggaggcagacacagctaagggttatgtgttccagctcttccaaccagacagacacattccttttttttttt

SEQ ID NO: 18435 - DNA, 240 bp, Homo sapiens
  misc_feature 12: y=c or t
  misc_feature 124: m=a or c
  misc_feature 125: w=a or t
  misc_feature 127: w=a or t
  misc_feature 199: m=a or c
  misc_feature 237: m=a or c
tcaaaccattayataatcattatatactgataatgtagttatatgccaccaatgacccataaacatgaaaaatgaccagcagccatttccatcaactcaccgaaatataggggtgtggccaggmwtwggtttgctccaggtaaagggtgaaggaactgaaagaaactgatcaccacatgaatctttctttaaaggatamtgagatccaaggccatcatctattgaagtctcccgggmtca

SEQ ID NO: 18436 - DNA, 87 bp, Homo sapiens
  misc_feature 31: r=a or g
ataaatagtgctgcaataaacatgagtgcaratatctttagtatataatgatgtctttccctttgggtatgtatgcagtagggggat

SEQ ID NO: 18437 - DNA, 192 bp, Homo sapiens
atgttttcacctaccctcttaactcaaactctcccttatctatattcccataacacattatattgaatgcatttctgttctgaaatccatcaaatgagatatattgtactatgattatttgtttacacatctgtgtctctgtccttccttctatcaatagtcaatgacctacctcttttttttttttttttt

SEQ ID NO: 18438 - DNA, 195 bp, Homo sapiens
taccaagtatgttcatatacctgagattctagaggatcctctctaggtagataggatttgtttcaaaggttcaggtactttggtttttgaaacagagtcttgctctgtcacccaggctggagtgcagtggggcgatcatggctcactgcagccttgacttcccaggcttaaacaatcctcctcctacatccccat

SEQ ID NO: 18439 - DNA, 98 bp, Homo sapiens
cggaatagaatggaatggaacgaattgtaatggaatggaattgaatggaatggaatggaatggaatggagtggaatcaacgcgagtgcaggggaattt

SEQ ID NO: 18440 - DNA, 118 bp, Homo sapiens
  misc_feature 44: s=g or c
ccagggtttttatagttttaggttttacatttaagtctttaatstatctcgagttaattgttgtatataatgtaagacaaaggtccagcttcaatcttctgcatattgctagccggtc

SEQ ID NO: 18441 - DNA, 214 bp, Homo sapiens
  misc_feature 7: y=c or t
cagtttyagtttgtttttcacaaggctctaattaactgaggcagagatggacaggaatggaaaggaaagctttagcctctctttcctagctgaaagatcaatggggagggagtgtgtctcagaaaataagtggggttgtgtttggagcactgggaagggaggaaatgcatgaaagatgaaaccatttattgggaaagaaacaggaaatggggcc

SEQ ID NO: 18442 - DNA, 161 bp, Homo sapiens
  misc_feature 7: m=a or c
  misc_feature 24: s=g or c
cacacamactttgccgctttaaasattttttaagtgcacgacttaatggcattaagtacattcacaatgttgtacaaccacttcacaagccagttccataactttttcatccaatatgaaaactctacccattaaacaactttccattcctccctcgcgcc

SEQ ID NO: 18443 - DNA, 248 bp, Homo sapiens
  misc_feature 7: m=a or c
aaaggamaaggggaaagaaagaggggcagaggagggaaggcgactgcagtccgaaaggagcttttggaagctaggaccctaagcgtcaggacgtggcattggtcgagagaaagcctgggctggcaagagctgccgccggtgctgggagagcatttatttgggagaaaaagaggggagagagcagagggagggggaggaagagagttcaaaccgaagtggatggaaggggactggggtttctgccgcgc

SEQ ID NO: 18444 - DNA, 339 bp, Homo sapiens
  misc_feature 7: w=a or t
  misc_feature 170: h=a or c or t
  misc_feature 232: n=a, g, c or t
cagttcwgctctgttcttggttatttgtcttctgatagctttggggtttgctcttgattctctagttcttttagttgtgatggtagggtgtcaatttgagatctgtctagctttttgatgtgggcatttagtgctgtaattttctgtcttaacactgctttatctattthccagagattctggtatgttgtctctttgtgcacaaaaccacacaactacatgaaaactgaanaatctacccctgaatgactcctgggtaaataataaaattaaggcagaaatcaagcagttttttgaaacaaatgtgcacaaagagacaacataccagaatctctggga

SEQ ID NO: 18445 - DNA, 146 bp, Homo sapiens
  misc_feature 7: y=c or t
  misc_feature 8: y=c or t
tatcacyyctaagagatttctggtgaaacttgtggattttctatacatgacaccatgttttctgcaaatggacaatttgactcctcttttcctatctggatgctttttatttctctctcttgcctgatttatttggctaggatttt

SEQ ID NO: 18446 - DNA, 261 bp, Homo sapiens
  misc_feature 260: m=a or c
  misc_feature 261: n=a, g, c or t
cttaattttttgtatttttttgtagagttttttttttgccttgttgccctagctggtcttgaactctgggacccaaagtgatcctcccattttagcctcccaaagtgctgggattacaagcgcccgccactgcgcctggctagtttttctatttttagtagagacagggcttcaccatgttggccaggcttgtctcaaactcctgacctcgtgatccgcctgcctcagcctcccaaagtgctgggattacaggcgtgagmn

SEQ ID NO: 18447 - DNA, 142 bp, Homo sapiens
  misc_feature 2: s=g or c
tsgctgggtgtggtggcacatgcctgtggttcctattactctggtggagactgaggcaggaggatggctggagctcagaagttcaagtcttcagtgagctgtgttcataccactgcactctagcctggatggcagagcgccc

SEQ ID NO: 18448 - DNA, 206 bp, Homo sapiens
ggccaataacttagatttgtcctgttgaggttattttgcagatcctgtaggtgtgctttattgtgttttactttttttttcttttgtctcctcaagttgtttgttttcaaagagcctgtcttcaagctaattctttagcttgatcaatctctcaatagaattgatcaagctaaagaattagcttgaagacaggctctttgaaaaca

SEQ ID NO: 18449 - DNA, 108 bp, Homo sapiens
  misc_feature 17: s=g or c
gaacccgggaggcggasttgcagtgagccaagatagcgccactgcagtccagcctgggtgaaagagcgagactccatctcaaaaaaaaaaaaaaaaaaaaaaaaaaaa

SEQ ID NO: 18450 - DNA, 121 bp, Homo sapiens
acctcgccacgtcaccgactgcaaaccttcagctgtctcaggctcgggtgcaatccgtaccctcagtgggttccctttcagtgggttcctttgtccccaggcccattattccatcctcccc

SEQ ID NO: 18451 - DNA, 134 bp, Homo sapiens
atgaccagcggacgagctgccacagacttgccgcggccccagagctggcgggagggagaggccaccagcagcgcgcgcgggagcccggggaacagcggcagctcacagtgtgccaccatggagttggggccaga

SEQ ID NO: 18452 - DNA, 108 bp, Homo sapiens
aattatgtattattatttttcacattcatttttgcctgagacaggaggtggagggtggtaaattaagaaacccgggaagctcagtgcttgagagaacccatagaagca

SEQ ID NO: 18453 - DNA, 151 bp, Homo sapiens
  misc_feature 47: r=a or g
taagagaatcttgattcaaacaggtaagtagttttaagcagcttacrtgactaccttaaggtgtcctctcacctaactggtttcaaaaacttaaaaaaggagtaggtcagttttagatctaatcttagctatcacaagcataatcagttct

SEQ ID NO: 18454 - DNA, 144 bp, Homo sapiens
cgccaaactcctccagctggccccatgtgctgcctttctgccacgctagccttttcaggctcttttctggctccccacctcatcttttgctgtttctcccacctgaatgtcatcatcctcctatcctcattatcccctatccac

SEQ ID NO: 18455 - DNA, 114 bp, Homo sapiens
agaaatctaggatggagccagcactgctggcccaacatgtctgtgagagaacctaaaggcgcctccaggaggaagcgtctgcatcttttccttgtttttttttttttttttttt

SEQ ID NO: 18456 - DNA, 184 bp, Homo sapiens
  misc_feature 127: s=g or c
acccggctaattttttgtatttttagtagagacggggtttcatcgtgttagccaggatggtctagatctcctgacctcatgatccgcccgcctcggcctcccaaagtgctgggattacaggcgtgastactgcacccagcaaagtgtgtgtatattttaggaaacacacacgcgcacaccccac

SEQ ID NO: 18457 - DNA, 163 bp, Homo sapiens
ttaaatggaataaatggaagactaaataaatataaattgcccagctggaaaaccagcaagataatttcctattttgagactacctaggctgtaacacacatcaatgttacacaataaaacaaaaggagaaatcccctactttttttttttttttttttttttt

SEQ ID NO: 18458 - DNA, 62 bp, Homo sapiens
aaaggtgattaggacctgtggttctagctactcgggaggctgaggcacaagaatcgcttgaa

SEQ ID NO: 18459 - DNA, 339 bp, Homo sapiens
  misc_feature 19: w=a or t
  misc_feature 118: w=a or t
  misc_feature 127: w=a or t
  misc_feature 132: s=g or c
  misc_feature 266: m=a or c
  misc_feature 267: s=g or c
tgtagattcacaggcagtwttaagaaataatacaaagatatcccatcttccctttatccagtttagcccaaagacaacatcaggcaaaaccatattaccatatcatatacaacatgtwgacatgaawcagtsaagctacaaaacatttccatcatcacaagtgatccatcttgtcctttaaagtcatactcatcctaacccccatcctgaaaacctggaaaccactattctattctttatttgtataattttctcatttcgaggamsttatataatgaaattacacagtatgtaatcttttagaattggatttttcagcccaattctcataagatcatt

SEQ ID NO: 18460 - DNA, 238 bp, Homo sapiens
aaataaggacagttatcaacaaaacatcttgaaatacaaatatgaaaagtattcctattcctgaggttgtgttttcctgggccatgttcactcatgttagctcagaataaaactcttgaaaatattttacagagcttggtttttccattaacaaggtggtattcttcattattgcaaggcctgataagtttctcactgaaaattctaaattaattaaggattattttaacagcaagct

SEQ ID NO: 18461 - DNA, 78 bp, Homo sapiens
ggtcaggagttcaagaccagcctgtccaacacgctgaacccaacctctactaaaaatacaaaaaaaaaaaaaaaaaaa

SEQ ID NO: 18462 - DNA, 101 bp, Homo sapiens
tacaatggtaacactaatcgaatgtaagtgagaacagctatattaatttctgacagagaagacttcacagcaaggaaagttatcagagataaagagggcta

SEQ ID NO: 18463 - DNA, 227 bp, Homo sapiens
gctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgccct

SEQ ID NO: 18464 - DNA, 168 bp, Homo sapiens
  misc_feature 129: r=a or g
attgttacctctatggcaggcatgggtatattatttagcatactttagggattggttttcatattacttgcagttttgatgaggaaggcttatagacctactcaggcaaacctgactggaacgtgagtrtctgtggtctggtgtggaaatagctctctagccccacaa

SEQ ID NO: 18465 - DNA, 123 bp, Homo sapiens
  misc_feature 13: s=g or c
  misc_feature 61: w=a or t
  misc_feature 62: k=g or t
atgcaaaaattasccgggcatggtggcatgcgcctgtggtcccagctatttgggaggctgwkgtgggaggatcacttgaacccagtgagccgagcttgcgccactgcactccatcctgggcac

SEQ ID NO: 18466 - DNA, 100 bp, Homo sapiens
accctcgcgcctcgcgcctccgactcccagaccccacgacccggctccggcgctggtttggcggcctgggtgggagaaggcacctcgccccggaccccca

SEQ ID NO: 18467 - DNA, 241 bp, Homo sapiens
  misc_feature 9: y=c or t
agacggagytcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcgga

SEQ ID NO: 18468 - DNA, 84 bp, Homo sapiens
aatgtttcttcatttaaacagtttcatgtacatttcttcatttaaatattactcgttaattttttttttttttttttttttttt

SEQ ID NO: 18469 - DNA, 104 bp, Homo sapiens
aatcacttgaacctgggaggcagagattgcagtgagccgagattgtgccactgcactccagcctgggcaacaagagcaaaactctgtctcaaaaaaacaaaaca

SEQ ID NO: 18470 - DNA, 131 bp, Homo sapiens
tacaaaactcaaatcaatatggatgaaagacaaagacaaatctcaaaactgtgaaactactaaaagaaaacactgaggaactctccgggacactggactgggcaaaatttttttagtaataccccacgccc

SEQ ID NO: 18471 - DNA, 103 bp, Homo sapiens
tagccattcctgttttaaatgtttttggatttttaaatcattttgaataaaatattcaaagtgctctatgaaatatttcaaatatacacaaaatttcagagat

SEQ ID NO: 18472 - DNA, 241 bp, Homo sapiens
tctcggctcactgcaaccttagcctcccaggttcaagcaattctcctgtctcagcctcccaagtagctgggactgcaggtgcatgccaccataccaggctaatttttgcatttttagtagagatggggcttcaccatattggtcaggctggtctcaaacttctgatctcagattctcaggtgatccacccatcttggcctcccaaagtgctggaattacaggcacgagccaccacgccgct

SEQ ID NO: 18473 - DNA, 123 bp, Homo sapiens
tttatacattgtctttgaattttttttctgtttactttttaaagtctttttaaaagccattttcttatggaaagatgtctgaggtgtttccagacatttttaactaacggagttgcgcaaacc

SEQ ID NO: 18474 - DNA, 262 bp, Homo sapiens
  misc_feature 252: w=a or t
tatcctaggcatgcataccagcagtacagacattcattccactaagtgtaagctcccaattaggaaagtacagtgttacccaattaaatcaggtttgatgaaggaaatatgcttaaactctaggtgaggggatgtaaattcatgtttcttccttccttttcccccctttttgttgcaggggatcaaaattaacacattctttttattttattttattttttattttattttattttatttttgaatggagcwgggggagggt

SEQ ID NO: 18475 - DNA, 184 bp, Homo sapiens
tgaggttttcaaaagtatataccaagaagtggatactgggccgggtgtggtggctcacgcctgtagtcccggcacttggggaggctgaggtgggcggatcaattggggccgggagttcgagaccagcctggccagcatggcggaaccctgtctctactaagaatacagaagattggccgagcgt

SEQ ID NO: 18476 - DNA, 96 bp, Homo sapiens
gagttggatgaggtggggaggctggggatgggaatgggaatgggattgggatagcaggacggggtcacatggccaaggatcttgaagaccccgcct

SEQ ID NO: 18477 - DNA, 185 bp, Homo sapiens
gtacaagataaaccaacggagtttgacaactgtatgaaaagctcagtgatgtacaaattgatattggaatttggtaacaatttgttcgatattgcaaatacagtttggcgccaccaccagcatttttgttcaccattactttaatggtgccagtgcagatgtcaacacagcaaaaaagggagttg

SEQ ID NO: 18478 - DNA, 277 bp, Homo sapiens
  misc_feature 107: y=c or t
  misc_feature 143: w=a or t
  misc_feature 147: y=c or t
  misc_feature 149: k=g or t
  misc_feature 166: k=g or t
  misc_feature 169: k=g or t
  misc_feature 221: k=g or t
  misc_feature 267: w=a or t
  misc_feature 270: w=a or t
gtgcatatatatttaggatagttagctcttcttgttgaattgatccctttaccattatgtaatggccttctttgtctcttttgatctttgttggcttaaagtctgtyttatcagagactaggattgcaacccctgcctttttwtgtytkccattggcttggtagakctkcctctatccttttattttgagcctatatgtgtctctgcacgtgagatgggtktcctgaaggaagcactaaatatggaaaggaacaaccagtaccagcwgcwgcaaaat

SEQ ID NO: 18479 - DNA, 157 bp, Homo sapiens
tgagcaaaaaggaggaaactgattagaaaatacctatgagggccgggtgcagtggttcatgcctgtaatcccagcactctgggaggccgaggcggacagatcacgaggtcaggagatcgagaccatcttggctaacacgaggaaaccgcgtctctac

SEQ ID NO: 18480 - DNA, 174 bp, Homo sapiens
cctcttaacatggcaaagaattttttcatatctgcctttgtttacccaaaagccattcaagagcaagttgtttagtttccatgtatttttgtggttttgagaattcctcctggtattcttatttttattgcactgtggtctgagaagatacttggtgtgatttcaatctttttt

SEQ ID NO: 18481 - DNA, 271 bp, Homo sapiens
cggagtctcgctctgtcacccgggctggagtgcagtggcgcgaactctgctcactgcaagctccgcctcccgggttcacgccattctcctgcctcagcctcctgagtagctgggactacaggcgcccgccgccacacccggctaatttttgtatttttagtagagacggggtttcaccatgttatccaggatggtctcgatcccctgacctcgtgatccgcccgcctcggcctcccaaagtgctgggattacaggcctgagccaccacgtc

SEQ ID NO: 18482 - DNA, 307 bp, Homo sapiens
  misc_feature 140: m=a or c
  misc_feature 197: y=c or t
  misc_feature 198: m=a or c
aattagggagtgttctttctttatattgtggaatagtgttaaaaggattgctaccaattcttttttttttaaatttttttagtatttattgatcatttttgggtgtttctcggagagggggatttggcagggtcataggmcaatagtggagggaaggtcagcagataaacatgtgaacaaaggtctctggttttccymggcagagggccctgccgccttctgccttccgcagtgtttatgtccctgggtacttgagattggagtggtgatgactcttaaccagtatgctgccttcaagcgtctgttt

SEQ ID NO: 18483 - DNA, 168 bp, Homo sapiens
aagttggccgagcgtggtggcgggcgcctgtggtcccggctgcttgggaggctgaggcgggagaatggcgtgagcccggaaagcggaggttgcagtgagccgagatcgccccactgcactccagcctgggcaacagagcgagactccgtctcaaaaaaaaaaaaaaaa

SEQ ID NO: 18484 - DNA, 105 bp, Homo sapiens
  misc_feature 96: n=a, g, c or t
ctttctctttctctgtctctctctttctctcttgttttcttttctttctttcttctttcttttttctttctccttctttccttccctccctccacnctccctccc

SEQ ID NO: 18485 - DNA, 121 bp, Homo sapiens
agtgtgccctaagccaagtactcgttctcatttgggtgtctgcactgttggaagctactgcactgtgtttccacgcagacagagtacagtgggaaaggctttctccagctgatggatggcg

SEQ ID NO: 18486 - DNA, 227 bp, Homo sapiens
  misc_feature 7: s=g or c
  misc_feature 207: r=a or g
  misc_feature 208: k=g or t
tggaaasgttttcctaattccaaaatgtctatgattttcaggacatttctgagcatctttctaaatgctcagaagcatttagaaacaagaccttgtttcctctatattagactgttttaaaaaattttgttatcaatcatattttggattggtggtatttagtccaaattccaaatatttgagcccattgtcagaccatgtgtctcrkatttctattcttttttttt

SEQ ID NO: 18487 - DNA, 72 bp, Homo sapiens
accatcattattcttttctcctattatgttcatgctatatcgctttcctataaatgcatattaggcctcggt

SEQ ID NO: 18488 - DNA, 261 bp, Homo sapiens
  misc_feature 7: m=a or c
ttcagamtactgtctctccttttttgagatggagtctcgctctgtcgcccaagttggagtgcagtggtacgatctcggctcactgcaacctccgccttgcgggttcgaatgatcctcttgcctcagcctcctgagtagctgggattacaggtgcccaccacctcacctagctagtttttgtattttttgtagagatggggtcttgccgtgttgaccaggctggtctcgaactcaagcgattctcctgccttggcctccccc

SEQ ID NO: 18489 - DNA, 130 bp, Homo sapiens
cagccccctgagtagctgggattacagacccgtgccaccacgcctggctaattttttgtatttttagtagacacagggtttcaccatgtaccccaggctgatccgcctggccaagtgatccgcccgcccc

SEQ ID NO: 18490 - DNA, 117 bp, Homo sapiens
atcaaaaaaacagctttgaactcccccttcaaaggaaacagtcgactttcataattagcatctaccattatccccaaatcttattttattcattgacttgaaattttttccaattgc

SEQ ID NO: 18491 - DNA, 146 bp, Homo sapiens
ccaacaatgatagactggattaagaaaatgtggcacatatataccatggaatactgtgcagccataaaaaatgatgagttcacgtcctttgtggggacatggatgaaattggaaatcattattctcagtaaactattgcaagaaca

SEQ ID NO: 18492 - DNA, 128 bp, Homo sapiens
  misc_feature 112: r=a or g
atatttagtttaattagatctaatgtgtcaatttttgctttagttgtcattaattttgatgtttttgtcataatattttggcccttccttatgaactggctagccatatgcrgaaaattgaaactgga

SEQ ID NO: 18493 - DNA, 132 bp, Homo sapiens
  misc_feature 119: s=g or c
tttttatattttcagtagagacggggttccaccatgttagccaagctggtcttaactcctgacctcagatgatccacccacctcggcctcccaaagtgctgggattacaggcgtaagcsaccacacctgccc

SEQ ID NO: 18494 - DNA, 137 bp, Homo sapiens
gttttttgtatttttagtagagatggggttttcaccttgttggccaggctggttgaactcctgacctcaggtgatcagccagctcgggctcccagagtgctgggattacaagtgtgagccaccgcgcccggcccaca

SEQ ID NO: 18495 - DNA, 162 bp, Homo sapiens
ggctgaactctccagaaaatgaaagtgtgcttcagggaactctttctcctccactccactatcccagggtttcagtcacccaggctggagtgcagtggtgcgttcgcggctccttgcagccccgccctctcgggctcaggtgatcctcccatctccgccatc

SEQ ID NO: 18496 - DNA, 58 bp, Homo sapiens
  misc_feature 7: s=g or c
  misc_feature 9: r=a or g
aaaaaasaratcatgtttaatactatttcaatcaaacattatcttttttttttttttt

SEQ ID NO: 18497 - DNA, 137 bp, Homo sapiens
cctgtggtcccacctgctccggaggctgaggcatgagaatcgctggaacccgggaggtggaggttgcagtgagccgagatggtgccactgcacttcagcctgggtgaaggagtgagactctgtctcaaaaaaaaaaa

SEQ ID NO: 18498 - DNA, 169 bp, Homo sapiens
  misc_feature 112: n=a, g, c or t
ttaatggaatatattatagtacactagcatgctggaaagaatgaaaataatatgaaaattctttacctttttttctttttgaaatggagtcacccaggctggagtgcaacgncgtggtcttggcacactgcaacctccgcctccctgattcaagtgattctcccgcctt

SEQ ID NO: 18499 - DNA, 273 bp, Homo sapiens
tgaaatggtgatgttggtggtaactaccttgtagggctgttaagaacattaaatgagataatccatgtataggacttggcctagtgtctgatacattgtaagcccttgaatgttagcttaagcaaaaattaagagctcagcttcctttcagcatttgcctttttcatcttcataattcccttgctgggcagctcaagggtaggatgaatggttcctgccgtgtggagtggcgtccctggggccagctgtccctcggggaagcagtgacgggga

SEQ ID NO: 18500 - DNA, 115 bp, Homo sapiens
cataaaaaattagatgggttggtggcactctcctgtatccccagctactcgggaggctaaggcaagagaatcgcttgaacccaggatccagaggttgtggtgagccaagatggca

SEQ ID NO: 18501 - DNA, 154 bp, Homo sapiens
  misc_feature 44: k=g or t
  misc_feature 73: w=a or t
tttcttgcctcagcctcctgagtagctgggattacaggcaagtkacaccacacccaactaatttttgtgtttwtagtagagacaggttttgccatgttggccaggctggtcttgaactcctgacctcaagtgatccgccaccctcgccccccta

SEQ ID NO: 18502 - DNA, 129 bp, Homo sapiens
  misc_feature 7: b=c or g or t
  misc_feature 8: n=a, g, c or t
aggcgcbncgggcgctggcggcggcggaggagagggagcagcgtcacgggcgcccggcccgttaaaacgctgctggctggagccacctccctccctgcagcccgcaacgggaatggagtaaagggagac

SEQ ID NO: 18503 - DNA, 68 bp, Homo sapiens
  misc_feature 7: s=g or c
aaactgscaacgtaaggaattggggaaggtgtgatagaactgcactcatgtgtgctggaggtgctttt

SEQ ID NO: 18504 - DNA, 205 bp, Homo sapiens
  misc_feature 116: r=a or g
  misc_feature 154: s=g or c
  misc_feature 155: s=g or c
aatagtttgcttctgtagcataggtaaaattattgtacagagttttatgtgggccaaaagaaattggccaggcgcggtggctcacacctgtaatcccagcactttgggaggctgargcgggtggatcacttgaggtcaggaatttgataccagssaggccaacatggtgaaaccccatctctactaaaaatacaaaaaaattagt

SEQ ID NO: 18505 - DNA, 114 bp, Homo sapiens
ttttggttttacatttaagtttttaatccatcttgagttaatttttgtataaggtgtaaggaaggggtccagtttaagttttctgcatatggctagccatttctccctgcacca

SEQ ID NO: 18506 - DNA, 156 bp, Homo sapiens
  misc_feature 129: w=a or t
ttttttttgagatggagtctcactctgtctcccaggctggagtgcagtgatgcaatccggctcactacaacctccgcctcctgggttcaagcagttctcctgcctcagcctcctgggtagctgggattwcaggtgcccaccaccacacccggctgc

SEQ ID NO: 18507 - DNA, 128 bp, Homo sapiens
  misc_feature 7: n=a, g, c or t
  misc_feature 8: s=g or c
  misc_feature 120: r=a or g
tcccagnsactcgggagggtgaggcaggagaatcgtttgaacccgggaggtggaggttgcagtgagccaagatcgtgccactgcactccagcctggatgatagagtgaggtctgtctcaraaaaaaaa

SEQ ID NO: 18508 - DNA, 163 bp, Homo sapiens
  misc_feature 81: k=g or t
  misc_feature 147: k=g or t
  misc_feature 148: k=g or t
ggatgtgagggcgatctggctgcgacatctgtcaccccattgatcgccagggttgattcggctgatctggctggctaggckagtgtccccttcctccctcaccgctccatgtgcgtccctcccgaagctgcgcgctcggtcgaagakkacgaccatccccgat

SEQ ID NO: 18509 - DNA, 151 bp, Homo sapiens
tttgctgaggagaatgaggagtataaggagtgtggatgggctggttacttttggctgtattggagaacttaaagaaaattacatgcttagaagttcttgaatgaaggaccagttaagatgacccagggagcttatgttaattgagagaacc

SEQ ID NO: 18510 - DNA, 186 bp, Homo sapiens
  misc_feature 12: s=g or c
  misc_feature 81: s=g or c
tgctcaggctgstcttgaacttttggtctcaagcaatcctcccacctcagcttcccaaagtgctgtgattataggcgtgascaccacacgtgtgcccagccagtcagtacatcttgattctaactcctgaataacttacatcaggctcctcctttccatcctttgagtttagtccccatccccaca

SEQ ID NO: 18511 - DNA, 254 bp, Homo sapiens
agtctttattggccgagtccaataactggattcctcaaaaatggtaggtagtgacttatttttttaaacataggttacattttttctttgtatgtcttgcaatggttttgttgaaaactgtacattttagataatatattgtagcaattcaggatttctattctctccccctgaggggggttatttttgttgcttctcttggtttgtttaataattttcctgaactaattctgtggagtctgcctcccccataa

SEQ ID NO: 18512 - DNA, 185 bp, Homo sapiens
gcctcctgagtagctgagactataggtgtgtgccactatggccggctaagttttgtatgtttatgagagataggatttcaccatgttggtcaggctggtctcaaactcctgacctcaagtgatccgcccacctcagcctcccaaagtgctgggattacagacttgagccactgtgcctggctggt

SEQ ID NO: 18513 - DNA, 228 bp, Homo sapiens
  misc_feature 8: v=a or c or g
  misc_feature 12: s=g or c
  misc_feature 13: y=c or t
  misc_feature 25: m=a or c
  misc_feature 58: m=a or c
  misc_feature 72: m=a or c
  misc_feature 81: m=a or c
  misc_feature 85: s=g or c
  misc_feature 127: r=a or g
  misc_feature 226: m=a or c
gctttggvgaasyttgggggaaaamagtttggaaaagtttctataataacgagggggmttctggagggaggmggcagcgamggasgagggggcttctcagagaaagggagggagggagccacccggrtgaagatacagcagcctcctgaactcccccctcccacccaggccgggacctgggggctcctgccggatccatgggggcggccagctgcgaggatgaggmgc

SEQ ID NO: 18514 - DNA, 192 bp, Homo sapiens
  misc_feature 96: m=a or c
  misc_feature 99: m=a or c
ggtttcaccgtagtagccaggacagtcttgatctcctgacctcgtgatccacccacctcagcctcccaaagtgctgggattacaggtgtgagccamtgmgcccagcctgtgtcagctgctttttacaaagcattatgcaagtagttaatgactaatatatacatatctaatatatatacatctaatgcagaa

SEQ ID NO: 18515 - DNA, 225 bp, Homo sapiens
gttttgctcttatcgcccgggtggagtgtagtggcgtgatcccggctcactgcagctgccttctcccaggttcaagtgattctcctgcctcagtttcctgagtagctgggattacaggcactggccaccacgcctgtgtaattttttgtgtttttagtagacacggggtttcaccatgttggtcaggctggtctcgagctcctgacctcaggtgatccgccctac

SEQ ID NO: 18516 - DNA, 108 bp, Homo sapiens
  misc_feature 23: n=a, g, c or t
cctcctgagttcaagtgattctnctgcctgaacctcctgtgtagctgggactacaggcatgcaccaccatgcccagctaatttttgtattttttgtagagatggggac

SEQ ID NO: 18517 - DNA, 102 bp, Homo sapiens
  misc_feature 12: m=a or c
agaatggcctgmacccgggaggcggacttgcagtgagcccagatagcgctgctgcagtccagcctgggtgaaagagcgagactccgtctcaaaaaaaaaaaa

SEQ ID NO: 18518 - DNA, 110 bp, Homo sapiens
  misc_feature 7: s=g or c
tgataascaacaaaacaagtctcaataaatcaacattatatcaagcactgtctcagaccacagtggaacaaaattgaaaatcaactccaaaaggagccctcagaaccgcg

SEQ ID NO: 18519 - DNA, 70 bp, Homo sapiens
ttactgagtgaaggaaccaaaggcacaacttgagaactgtctatgtttgtgtttatagaagaggaacgga

SEQ ID NO: 18520 - DNA, 163 bp, Homo sapiens
agtctaggtgctcctgtattgggtgcatatatatttaagatagttagctctttttgttgcattgatccctttaccattatgtaatgcccttctttgtcttttttatctttgttggtttaaagtctgttttatcagacactaggattgcaacccctgctttttt

SEQ ID NO: 18521 - DNA, 199 bp, Homo sapiens
  misc_feature 8: n=a, g, c or t
ttcaagcntgattaagctttacctctcagcagctgtgatactgttatttccattaccaaatgaataggttaggcccaagaggaattgcctgacataaaatagtctaataggactaattcagtcagggttctgactgctgcttctcctagcagtaactcacagtatcacagctgctgagaggtaaagcttaatcaggctt

SEQ ID NO: 18522 - DNA, 156 bp, Homo sapiens
  misc_feature 11: r=a or g
  misc_feature 12: m=a or c
caaagaagaarmaaaattagccaggagtagtggtggacacctgcagtcctggctacttgggaggctgaagcagaagaatcacttgaacccaggaggcagaggttgtagtgagccgagatcgcgtcactgcactccagcctgggtgacagaatgaga

SEQ ID NO: 18523 - DNA, 103 bp, Homo sapiens
tacacattcatagtttaaaggaatgaagggtctacacaacttattacaaaaacaaaacaaacatacctcgtatccccctgtcaattactattccccaggggct

SEQ ID NO: 18524 - DNA, 184 bp, Homo sapiens
  misc_feature 96: r=a or g
  misc_feature 98: r=a or g
  misc_feature 102: m=a or c
aatcatgtcatctgcaagttgcaaaagtttcatttcttcctttctggtctgtacaatttttgtttccttttcttttcttttttctttttgagacargrtttmactctgtcactgaggctacagtgagccataatcatgccactgcacccagcctcagtgacagagtgaaaccctgtctcaaaaa

SEQ ID NO: 18525 - DNA, 130 bp, Homo sapiens
  misc_feature 9: v=a or c or g
ccgaatgtvatggaaaggaatggaacggaatggaatggaatggaaaggaatggaatggagtgtaagggaattgaatagaatcaatccgaatgtaatggaatggaatggaatggagtggaatggaatgcaa

SEQ ID NO: 18526 - DNA, 196 bp, Homo sapiens
  misc_feature 15: n=a, g, c or t
attcaagtgattctnctgcctcagcttcccaagtagctgggattacattcatgcaccaccacagctggctaattttgtatttttagtagagacagggtttctccatgttggttaggctggtctcaactcccaacctcaggttattcccccacctcagcctcccaaagtgctgggattacaggcatgagccaccaca

SEQ ID NO: 18527 - DNA, 129 bp, Homo sapiens
aaaaaaccaggctctgccaggcgcagtggctcatgcctataatcccggcactttgggagtctgtggcaggaggattgcttgaggccaggagtttgagaccagcctgggcaacatagcgagaccccaaaa

SEQ ID NO: 18528 - DNA, 197 bp, Homo sapiens
  misc_feature 161: r=a or g
ttataagcagaggatatcacccacttcagagactcccagaggagaaagagtgtgtgttcaaagggcagatgaggctcagttggactccatagcagatgaaatggagaggggcaagcaatgaggctgccttgcaaggcagggcagagcaggggctgttgaarggtttggacttaatccctgaggcaaggagaagtgat

SEQ ID NO: 18529 - DNA, 292 bp, Homo sapiens
  misc_feature 2: r=a or g
argttgcagtgacccaagaccatgccattgcactccagcctaggtgacagagcgagactccatctcaaaaaaaatgaataaataaaaaaattagccagatccctgtagtcccaggtatttgggaggctgagagaggagaattgcttgagcccaggaacagaaggtttgcagtgagccaagatcacaccactgcactccagtctgggcaacgggagtgaaaccctgtctcaaaaacaaacaaacaaatatatcacaaaatatgtttagtgtttttgatgggtttttttctttt

SEQ ID NO: 18530 - DNA, 169 bp, Homo sapiens
ctgtccccacaccctggtcccagcctcgtgtgtctctgggcaggaacatcgccaggcggggcctctgggctcttcccttcccggaggcgtggccagaagttccccttgggcctccggtcctcggggcgtaagggccacggtgtatttttgggatgaaaaccagtccttc

SEQ ID NO: 18531 - DNA, 156 bp, Homo sapiens
  misc_feature 12: n=a, g, c or t
  misc_feature 39: k=g or t
aagttatttaanactttgacataaatagccatatttgtkttttgtcattgtttttaaaacacggtctcactttgtcacccaggctggagtacaagggtgctatcacagctcagtgcagcctcaacctcctggcctcaagcgatccttccaccccat

SEQ ID NO: 18532 - DNA, 154 bp, Homo sapiens
  misc_feature 141: y=c or t
gtgtgcagtttacatgtgtgtactttgcgtgtgtggtttatatgtgtatgtagtgtgtgtgtgtagtttatgtgtttgtgtatagtttgtgtatgtggtttatatgtgtgtgtgttatcgtacatagctaatgtgtttttyttttttttttttt

SEQ ID NO: 18533 - DNA, 65 bp, Homo sapiens
  misc_feature 7: k=g or t
  misc_feature 8: m=a or c
  misc_feature 9: n=a, g, c or t
aacctckmnatttccacctgctgttgtaaaatggaagatctgctgagacggtgagacggatttaa

SEQ ID NO: 18534 - DNA, 218 bp, Homo sapiens
  misc_feature 125: s=g or c
  misc_feature 138: s=g or c
gagatcgtcctggctaacatggtggggccccgtctctactagaaatgcaaaaagttggccgggtgtgatggcacagacctgtggtcccagctactctggaggctgaggcgggagagtggcgtgasctgggaggcggasttgcagtgagttgagatggcgccattgcactccagcctgggcgagagtgagactccgtctcaaaaaaaaaaaaaaaaaaa

SEQ ID NO: 18535 - DNA, 119 bp, Homo sapiens
caagtgtctagcagattcattgtctggtaagggcctgtttctcatagatggcatcttcttgccgtgttcttccttggtgtaagggataggggagctcccttgagcttttttttttttaa

SEQ ID NO: 18536 - DNA, 181 bp, Homo sapiens
ctggcctgtgccacctcaccagcattgattctgacgattccactaccccaagtgaaaccagtcagctttcagttcctcctggatgccctgctcctcccactcactacggggctttattacaagttgtttttatagtcataaagggctcccttccctttttcttacaaattagccaaggcta

SEQ ID NO: 18537 - DNA, 247 bp, Homo sapiens
aagctggagtgcagtggcgcaatcttggctcaccacaacctccacctcccgggttcaagcgattctcttgccttagtctcctgagtagctgggattacaggcacacaccatgcctggttaatttttgtattttagtagagatggcgttttgccatattggctaggctggtctcaaactcctgacctcaagtgatctgcctgccttggcctcctgaaatgcttggaaaacactcactccccaccaccg

SEQ ID NO: 18538 - DNA, 102 bp, Homo sapiens
gacgtgccttttgcattctgccatgattgtgaggcctccccagctatgtggaactgtaagtctattaaacctctttttcatccttttttttttttttttttt

SEQ ID NO: 18539 - DNA, 130 bp, Homo sapiens
ccgaatgtaatggaaaggaatggaacggaatggaatggaatggaaaggaatggaatggagtgtaagggaattgaatagaatcaatccgaatgtaatggaatggaatggaatggagtggaatggaatgcaa

SEQ ID NO: 18540 - DNA, 272 bp, Homo sapiens
tgagggcgccgtgtccagcgagcaaacgggcgccccggagccttgctgagaggcagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagact

SEQ ID NO: 18541 - DNA, 131 bp, Homo sapiens
  misc_feature 11: m=a or c
  misc_feature 12: r=a or g
  misc_feature 13: n=a, g, c or t
  misc_feature 14: v=a or c or g
  misc_feature 35: r=a or g
  misc_feature 36: w=a or t
gggggcctcgmrnvgggagatccagcccaggctgrwtccgctgactctgcctgtaggccggtggcgtcttctgggcctggatggtctaatatggagtttataagctgaagtggctttgaaaagggcaagct

SEQ ID NO: 18542 - DNA, 86 bp, Homo sapiens
  misc_feature 7: r=a or g
  misc_feature 38: k=g or t
  misc_feature 39: w=a or t
atacaaraattagccgttcttggtggcacatgcctgtkwtcccagctgctcgggaggctgaggcgggagacttgcttgaacgcgag

SEQ ID NO: 18543 - DNA, 119 bp, Homo sapiens
catggcaagttgatacgatggggtgcttggtggatgggccatggaggtccgtgagctggaactgggcacacgccatcccagagggctcaggatgccccaggaaggaaagaagggcgaca

SEQ ID NO: 18544 - DNA, 369 bp, Homo sapiens
  misc_feature 3: w=a or t
  misc_feature 177: m=a or c
  misc_feature 283: r=a or g
  misc_feature 284: w=a or t
  misc_feature 334: r=a or g
ttwtatacatttaaagtcctagaacaaagcctgcacatagcaagctcttagccaatgttagcagccattattactgtttactgttaataacagaagttactattaaaaaagaggaaacaggaaaaacctttgtcttcaagaagcttttactgtccgcctgtcaagttcctgagcagmagctgatttctggcttagaagttatggttaggaaagtaactagtgagcgcactaaacagtaagatgcgctgccacagttgtgtgtgtaattgacttttatagtcarwtctgcttatatttcctccttcaccctaatgctagcccggttctgagccaragttatttcgctctgccagtggtgcacttcagaaa

SEQ ID NO: 18545 - DNA, 78 bp, Homo sapiens
acttttttgtaaagacagagttttgccatgttgcccaggctggtcttgaactcctgacttcacgcgatccacccaact

SEQ ID NO: 18546 - DNA, 114 bp, Homo sapiens
  misc_feature 8: r=a or g
aatacaaraattagccaggtgcagtggcaggtgccttcagtcccagctactcaggaggctgaggtgggagaatcacttgagcctgggagacagagtgtcgctctctcgcccagg

SEQ ID NO: 18547 - DNA, 123 bp, Homo sapiens
  misc_feature 80: w=a or t
  misc_feature 81: w=a or t
gaaatggtaatggtaaagaaggaagagaggtaggaaaggtaacgtaataatagccttcgttttgtgtgtagaaaggttgwwattacttttgattcaattgttgactttgcagagcagactgaa

SEQ ID NO: 18548 - DNA, 158 bp, Homo sapiens
  misc_feature 10: y=c or t
tctaattgtytgatccttgggtgattatggcaggtgaatgtgctcttcaaatgcaaaccaaccagtctagaatctaaaacccaaccacctcctttattgggcttccacattatgggtcaccatccacctgccataatcacccaaggatcagacaatta

SEQ ID NO: 18549 - DNA, 241 bp, Homo sapiens
  misc_feature 8: m=a or c
  misc_feature 9: m=a or c
  misc_feature 12: s=g or c
  misc_feature 13: y=c or t
ttatttammcasyagtcattcaggcgcaggttgttcagtttccatgtaattgtgtggttttgagtgagtttcttaatcctgagttctaatttgattgcattgtgatctgagagactgtttgttactatttctgttcttttgcatttactgaggagtgttttacttccagttatgtggtcaattttagaataagtgtgatgtggtgctgagaagaatgtatattctgttgatttggggtcaa

SEQ ID NO: 18550 - DNA, 51 bp, Homo sapiens
  misc_feature 42: k=g or t
  misc_feature 48: n=a, g, c or t
gaaaaacaaacggggtgcccagggggaaggaaggcaggcgakaaagangca

SEQ ID NO: 18551 - DNA, 163 bp, Homo sapiens
  misc_feature 73: k=g or t
  misc_feature 106: h=a or c or t
tgaggtactggtgacccaggagatatctggggatttagggccactgaagatagaagatacaatacagtctgakatgctggggacccaggagacagaggtggaagchtctagggtaccagagtcagaggctgaggggacagaagctaaaatattaggaacccga

SEQ ID NO: 18552 - DNA, 211 bp, Homo sapiens
tgctttaaatatttttaaaataggtagttcaaagatttcctaaacatttcttatttagtaagttttcttaggaaggggcactttgtaaaaattagatggcctttgttctagacagttgtacccttttatattggtgttaatccattaatcctactcatgtgggcagagccctcatggtctaattatctcttaatggtcccaccccccccat

SEQ ID NO: 18553 - DNA, 126 bp, Homo sapiens
  misc_feature 7: h=a or c or t
tttctthttgtctttgtctgattggattaatttcaaagctttgtctttgagctctaaagttttttcttctacttctctagtctattattgaaacttcccactgcatttttatatctctaagtgtgt

SEQ ID NO: 18554 - DNA, 65 bp, Homo sapiens
  misc_feature 7: n=a, g, c or t
  misc_feature 8: n=a, g, c or t
  misc_feature 9: n=a, g, c or t
ggctgcnnntgagccgagatcgcaccactgcactccagtctggcaacagggttaactccatctca

SEQ ID NO: 18555 - DNA, 77 bp, Homo sapiens
caggttcttttttgcataaattaatataaaatgtgggtttttttctttaacctattatggtggatcacgttgtttgt

SEQ ID NO: 18556 - DNA, 175 bp, Homo sapiens
  misc_feature 7: s=g or c
  misc_feature 11: s=g or c
acaggcstgascactgcgcccggccccctagctaatttttaaattttttgtagagatgggggtcccactatgttgcccagactagtctcaaactcctggcctcatgggatcctcctgcctcagccttccaaaggctggcttgggtttacagaaatgagtcactgtgcctggccca

SEQ ID NO: 18557 - DNA, 156 bp, Homo sapiens
ggaagtatgtttggtgggtcagatcttcccttagtttctcctcttctgagggcatgtggagaccaggtttctgagcttggcttggattcagaagtgctgcccagtgggtagggcatgcagggcaccgcccacgtagaggaacctgttctgggcagc

SEQ ID NO: 18558 - DNA, 153 bp, Homo sapiens
  misc_feature 7: y=c or t
  misc_feature 67: v=a or c or g
  misc_feature 130: v=a or c or g
gctttcyaaatatgttctgaatattagatagctagttcccaaatgcactgcactgaaagtgtatgavaattggaaattggcttctagatttttgtattatattgccaaatgatggagtgatgagattgavatctactacttctttttgccttt

SEQ ID NO: 18559 - DNA, 212 bp, Homo sapiens
  misc_feature 7: y=c or t
  misc_feature 36: h=a or c or t
  misc_feature 110: r=a or g
aataggyaaatgacttgtattatatatatgtataahataattcttaataaaacaattcttacaagtcagtaagtaagagacaaacaacttactaaaaaaatggttgagargccaaggcatgttgacagcacacctgtaattccagcactttgggaggccaaggcaggaggatcacttgaggccaggagttcgagaccagcttgggcaacaca

SEQ ID NO: 18560 - DNA, 323 bp, Homo sapiens
  misc_feature 6: s=g or c
  misc_feature 44: k=g or t
  misc_feature 110: w=a or t
  misc_feature 150: s=g or c
  misc_feature 157: k=g or t
  misc_feature 205: s=g or c
  misc_feature 206: k=g or t
  misc_feature 207: k=g or t
  misc_feature 213: k=g or t
  misc_feature 234: k=g or t
  misc_feature 252: k=g or t
  misc_feature 269: k=g or t
  misc_feature 284: b=c or g or t
ggatasgaaattctgggttggaaattcttttctttaagaatgtkgaatattggcccccactctctgctggcttgtagagtttctgccgagagatctgctgttagtctgawgggctttccctttgtgggtaacccaacctttctctctgastgccctkaacattttcccctcatttcaactttggtgaatctgacaattatgtgtskkgcagtkgctcttcttgaggagtatctktgtggcgttctctgtatktcctgaatttgaatgtkgacctgccttgctabgttggggaagtctcctggataacgtaatgcagagtgtgt

SEQ ID NO: 18561 - DNA, 52 bp, Homo sapiens
tgcactccagcctggatgacagagtgagactccatatcaaaaaaaaaaaaaa

SEQ ID NO: 18562 - DNA, 153 bp, Homo sapiens
  misc_feature 147: n=a, g, c or t
ttacaggtgcacgccaccacacccggctaatttttgtatttttggtggagatgggtttcaccgtgttggtcaggttggtcgtgaactcctgatcttaggtgatccgccccccttggcctcccagagtgctgggattacaggcgtganccacca

SEQ ID NO: 18563 - DNA, 408 bp, Homo sapiens
  misc_feature 8: k=g or t
  misc_feature 77: y=c or t
  misc_feature 314: h=a or c or t
  misc_feature 328: y=c or t
  misc_feature 347: k=g or t
  misc_feature 355: k=g or t
  misc_feature 358: k=g or t
  misc_feature 398: h=a or c or t
gctttttkattatttaagattattattatttatattactgttataatatcattattatatttatattattataagtytctttaatgcttattggtttgtatacaatataatgcttttgagtctgttattaatatttttctagaaaaagttatttcatctgtttttagatatattgacatagaattgagttatagttttctcttttaattaaataaaactctgtatttaacattatcctcctttttatccaatattgtttatttgtgctagacgtttgcctgcttagtttttctggtgagccagaatttggttthggttaatatttgcygtttttcttattttctgcktaatttckackttcttccttttaccctcttgctttttcccttcttcctcchatctccccct

SEQ ID NO: 18564 - DNA, 81 bp, Homo sapiens
ctactaagagtgaccagaaaagtcatgggactgactaagtgttcactcagaggcaggagctgcctcaggaagaaaaaaaga

SEQ ID NO: 18565 - DNA, 199 bp, Homo sapiens
  misc_feature 118: m=a or c
agttcagtagtcaggatgatagattaaaaaggaaacgagaaagtgaaagaacattttctaggagtggttctatatctgttaaaatcataagacatgattctagacaggatagtaagamaagtactaccaaagatagtaaaaaacattcaggctctgattctagtggaaggagcagttctgagtctccaggaagcagcat

SEQ ID NO: 18566 - DNA, 335 bp, Homo sapiens
tagctttttttatcttggtacctatcttatttaggaatagaaagggcggcaggtttgcagctcccagcttgtcttttccctttggcttagtgattttggggttccaagatttattttccggccgggcgtggtggctcatgactgtaatcccagcactttgggaggccgacgtgtgcggatcatctgaggtcgggagtttgagactagcctgaccaacatggagaaacctcgtctctacaaaaaatacaaaattagctgggtgtggtggtgcatgcttgtaatcccagctacttgggaggctgaggcaggagaattgctggagcctggggggcgga

SEQ ID NO: 18567 - DNA, 286 bp, Homo sapiens
agtatattatattagaaaatttaatctacgttaccttttcaaaactaataatgaatttcatacgtaaaaatgatttttaccctcaagctccttgtttctcccacctgaaccattatttttctttttttttcttttctttattatactttaagttctagggtacatgtgcacaatgtgcaggtttgttaaatatgtatacatgtgccatgttggtgtgctgcacccattaacttgtcatttacattaggtatatctcctaatgctatccctcccccctccccctcat

SEQ ID NO: 18568 - DNA, 133 bp, Homo sapiens
cccgagtagttgggattataggcacccaccaccactaatttttgtatttttagtagatatggggttttttgccatgttggtcaggctggtctcaaactcctgacctcaagtgatccacccacttcggcctcct

SEQ ID NO: 18569 - DNA, 262 bp, Homo sapiens
  misc_feature 79: s=g or c
  misc_feature 80: n=a, g, c or t
  misc_feature 81: n=a, g, c or t
ctgagggcactgcagcacatgccacccacccactcttccaccagtctgtccaaggtcacacagctatgaggcggtagasnnggtatctgaccccaggctgtttagctccacagagtcaatgctgggataaagtccagcccctgacccggtcctccaggccgtgtggagccagcctcagttgccctttccaccttcatctctgtcactcctcatcttctggtcaagttcctcagacatcccaggtgtctccctccaatgtctg

SEQ ID NO: 18570 - DNA, 152 bp, Homo sapiens
tttttctgtcagcaccccaaaactcagggaaaaagattaatggaaggtttctgtgagtgctacactaacatgttctcctgcttattcagggctttcttctacagccattgttgccagccaacaaggctcaactccctcactctacccgcctc

SEQ ID NO: 18571 - DNA, 172 bp, Homo sapiens
  misc_feature 33: m=a or c
ctgtaattaaaaatactatgctgtatatttgamatttgctaagaaagtagatcttaaggcctatgacaccacacacacacacatacacacacacacacacacacacagagggaactgtgttattcagctctattgtggtaatcatttcacagtgtacaacatgatgatttat

SEQ ID NO: 18572 - DNA, 228 bp, Homo sapiens
cattcattcaaagccatccattcattgggggaacaacatgggcatgagggtaaagaaataatcccaacgcaatctgcctgtgagaagctcagtccactggaacagacaacaggcacataaacaacaaggacagaggatgccagggagtgcaaaaggaatacaagagaaacccggaggaggagaggcgagggtggttaatgccactgcagatgggactctggagctgag

SEQ ID NO: 18573 - DNA, 338 bp, Homo sapiens
aaaggaggtctgaaatctttaaatcttatcagaaagtgttcttttaatgcaaaactggtgaccatattacccttttaattatattaaatgccacttaatttttttctaaaagtacatattttaaactttttactagatgttttttaggaaattgctaaaattagcagtggtcaaagatggactgtttagttggtatgttcttgttactttcttgggcccatttcaaaatatgctggatgtggcatgtggcacagccccctagtgattgacgtggttttggtatcttaaaggctgttgacctggcgacccaattctggagaaactgcccccccacctct

SEQ ID NO: 18574 - DNA, 57 bp, Homo sapiens
cactccagcctgggcgacagagcgaaactcagtctcaaaaaaaaaaaaaaaaaaaaa

SEQ ID NO: 18575 - DNA, 82 bp, Homo sapiens
aacctccagatttccacctgctgttgtaaaatggaagatctgctgagacggtgagacggatttaaaaaaaaaaaaaaaaaaa

SEQ ID NO: 18576 - DNA, 153 bp, Homo sapiens
  misc_feature 29: m=a or c
  misc_feature 30: v=a or c or g
gcgattctcctgcttcagcctccggagcmvctgggattactaggcatgcgccaccatgactggctaattttgtatttttagtagaggtggggtttctccatgttggtcaggctggtttcgaactgcccgccaatttccaacctgaatcccccc

SEQ ID NO: 18577 - DNA, 222 bp, Homo sapiens
ccttgccaatccttgaaccagatatgctctcattgccagacctgtgcacttaaacttttccctctgcctggaatgatcttcccctaggctcctgcatagtccagttcttcccttctcttggctcttgattcaaatgtcatcatcatagtgaggttttccctaatccccctacagattctagtaactccttcacaatcacccctgggcttcttcccctgctcg

SEQ ID NO: 18578 - DNA, 153 bp, Homo sapiens
cctaaaacttaaagtataattttaaaaaaaacactaatacatgttagttgtagaaatattggaaataaaattttaaaataagaatttttctcatttttattgttcaagaaaaacacttactggtgagttttgttatataactttctaggtttt

SEQ ID NO: 18579 - DNA, 90 bp, Homo sapiens
gcccctgcgtttatcgtatttgtgtgtttgtgaatatgagtgtatgtgtgtgaatctgtatggcaatgtataaattcttttttttttttt

SEQ ID NO: 18580 - DNA, 138 bp, Homo sapiens
tttagggtattgcagtagacatggtgaaaaacaagtgagaaccgtgagggatcactttttactgcaatacgcaatttactggagagacaactgctcacacggtagtgattagcgtgacatgacttttttttttttttt

SEQ ID NO: 18581 - DNA, 120 bp, Homo sapiens
attccctggaacgaggcgcgggatacggtgctctccgcctattctgccttctcgccgcgcatggccgacatcgcccggcgcttcttcgacgagggctggatcgacgcgcccacccgcccc

SEQ ID NO: 18582 - DNA, 292 bp, Homo sapiens
cttttttaatgccatggagtactatattcttcaaagttccaacaaagatgcactacatttggacaatgtggaaatggccctcagccttctcttcctgatgtgccaattccactgatcctgtgaaggctgcccaatttgagccacctggacgtcaaatgattgccatcagaaagagacaacttgaagaaaccaacaatgcctatgaaacagctgacggcggctacatgactctgaaccccagggcacctactgacgatgataaaaacatctacctgactcttcctcccaacga

SEQ ID NO: 18583 - DNA, 300 bp, Homo sapiens
ttctcagcccagcttttcaccccagctgtttgttcagccacctgctggcacggatgtaacagcgccttgctgagctgtgtggcttctcttacttcctgcttgagatgcctgcagagcccacttggctgttctgacccaagcagacctggaagtgtgggggagctaatatcccatgtggcaccccttgatgccaaggaggtattggagccaatggaaaaaccatcccttcttttattccctgagaagataatccagaggtatattgtgacccatcaaaatccaagttcagttgcccccaac

SEQ ID NO: 18584 - DNA, 147 bp, Homo sapiens
cctcctgggttcaagcgattctcctacctcagcctcctgagtagctggaactacaagtgtgcgctaccatgcctggctaatttttgtagttttagtagagacagggttttgctatgttgactaggctggtctcaaactcctgacctt

SEQ ID NO: 18585 - DNA, 101 bp, Homo sapiens
gctgccctcctctcctatatgtattctatgacctagacttaaaactgattacggccaagtgtggtggctcatatctgtaatcccagcactttgggaggccg

SEQ ID NO: 18586 - DNA, 136 bp, Homo sapiens
  misc_feature 32: y=c or t
  misc_feature 51: m=a or c
cctcagcctccctagtaactgggattccaggygcctgctaccacgactggmtaatttttttgtatttttagtagagacgaggttttaccatgttggccaggtgggtctcaaactcctgacctcaggtgatcgccct

SEQ ID NO: 18587 - DNA, 164 bp, Homo sapiens
atccctttattttgatcctatatgtatctttgcatgtgagatgggtctcctgaatatagcacaccagtgggtcttgactatccaatttgtgttctggctctacttctaattggagtgcaagactgagattcatgaggaaatgctggtgtttaggaggagtacgt

SEQ ID NO: 18588 - DNA, 182 bp, Homo sapiens
ttaaatgacagaaatgtgtagagcggttctggaggctggaagtctgagctcagtgtgccagcatggtcatgttcttggtgagcgatcttcctgccttggcctcccaaagtggtgggaatacaggcgtgagcgactgcgcctggtctgacctctgacatctaagtctcttcaccactatctct

SEQ ID NO: 18589 - DNA, 293 bp, Homo sapiens
  misc_feature 280: h=a or c or t
tttcttttgggggtgggggacagtcttgctctgtcaccaggctggagtacagtgacgtgatctcgcctcactgcaacctccgcctctcgggttaaagcgattctcctgcctcagcctcccaagcagctgagactacaggcgtgtgccaccatgcccagctagtttttgtatttttagtagagatggggtttcaccatgctgaccaggatggttttgatctcttgaccttgggatccgcccacctcagcctcccaaagtgctgggattacaggcgtgagthattgcacccggtc

SEQ ID NO: 18590 - DNA, 140 bp, Homo sapiens
tcttttttttattattatgctttaagttctggggtacatgtgcacaatgtgcgggtttgttacataggtatacatgtgccatgttggtttgctgcacccatcaactcgtcatttacattaggtgtttctcctaatgctat

SEQ ID NO: 18591 - DNA, 65 bp, Homo sapiens
  misc_feature 50: b=c or g or t
tactcatagatcataatgactcattaaaacttccagcaagcttgtgtgtbaaaataatctttttt

SEQ ID NO: 18592 - DNA, 75 bp, Homo sapiens
  misc_feature 49: y=c or t
  misc_feature 73: r=a or g
tataggataaatatgggataaatactgggtcaaaggaaaatttcaattyagagaaaagattttgatgagagarat

SEQ ID NO: 18593 - DNA, 73 bp, Homo sapiens
tgtctagaagtaattcgtccatcaaatacacagataacacaaggccacaagaaacagaaagaaaaaaaaaaaa

SEQ ID NO: 18594 - DNA, 88 bp, Homo sapiens
caaccacagaatataccttcttctcatctgctcatgaaacatattctaagatcaaacacatgcttggtcataaaacaagtcacaaaaa

SEQ ID NO: 18595 - DNA, 198 bp, Homo sapiens
  misc_feature 193: m=a or c
cagtggtgtgatcttggctcactgcaagctctgcctcccgggttcatgacattctcctgcctcagcctccccagtagctgggactacaggtgcccaccaccacgcccagctaatttttttttttgtatttttagtagagacggggtttcaccacgttagcaaggatggtctcgatctcctgacctcgtgatcmaccct

SEQ ID NO: 18596 - DNA, 116 bp, Homo sapiens
ctgattaatgattaataaatataagttctgttttacttttaaacatccaactttggctgggtgtggtggctcatgcctgtaatcccggcactttgggaggctgagccgggcggatc

SEQ ID NO: 18597 - DNA, 233 bp, Homo sapiens
tatacacatgcatgtgtctttatggtagaacaatttatattcctttgggtatatacccagtagtgggattgctgggtcgaatggtagttctattcttagttctttgaggaatgaccacactactttccacagtaattaaactaatttatactcccaccaacagtgcacaagtgttccattttctctgctacctcatcagtacctgttatttttgggctttttttttttttttt

SEQ ID NO: 18598 - DNA, 372 bp, Homo sapiens
  misc_feature 245: y=c or t
ttctggttattaatcacttgtcaaatggatggttttccaatattttcttcctttctatgtgttgtcccttcaatgtcttgattgttcatttgcagaagaaactttttagcttgatataaacccagttctatatttttgctttggttgcctgtgctttcgaagtcgtatacaaaaaaaaattgccaagaccaatgtcctggagcatttccccaatgttttcttctagcagtttcatgatgtcaggycttagattcaagtctttaattcattttgatctgatttttttgtgtatggtgagagattcagggtctactttcattcttgtgtacatagctctctagtttttctagcactgtttcttgaaaaggctgt

SEQ ID NO: 18599 - DNA, 211 bp, Homo sapiens
tcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagcta

SEQ ID NO: 18600 - DNA, 196 bp, Homo sapiens
attggttaaattagtctccatggcctattttgtttaaattacattgtttacactagaccatatggtctattttggtgaatgatcctagcactcctgaaaagaatgtattttctgcattgttgagtgttctgcaaaggtcagtcaggtcaaactggttggcagtgttgttcaagtcttctataatccttactgattt

SEQ ID NO: 18601 - DNA, 102 bp, Homo sapiens
  misc_feature 46: w=a or t
  misc_feature 47: k=g or t
  misc_feature 59: w=a or t
  misc_feature 61: w=a or t
ttggccaggcgtggtggtgggcgcctgtggtcccagctactcgggwkgccgaggcgggwgwgtggcgtgaacccgggaggcggacttgcagtgagccgagga

SEQ ID NO: 18602 - DNA, 125 bp, Homo sapiens
  misc_feature 115: s=g or c
aaatttttattttttgtatatatagggtcttgctctgttgccaaggctggtctcaaacctctaggcaagctatcctttcacctcagcctcccaaagtgctgggattacaggcccstttttttttt

SEQ ID NO: 18603 - DNA, 223 bp, Homo sapiens
tttctgtttgtggggtagatctttctccagccctttactttgaacctatgggtgtcgttatatgtgagatgggactcttaaagacagcagacaggtaagtcttgttttttaattcaacttgccactctgtgccttttaagtgagacatttaggtcatttacagtcaaggttaatattaatatgtgaggttttaatcctatcatgaagttgttagttggctgct

SEQ ID NO: 18604 - DNA, 211 bp, Homo sapiens
  misc_feature 27: w=a or t
  misc_feature 28: r=a or g
  misc_feature 69: v=a or c or g
  misc_feature 80: b=c or g or t
  misc_feature 81: r=a or g
  misc_feature 104: k=g or t
  misc_feature 140: w=a or t
  misc_feature 141: y=c or t
atacaaaaattagccgggcgtggtggwrcctgcctgtggtcccagctactcgggaggctgaggcgggavgatcgcctgabrtgcaggaggtggaggctgcagtkagccatgatcgtgccactgcactccagcctgggcawyagagccctgtctcaaaaaaaaaattatggccaaaatttttcccaaatttttgaaaagctgtaagccacca

SEQ ID NO: 18605 - DNA, 106 bp, Homo sapiens
tattttaaatgcatttatcttttttgacactattcagtggaatgtgtaagctagctaattcttgttttctgatttaaagcacttttaaatcttatcctgcccccca

SEQ ID NO: 18606 - DNA, 112 bp, Homo sapiens
ggattgaaaatattgaggaaaaagagattatcctgtcatgtgagatgcataagaagccatgcctccatgctgcacccctggaactcacaacaattcttgacccacacccagt

SEQ ID NO: 18607 - DNA, 151 bp, Homo sapiens
ttatactctaagttttagggtacatgtgcacattgtgcaggttagttacatatgtatacatgtgccatgctggtgcgctgcacccactaacgtgtcatctagcattaggtatatctcccaatgctatccctcccccctcccccgccccact

SEQ ID NO: 18608 - DNA, 157 bp, Homo sapiens
  misc_feature 19: w=a or t
agcatctttaaattatgtwacagccaagtgtggtggttcactcctataatcccagcactttgggaggccaagatgggtggattacctgaggtcaggagttcgtgaccagcctggccaacaaggtgaaaccccatctctactgaaaaaaaaaaaaaaa

SEQ ID NO: 18609 - DNA, 203 bp, Homo sapiens
  misc_feature 185: k=g or t
ggctcactgcagcctcgacttcctgggctcaggtgattgtcccacctcagcctcccgagtagctggaactacaggtgcatgcctccacacccggctttttttcttttttttctttttagtagagactgggatcttgacatattgcccaggctggtctcaaactcctgggctcaagcgatccacckctctcatcctcccacagt

SEQ ID NO: 18610 - DNA, 205 bp, Homo sapiens
caacatgaacagacacttttcaaaagaagacacacacggtcaacacgcatatgaaaaaaatgctcaagatcactaatcatcagagaaatgcaaatcaaaaccacagtgagataccatctcgcattagtcagaatggctattactaaaaagtcaaaaaataacagatgctggcaaggttgcagagaaaaaggaaggcatatacact

SEQ ID NO: 18611 - DNA, 211 bp, Homo sapiens
  misc_feature 138: s=g or c
  misc_feature 201: m=a or c
gagatcgtcctggctaacatggtggggccccgtctctactagaaatgcaaaaagttggccgggtgtgatggcacagacctgtggtcccagctactctggaggctgaggcgggagagtggcgtgagctgggaggcggasttgcagtgagttgagatggcgccattgcactccagcctgggcgagagtgagactccgtctcamaaaaaaaaaa

SEQ ID NO: 18612 - DNA, 404 bp, Homo sapiens
  misc_feature 296: v=a or c or g
  misc_feature 297: d=a or g or t
  misc_feature 316: r=a or g
  misc_feature 319: n=a, g, c or t
  misc_feature 367: m=a or c
  misc_feature 370: m=a or c
  misc_feature 376: m=a or c
tgaactgtgatgacatgtatctttttagtagcctttctacctcatgagattgttgtaaggataaagtagatgttccagaaagtcaaaatctataaacggaagaaagtggtatattttgagctcaggaagctttgtgggtatccattctggatttcctttccagaattttgcacacctccattaccttagtcaaattttgcctaggagtttatgttcagattggggaaatgcagcactttgtttttgtttttagtgctgggagactaaccaggactagcaaattcttcttaatgtgvdtcacttaggtgaggcagartcntgctgtcgcccaggatggagtgcggtggcacagtcttggcctgtctgmaamctccamctccagggttcgggcgattctcctgcct

SEQ ID NO: 18613 - DNA, 227 bp, Homo sapiens
  misc_feature 92: k=g or t
  misc_feature 124: k=g or t
  misc_feature 204: k=g or t
  misc_feature 214: k=g or t
ttgggcaattatactgtatttctgtatctccatcactttcctgttctcccaggaaatgatttaattccttctttcattacctcaaacctcckaacacctctcccctcattccttttctcatttkatctcccatttcattgagacaactgaaaccatcagaagaagactttgataaacttttaccatgctatctagctacctgtkaccatctackatctactgcccac

SEQ ID NO: 18614 - DNA, 52 bp, Homo sapiens
tgaaaatggatggtttgggtattaaaaagaaaaaaaaaacttaaaaaaaaaa

SEQ ID NO: 18615 - DNA, 236 bp, Homo sapiens
ttacagttggtttatagtgtgtcttggtatggggctctgcaggtttctcttacttagagtttgttgagctgcttctgtttgttatccccatctttcctcaaatctgtgaagtttttggacattattcctccccattaactgtgtatttttctctttttattcttctgaagtttctacaatacatatattggtctacttaatggaggctcataagttccttacttcttttctctttt

SEQ ID NO: 18616 - DNA, 376 bp, Homo sapiens
  misc_feature 77: r=a or g
  misc_feature 316: y=c or t
  misc_feature 318: r=a or g
taaataccacatattagtcaggatactttgtagcacaaagatatattcatgaccttaattaatgccataacagttgrgatagttttcctggaaatgaaatgagaggattgagaaatattttagtatacaaaacaagcatcattaatgaatgatcagatgggtgggagagatgttagtgaaggaaagaagtttaggatgactcctgtgttcctggcctctattaaatatatttttatgttgagtaggtcaggagaaatttacatgctagttttagcgtcacatcaaatcttgacaacttttgaattaatttgttaayaratcaattgatttgaactgtatttttgaggtgtttacttaagattgagtttgaggcata

SEQ ID NO: 18617 - DNA, 58 bp, Homo sapiens
tgagccaagatatcaccactgcactccagcctgagtgatgcagtgagattccgtctca

SEQ ID NO: 18618 - DNA, 286 bp, Homo sapiens
  misc_feature 245: k=g or t
  misc_feature 246: s=g or c
ttgtcatcatatggtaagtttacacttaaaatttttagaaaactatcaaatggttttccaaaatggatgtaccattttacattgtttacatacaaattccattggtacattctttagttcttccacatccttgccaacacttggtataatcagttaatttttctttttcctttttgatttattttatttcaagacagggactcagtttgttgcccaggctagagtgcagtggtgtaatcatagcksactataacctgggcaacagagtgagactctgtctcagaaa

SEQ ID NO: 18619 - DNA, 193 bp, Homo sapiens
tcaggagatcgagaccatcctggctaacaaggtgaaaccccgtctctactaaaaatacaaaaaattagccgggcgtggtggcatatgcctgtaatcccagcaactcgggaggccaaggcatgagaattgcttgaacctgggaggcggaggttgcagtgagctgagattgcgccactgcactccagcctggcaa

SEQ ID NO: 18620 - DNA, 170 bp, Homo sapiens
tgggactacaggcacctgccaccatgcccagctaaatttttttgtatttttagtagagacggggtttcactgtgttagccaggatggtctcgatctcctgacctcgtgatctgcccacctcagcctcccaaagtgctggaattacaggcgtgaaccaccgcacccgagcc

SEQ ID NO: 18621 - DNA, 120 bp, Homo sapiens
  misc_feature 16: r=a or g
  misc_feature 116: v=a or c or g
caaaaaaacaaaaacraaaaaagaaggaaaatcttggagggtgggcgtgggaactcaggaccccagagtggcgagtggtgtggggagggagagcctctctcccccttttctgtgtvaaga

SEQ ID NO: 18622 - DNA, 113 bp, Homo sapiens
cctgttccccaataacctacggaaattaaaaaatttaaaaaaaattaaaaaaacaaaaaggaatggttttgagaaaaaaaaattattaaatacaggtggggtctcaccatgtt

SEQ ID NO: 18623 - DNA, 136 bp, Homo sapiens
caacattctgttataaacattgattttttataagttcagtcaatgtcaatcatttccattttcatcatccttgaaacaaaaacagcttttagtagactgacaaagtaaactttctagttctgcaaacaacaaattt

SEQ ID NO: 18624 - DNA, 113 bp, Homo sapiens
ctttccagaaaattcatggtagtgtactcagaatttgagactcaagagggcagaggtttccccgattgtgatgttttgatttgggctaagaggaactcttttttttttttttt

SEQ ID NO: 18625 - DNA, 302 bp, Homo sapiens
  misc_feature 273: w=a or t
  misc_feature 280: y=c or t
  misc_feature 283: k=g or t
gattgatctgtctaatattgacaatgggttgataaactttcccactattattgtgtgggagtctaagtctctttgcaggtctctaagagcttgctttatgaatctgggtgctcctgtattgggtgcacatgtattcaggataattagctcttcttgtttcattgatccctttaccattatgtaatgcccttctttgtgtttttagagctttgttggtttaaagtctgttttatcagagattaggattgtaaaccctgcttttttttttgcttwacatttycckggtaaatattcctccatcc

SEQ ID NO: 18626 - DNA, 186 bp, Homo sapiens
tcatttcaaaaggaagctgtttaaagctctgaagatattttgtagcattttcctgacgtcattctatagacagaaaagagtcaggaaattccttgaaaagtgcagtcttaatgagagtgttccttccaaaccccacttccaccacaatcaactacccagtttgaggtggattctgattgaaattaa

SEQ ID NO: 18627 - DNA, 282 bp, Homo sapiens
ccatggattattccattccattccattagatgattccattcgggtccgttcgaagattctcttcgattccattcgataattccgtttttttccgtttggtgttgataccattcgattccattcgatgataattccattcgattctatgcgatgattccattcctttccattagaagatgattccattcgagaccattcgatgattgcattcaattcattcgatgacgattccattcaattctgttcaatgattccattagattccatttgatgatgattcca

SEQ ID NO: 18628 - DNA, 146 bp, Homo sapiens
  misc_feature 132: w=a or t
tggtttcaggtcttaaatgtaagtctttgctccattttgagttgatttttatatgaggtgagagatggggatccagtttaatcttctacatgtggcttgccagttttcccagcaccgtttattgaaataggwatcctttccccaat

SEQ ID NO: 18629 - DNA, 80 bp, Homo sapiens
tcaggcatgaggattacaggattacatgccaggattacagtattacaccatgtctggccaatcataatcttttttttttt

SEQ ID NO: 18630 - DNA, 222 bp, Homo sapiens
  misc_feature 147: n=a, g, c or t
cactggagttttgtgtgagttggagcaacgtgagggttttcacagtagctcctgaagaacaagagctgtgtgttcatggaaattgtataaccgtgagtagaaatggttttgcagctctttgtaacatgaatttgacttcgatgtggnctagatttatataaaaatagttttaaagtatatgaaaatatgatctcttaaatgttatcaaatgtagccgcagaa

SEQ ID NO: 18631 - DNA, 201 bp, Homo sapiens
  misc_feature 160: b=c or g or t
  misc_feature 186: n=a, g, c or t
agaattgtagcaaatgctggccatcttctgtcagcattccaatgctagtaatgactggagggaacagagatggatgagatgtggaattagctgttgggcccgtggattctgtctagggtgttcttacctttcactgtttgcctgagttgaagtcattgcbcacattgtacagtcactgttgtttcntgtgtggttgtttat

SEQ ID NO: 18632 - DNA, 174 bp, Homo sapiens
  misc_feature 17: r=a or g
  misc_feature 18: k=g or t
  misc_feature 151: r=a or g
aaaatagagtagctgarkgaaaaaataagaaccaatgatctgttgcctgcaataaacacacgtcacctataaagacacacctagactgaaaataaagggataggaaaagtcattctatgcaaaatggaaactacaaaagaacagagtagcragtatttgtatcaaacagattta

SEQ ID NO: 18633 - DNA, 83 bp, Homo sapiens; identical to SEQ ID NO: 17740

SEQ ID NO: 18634 - DNA, 59 bp, Homo sapiens
ggaatatgttaccccctaaatccaaagagacccacgaagcattgtgctttttttttttt

SEQ ID NO: 18635 - DNA, 205 bp, Homo sapiens; identical to SEQ ID NO: 18347

SEQ ID NO: 18636 - DNA, 436 bp, Homo sapiens
  misc_feature 131: m=a or c
  misc_feature 149: d=a or g or t
  misc_feature 150: b=c or g or t
  misc_feature 155: w=a or t
  misc_feature 220: w=a or t
  misc_feature 329: w=a or t
  misc_feature 365: w=a or t
  misc_feature 369: d=a or g or t
  misc_feature 370: y=c or t
  misc_feature 375: w=a or t
  misc_feature 380: h=a or c or t
  misc_feature 386: w=a or t
  misc_feature 401: w=a or t
  misc_feature 408: k=g or t
atggggaacatgtgtgcctattgtcaccgttatccactttgttgaatgtgtcatattatcagtagtgtcccctctgtgttctttaggactattttgctctaaatcctgtgttgcctggtaacaaactcacmatcttaactttattattdbcttgwatttggtagcatatctttcttaaatcctttataaaaaaaaagtcagtacatattgttttcagtgwgtcttttcatgacaactaactgctggatttgttcattttcttcatcaagcaaatctgagatctgtcctttgggaagtttagcttctttgcagttactgatatttctgawacctcatattgtgctttatttactaaacttcatttwattdyttttwcttthcttgtwatttataattaggtwatatttkcttctactgctttaaaaagctatttaat

SEQ ID NO: 18637 - DNA, 99 bp, Homo sapiens
  misc_feature 14: r=a or g
ttttggataacggrtacctagcctgtattttgtatccccgggatttgcaacagttctgtttagataatggtgccaagtgttaaattactttatgtttaa

SEQ ID NO: 18638 - DNA, 116 bp, Homo sapiens
  misc_feature 95: w=a or t
  misc_feature 96: w=a or t
actaaaaatataaaaattagttgggcaaggtggtgggcgcctgtagtcccagttacgcaggaggctgaggcaggagaaaggcgtgaacccaggawwcggagctggcagtgagccga

SEQ ID NO: 18639 - DNA, 203 bp, Homo sapiens
  misc_feature 114: r=a or g
  misc_feature 122: r=a or g
  misc_feature 123: r=a or g
  misc_feature 129: s=g or c
  misc_feature 134: r=a or g
  misc_feature 144: m=a or c
acaagagaagtcagtatgatctactaataatacaaaaattagccaggcgtggtggtgcacgcctatagtcccagctactagggaggctgaggcatgagaattgcttgaacccargaggccarrgggttscagaragccgagatmactccattacactccagcctggacaacaagagcaaaactctgtctcacaaaaaaaaaaa

SEQ ID NO: 18640 - DNA, 174 bp, Homo sapiens
  misc_feature 108: y=c or t
  misc_feature 109: d=a or g or t
  misc_feature 123: w=a or t
  misc_feature 137: d=a or g or t
  misc_feature 142: r=a or g
  misc_feature 148: w=a or t
  misc_feature 152: w=a or t
ctgcttttcaaattttatatatatatgtgtgtgtgtgtgtgtgtgtgtatgtatgtgtgcatatacatatgtgtgtgtgtatatgtatgtgtgcatatacatatataydtgtagtatatatgwattctcaaatatadatgarggatawatawatttgagtatgttggtaggggt

SEQ ID NO: 18641 - DNA, 222 bp, Homo sapiens
  misc_feature 116: m=a or c
  misc_feature 124: m=a or c
tgtccccaagaattgtaggaggctcctcgggaagtaaagggcccctctcaaagatttccattgctgggtgatcagccttcacaggcatggcatactggccacccttgcacccccamatcccatmaacaacattagccagcccacactgccccagaaattatcgctgaggcagaaatgaatgtggcaatagccaccccttgcccaatgtctcatgcctaagaa

SEQ ID NO: 18642 - DNA, 88 bp, Homo sapiens
  misc_feature 16: b=c or g or t
gcagaacgctccagabgctgagaggcaggaggcactagggatcgtccgcaggattgggactgatacagaggccgccacggagcccaac

SEQ ID NO: 18643 - DNA, 139 bp, Homo sapiens
  misc_feature 119: w=a or t
tagtttttttgtttgtttgtttgtttttgtttttcatggtttccttcaactctctgagcatatttaagacagttaaaatctttgtctagtaggtccattgtctgggcttgctatggggwggtttctgtcaatttctttt

SEQ ID NO: 18644 - DNA, 307 bp, Homo sapiens
  misc_feature 110: m=a or c
  misc_feature 111: w=a or t
  misc_feature 112: w=a or t
  misc_feature 113: w=a or t
  misc_feature 128: v=a or c or g
  misc_feature 235: v=a or c or g
  misc_feature 236: n=a, g, c or t
  misc_feature 237: m=a or c
aatttctgattgagaattgccttaggatatttggagaagaaatcacttccctcttcagagaggtttcagtgagatgtgacactagagagaatgcctcagatatttcttgmwwwcaactgaatgactcvtcctatgacagcttggaaaatgagctaaatgaggatgttgatgcaccatgcagtgacttggtaaagaaacttggccaggggagcagaagcatggactctgtcttaavnmtcagtgactatgatcttgaccagcccgaggtggaaggccttttaaccctaagcgactttgacttggccca

SEQ ID NO: 18645 - DNA, 88 bp, Homo sapiens
agaaaatgaaggaactttatttttagtaactttgtacagaaaccttgctaggttctaccccttttttttttttttttttttttttttt

SEQ ID NO: 18646 - DNA, 117 bp, Homo sapiens
  misc_feature 62: m=a or c
gtccttagcgggagcccgagtgcgggcggtggcgggcttggcggcggggcaggattccaggmaggagccttgcctctcaggtggcgggctctgcgaccctgcgagatggacgggaca

SEQ ID NO: 18647 - DNA, 64 bp, Homo sapiens
gagtgcgggaatccgccgtttgcgctgaggcaatggcggcagctgcgccggtggccgcggacga

SEQ ID NO: 18648 - DNA, 215 bp, Homo sapiens
  misc_feature 112: k=g or t
tattacttaaacttgcggtttgtcagaaagtggcttttatttatttatttatttatttatttatttttattatactttaagttttagggtacatgtgcacattgtgcaggtkagttacatatgtatacatgtgctattgctggtgcgctgcacccactaactcgtcatctagcattaggtatatctcccaatgctatccctcccccctcccacct

SEQ ID NO: 18649 - DNA, 145 bp, Homo sapiens
  misc_feature 64: s=g or c
tggtttcaggtcttaaatgtaagtctttgctccattttgagttgatttttatatgaggtgagasatggggatccagtttaatcttctacatgtggcttgccagttttcccagcaccgtttattgaataggtatcctttccccaat

SEQ ID NO: 18650 - DNA, 167 bp, Homo sapiens
gggactacaggtgcgcgccaccacgccaggctaatttcttatatttttagtagagttggggtttcaccgtgttagccaggatggtctccatctcctgacctcgtgatctgcgcacctctgcctcccgaagtgctgggattacaggcgtgagcactgcgcccggcctt

SEQ ID NO: 18651 - DNA, 270 bp, Homo sapiens
  misc_feature 125: n=a, g, c or t
ggattggcattaattctttatatgtttggcagttttcactagtgaagccatttgggctagggtttttctttttgggaagcttttacagtattaatgtaacattttgttatgtgtcttcagatttnctaattcttcttgagtcagttttcgtagtttgtgtttttctaggaatttgtttcatctaagtgtctaactcattggcacaccgttgttcatatattttcttataatcctcattatttataaaaagtccttaataacatccccctc

SEQ ID NO: 18652 - DNA, 138 bp, Homo sapiens; identical to SEQ ID NO: 18293

SEQ ID NO: 18653 - DNA, 362 bp, Homo sapiens
  misc_feature 128: s=g or c
  misc_feature 129: m=a or c
  misc_feature 169: y=c or t
cctggccaacatggtgaaaccccatctctactgaaaatacaaaaattagccaggcatggtggcaggcacctgtaatctcagctactcaggaggctgaggcacaagaattgcttgaatccgggaggcgsmagttgcagtagtgcaatctcggctcactgcaacttccgcytcccaggttcaagtgattctcctgcctcagtctcctgagtagctgggactagaggcatgtgccaccacactcagctaatttttgtattttttgtagagaccgggtttcagcatgttggccaggatagtctcaatctcttgacctcgtgatccgcccacctcagcctcccaaagtgctgggattacaggcgtga

SEQ ID NO: 18654 - DNA, 210 bp, Homo sapiens
  misc_feature 61: n=a, g, c or t
  misc_feature 62: s=g or c
  misc_feature 90: m=a or c
  misc_feature 101: h=a or c or t
  misc_feature 154: w=a or t
  misc_feature 156: w=a or t
  misc_feature 174: w=a or t
  misc_feature 186: h=a or c or t
  misc_feature 187: m=a or c
  misc_feature 202: w=a or t
tattttctcttttgctgctgcacctccaagcatggtgtcccagtgaccatatctagatgansatgactgggaagaaagggttgagtttgmgttgagtcaghagtcaaatggggacccaaattactattagtaaaggtaacaatattttctgcawtwcagaggtagtttctatawtatatgcaagthmctttgatgcataaawatgttttt

SEQ ID NO: 18655 - DNA, 83 bp, Homo sapiens
aaatggttaagagatacataaatactgcagtagagatgggattttacctcaaagtgcaaaggtaaatgaaataaagttttttc

SEQ ID NO: 18656 - DNA, 110 bp, Homo sapiens
atcaaatttaaggacgtttctgtcatatatatgagctatgccaagcttgttcaacttgcggcctgtgagctggcagcatgcagctgaggatggctttgaatgcggccgct

SEQ ID NO: 18657 - DNA, 308 bp, Homo sapiens
  misc_feature 123: y=c or t
  misc_feature 124: y=c or t
ttttattttttaagagatgaagtcttgccatgttgtccaggctggtctcaaactcctgggctcagccaatccacacaccttggcttcccaaagtgctaggattataggcatgagccactgcayycaacctagttttgatctttctatgcctactttgttgagattttttttttatcatgaaggggtgttgaattttattaaattctttttctatctctattgagtggatacaggcactgcatcttaccacatcaaaaaggaacaactgaggaagctaaaacactgagttttgtgtctccccccttcaa

SEQ ID NO: 18658 - DNA, 88 bp, Homo sapiens
atcatccggaatggaatggaatggaatggaatggaatggaatggaatggaatggaatcaacccgagtgcaatggaatggagtggacac

SEQ ID NO: 18659 - DNA, 258 bp, Homo sapiens
accagctctggctgtcagatgtttaattttgattttgcttctctacaaagacagcagctttaggaatcaggcttcggttgagaaagagaaagcacctccaacccccaaagctctccttctgcatcagagaagctgcaaggatgcctcaagagaccagccgccagcacaggcctcaaaggcaggtgcacccctgcgaggacgcatggctcgggtggctcctgggagcctctggaaggggcgtcatcagccctgcccacc

SEQ ID NO: 18660 - DNA, 123 bp, Homo sapiens
aaagacaatttggtctgtaggactagtacactttgtattgacttttcattcttggatgagttgttgctgtgatcattgattcatttatgtgtattgtgttctttccagtgttgcaaatgggga

SEQ ID NO: 18661 - DNA, 129 bp, Homo sapiens
aaaagaaaaagaaaaaagaaataaaaaatccaaattagaaaagaggaagtcaaattatttttgttcactgatgatatgatcttatatctggaaagccctaaagactcctctttctatttggatatgttt

SEQ ID NO: 18662 - DNA, 145 bp, Homo sapiens
  misc_feature 15: y=c or t
  misc_feature 16: w=a or t
  misc_feature 125: m=a or c
tgggctactcatggywagataagacttacacttctgaaagaggccttagagtttcatgaagtgctgggttctcagctacatgtggcagagtgcatctctgggttttagtaacaggattaaatctmacttgagacctccagcaggc

SEQ ID NO: 18663 - DNA, 275 bp, Homo sapiens
actaaaatacctcagcctcttcttccccagggtggatgggtggtggggatgggcaaggatcaagatcaccaaaatgtggaaatttgttgaagctgggatgagtacccaggagtctattatgtctactctggtgaatgttggaaaagtggcaaaattaaaagtaaaaaatttgagagaataggatagatgaaccatttgttctttttaatagtaactgatgttttcaacaaagatgcttattcatcacctatattaattaacagggttttttttgt

SEQ ID NO: 18664 - DNA, 172 bp, Homo sapiens
caaagaagaaaaaaaattagccaggagtagtggtggacacctgcagtcctggctacttgggaggctgaagcagaagaatcacttgaacccaggaggcagaggttgtagtgagccgagatcgcgtcactgcactccagcctgggtgacagaatgagactccatctcaaaaaaa

SEQ ID NO: 18665 - DNA, 194 bp, Homo sapiens
tactaaaaatgcaaaaattagccaggcataatggcacgcccctgtaatcccagctactcaggagactgaggtaggagaattgcttaaacccgggaggcagaggctgcagtgagccgagattgcactactgcactccagcctgggtgatagagcaagaccccgtcttggaaaaaaaaaaagttaaaaataaataa

SEQ ID NO: 18666 - DNA, 169 bp, Homo sapiens
  misc_feature 38: w=a or t
  misc_feature 60: w=a or t
  misc_feature 71: w=a or t
  misc_feature 118: w=a or t
  misc_feature 131: w=a or t
  misc_feature 140: w=a or t
ggattacaggcccctgccaccatgcccagctaattttwgtatttttagtaaaggcggggwttcaccatgtwggccaggctggtctcaaactcctgacctcaagtgatccacatgcctwagcctcccaaaawgctgggctwacagccatgagcctctccacctggccgat

SEQ ID NO: 18667 - DNA, 336 bp, Homo sapiens
  misc_feature 37: k=g or t
  misc_feature 38: k=g or t
  misc_feature 335: d=a or g or t
  misc_feature 336: m=a or c
ctgtatctttccaggaattcgaacgtctcctttaggkkttctagtttatgcatgtaaaggtgttcatagtagccttgaataatcttttgtatttctgtggtatcagtaatagtatctcctgttttgtttctaattgagtttatttgcacttctctcctcttttcttggttaatcttgctaatggtctatcagttttatttatcttttcaaagaaccagctttttatttcatttagcttttgtatttttttgcagttgttttaatttcatttagttctcctcttatcttagttattccctttcttttgctgggttttggttctgtttgtttttgtdm

SEQ ID NO: 18668 - DNA, 245 bp, Homo sapiens
  misc_feature 111: y=c or t
  misc_feature 112: d=a or g or t
  misc_feature 113: k=g or t
aataggtcctaaattttgtcatgctgtcagagcacccacacatagacatttaacttagcttttatgtagattaaacccctacattagaagagtttacaacaaagatggtgydkcttccttttgctttctgaggacacctactctgtatctgagtaactttcaataaactatctccttctcactgcactctgtgactcacctttaatttcttcctgtgcaagatccaagaatactcttttggggtc

SEQ ID NO: 18669 - DNA, 185 bp, Homo sapiens
gttcttgtcaggacttaaattttctaatcattctgataaatacctaggtgtgtgatggttaaatcatatcatttagctttgtaagaaatcaccaaactgtcttccaaagtgcctgtgccatttttgcattattataccagcaattaataagagtccttgttattctgtgtttgctgatcatatat

SEQ ID NO: 18670 - DNA, 126 bp, Homo sapiens
  misc_feature 87: y=c or t
atgtgaaaaagaaaagggggccgggcgtggtggctcacacctgtaatccgcactttcggaggccgaggcggacggatcacttgaggycaggagttcaagaccagcttggccaacatggcaaaaccc

SEQ ID NO: 18671 - DNA, 86 bp, Homo sapiens
  misc_feature 16: y=c or t
ataggtttttttcccytaagattttccttatataagatcatgccattgcaccccagcctgggcgacagagcaagactccgtctcaa

SEQ ID NO: 18672 - DNA, 173 bp, Homo sapiens
ccacaaacacaaagtggcttcccatttggatctttataagtttctttctgtaatgttttataattttcagtgcacaaatcttgcacctcttggtttaaatttattcctatgtattttattattttttatgctattataaatagaattgttttcttttttgacttttttttttt

SEQ ID NO: 18673 - DNA, 112 bp, Homo sapiens; identical to SEQ ID NO: 17258

SEQ ID NO: 18674 - DNA, 111 bp, Homo sapiens
  misc_feature 36: k=g or t
  misc_feature 82: h=a or c or t
  misc_feature 102: w=a or t
atttacttttcattgcatgggacttttaaaagaatkatccccttcaagggtgtgactgtaatgtatgttgtgaatggttgthtggcttcaattctgggtgcwatcagaact

SEQ ID NO: 18675 - DNA, 172 bp, Homo sapiens
  misc_feature 143: y=c or t
  misc_feature 149: k=g or t
  misc_feature 150: k=g or t
atttttttgagacagagtattgctcttgtcgcccaggctggagtgcagtgatgcaatctcgggtcattacaacctccacctcccaggtccaagcgattctcctgagtagctgggattgcaggcatgtgccaccatgcccagcyaatttkkgtatttttagtagagacgggga

SEQ ID NO: 18676 - DNA, 117 bp, Homo sapiens
cttgggaggctgaggcatgagaatcacctgaatccagaggcggaggttgcaatgagccgggatcggaccactgcactccaactccagcctgggtgacagagtgagactcttgtctca

SEQ ID NO: 18677 - DNA, 288 bp, Homo sapiens
  misc_feature 127: w=a or t
  misc_feature 131: r=a or g
  misc_feature 132: w=a or t
  misc_feature 135: w=a or t
  misc_feature 138: k=g or t
  misc_feature 143: w=a or t
  misc_feature 146: k=g or t
  misc_feature 147: k=g or t
  misc_feature 148: n=a, g, c or t
  misc_feature 157: w=a or t
  misc_feature 239: n=a, g, c or t
  misc_feature 240: n=a, g, c or t
attttagggctatataaattgtgtttttagtgtaaaatgttatttgataatgtgaagttaaatcccttttagaaagtgactgaaaatggtaaaggaactcatcagaatcttagcgttcttaagttcwctgrwaawttkagtawatkknattaatgawgtccaacacctctaagattgttgagaaaacatgaagaattgaggttactcttctcaggtgacactttaaatattaaaatcannggcttcctgaacaaaacaaattgcaaaatagcgataatggcaggggtt

SEQ ID NO: 18678 - DNA, 74 bp, Homo sapiens
cttacaggcaaatagcagaaaccccacctctgcagggatttgcatctcctgccttcaagagagtacaatgcagt

SEQ ID NO: 18679 - DNA, 117 bp, Homo sapiens
  misc_feature 8: y=c or t
  misc_feature 21: k=g or t
  misc_feature 58: b=c or g or t
  misc_feature 63: y=c or t
  misc_feature 90: y=c or t
  misc_feature 101: y=c or t
  misc_feature 105: y=c or t
tttttagyagagatggggttkcatcatgttgaccaggcttgtctcaaattccagaccbcaggyaatcagcccgccttggcctcccaaagygctgagattayaggyatgagccaccgt

SEQ ID NO: 18680 - DNA, 218 bp, Homo sapiens
  misc_feature 133: r=a or g
tataaatcgactgtacactggtattcagtgttactcttgtggaatgaggtttacaacatcacagacagatgtttatgcagatcatttggactggcattatcggcaaaatagaactgaaaaggatgttagccgraaaaggtcactcatagacgttggtactacagtttaacagactggatagaatttgaggagatagctgatctggaagaacggggcaa

SEQ ID NO: 18681 - DNA, 163 bp, Homo sapiens
  misc_feature 68: y=c or t
  misc_feature 71: m=a or c
  misc_feature 72: m=a or c
  misc_feature 80: s=g or c
  misc_feature 81: m=a or c
  misc_feature 90: k=g or t
  misc_feature 111: m=a or c
  misc_feature 121: m=a or c
  misc_feature 131: m=a or c
ttggcatagattggaatgcaatggaatggaatcaacccgagtacaggggaatggaatggacatggaaygcmmtggaatgsmatcatccgkaatggaatggaaaggaatggmatggaatggmatggaatggmatcaactcgattgcaatcgaatggaatggaat

SEQ ID NO: 18682 - DNA, 167 bp, Homo sapiens
  misc_feature 19: b=c or g or t
  misc_feature 132: m=a or c
  misc_feature 135: w=a or t
  misc_feature 138: r=a or g
cgggaggctgaggcgggabaatcgcttgaacctgggaggcggaggttgtagtgagctgggattgtgccattgtactccagcctggagacggagcgagactccgtctcaaacaaacataaaaatctgtcatamttwacraccttatgttaatgaaaaacgagagaatt

SEQ ID NO: 18683 - DNA, 100 bp, Homo sapiens; identical to SEQ ID NO: 17371

SEQ ID NO: 18684 - DNA, 223 bp, Homo sapiens
  misc_feature 129: m=a or c
  misc_feature 133: y=c or t
  misc_feature 180: b=c or g or t
ttttattttattttttgagactgggtctcgctctgtttcccaggctggtggacagtggtactagtgctacttgggaggctgaggctggaggatggcttgagctcagaagtttcaggctgcatggctcamtgcygggctcaatgcagcctggaattcctgggctcaaatcatcctccagcbtcagcctcccaagtagctgggaatacaggcatgcaccgcaaca

SEQ ID NO: 18685 - DNA, 265 bp, Homo sapiens
  misc_feature 135: r=a or g
  misc_feature 137: m=a or c
  misc_feature 148: h=a or c or t
tgtgggtagcacacctgagtgcttatcattgcaaaattatgtatatacaattttattgtataaagtagcccacaaagtgttctgttgtgtttttatgtttctaaactcttttaaaaatgtaaatatgtttaaagramcttttagaathatttttatcagaattatgtatttggggttttgatctttcaggattcaacactggggattatgggatcagaaactatcttttgggattctggcccaaacctctagccttgtaccctct

SEQ ID NO: 18686 - DNA, 102 bp, Homo sapiens
catcgatggtctttacaatttggcatgtttttgcagtggctggtaccagttgttcctttccatgtttagtgcttccttcaggagctcttttagggcaggcct

SEQ ID NO: 18687 - DNA, 100 bp, Homo sapiens
acttccggctcggccgaggcactgcggacggcttccgggtttgggcctggctctgtgactgaggcggcggcggtggcggccaagcgggatacgggcggtc

SEQ ID NO: 18688 - DNA, 162 bp, Homo sapiens
  misc_feature 123: y=c or t
accgctttttttttcttttgagatggagtcttgctctgttgcctaggctggagtgcagtggcatgatctcggctcactccaacctctgccttccaggttcaagcgattctactgccttagccyccctagaagctgagattacaggtgcatgccaccacgccc

SEQ ID NO: 18689 - DNA, 107 bp, Homo sapiens
  misc_feature 9: k=g or t
  misc_feature 13: y=c or t
  misc_feature 14: k=g or t
  misc_feature 29: y=c or t
  misc_feature 35: k=g or t
  misc_feature 37: k=g or t
  misc_feature 40: d=a or g or t
  misc_feature 49: y=c or t
  misc_feature 67: y=c or t
accgctttktttykcttttgagatggagycttgckckgtdgcctaggcyggagtgcagtggcatgayctcggctcactccaacctctgccttccaggttcaagcgat

SEQ ID NO: 18690 - DNA, 68 bp, Homo sapiens
ctgggtcctggtttttgaaggatacttatttgcagaagttgtacaaagtgcagacagtcctgaccaac

SEQ ID NO: 18691 - DNA, 103 bp, Homo sapiens
aatcacagctcattgaagcctcaaactcctgggctccaggaatcctcccaccacagtctctcaaatacttgggactacaggtatgcaccaccacacccgacca

SEQ ID NO: 18692 - DNA, 227 bp, Homo sapiens
  misc_feature 129: n=a, g, c or t
cacagtccactcttattactatatagtcttgaaatataatttgaaattataagtatgatatccttctgccttgttccttttcctcatgattgctttggctattcaaagtttattttaatttcatgtaanttttagaattgtattttccattactgtgaaaaaatacaactgcaatttagataagaagtttcttcaatctatagatcactttggataacatggtgcca

SEQ ID NO: 18693 - DNA, 97 bp, Homo sapiens
  misc_feature 60: s=g or c
  misc_feature 61: m=a or c
  misc_feature 69: s=g or c
  misc_feature 70: m=a or c
aggaggaaaaagatgattcaaatgaagaagaaaacaaagacagccttgtagatgatgaasmagagaaasmagatcttggcgatgaggatgaggcaga

SEQ ID NO: 18694 - DNA, 108 bp, Homo sapiens
  misc_feature 97: w=a or t
aacggctctgaccgtctggcaggccgcgtggcgcccgcgccggccttcctgcaggggactccaccggagccttgccaattccgtttgtttccctgtwgtcgcccgctc

SEQ ID NO: 18695 - DNA, 128 bp, Homo sapiens
  misc_feature 33: k=g or t
  misc_feature 39: k=g or t
  misc_feature 55: w=a or t
  misc_feature 90: w=a or t
  misc_feature 107: w=a or t
aataggagataaatttagggttggtttaccttktttgtkttttttacttttattwactttttttaatttttgtagagacaggatcttgcwaggttgcccaggctggwctcaaattcctggcctcaagc

SEQ ID NO: 18696 - DNA, 190 bp, Homo sapiens
  misc_feature 128: k=g or t
catatgtaggcccatgttgtgtatgctttgaagacatgtcctgcattcaaactcatttgtattatgttattattgaatttgccccatttattggaattataaactgcaatcccccaactacaagaaaktatgagctctgatgagataagagtaaagatgaatcagaagtgaaaacagtcctccaaccccc

SEQ ID NO: 18697 - DNA, 84 bp, Homo sapiens
  misc_feature 59: r=a or g
aggctgcgagcgagccgcgaaccgagcgggcggcgggcgcgcgcaccatgggggagaarcccgggaccagggtcttcaagaagt

SEQ ID NO: 18698 - DNA, 137 bp, Homo sapiens
  misc_feature 122: y=c or t
  misc_feature 133: r=a or g
  misc_feature 136: r=a or g
atcggggagcgcccaagggcgatggttcccggctcctggagaggcgtgcgaagttaagccggatgggaaggccattgtgactatgtggtgattacagttgtcttactactgagtttcctacygaaaatcatgragra

SEQ ID NO: 18699 - DNA, 247 bp, Homo sapiens
  misc_feature 104: n=a, g, c or t
  misc_feature 105: n=a, g, c or t
  misc_feature 135: w=a or t
  misc_feature 152: w=a or t
aattgttgaagctgggaatggtggggggttcatgatactattcttaataattttggattagtttgaaattttccataataaaaaacttagaaaaaatgtcatgnnacattattgaaagaggatctctgcagcacwaggtgacactggtgtawaaaatgtataaaatgtgttcagaaggatggatgtgagtaacacacaggtgttaaacgcacctaacgtgtaaatgtattttgtttttcttcagagc

SEQ ID NO: 18700 - DNA, 124 bp, Homo sapiens
  misc_feature 102: m=a or c
  misc_feature 106: d=a or g or t
agaatcttgtcaaggtaataataaaaagaggccagttctcaaacagttaaagaccccagaaacatgataaacactttagtgcacactgtgtacaggagggamagcdagagggcaggacttgaca

SEQ ID NO: 18701 - DNA, 158 bp, Homo sapiens
cattgtttaaaaattattctttaatttctgggatacatgtgcagaacgtgcgggtttgttacataggtatacacgtgccatggtggtttgctgcacccatcaatccatcatctacattaggtatttctcctaatgctctccctcctcttgcccccaca

SEQ ID NO: 18702 - DNA, 51 bp, Homo sapiens
  misc_feature 28: k=g or t
  misc_feature 29: r=a or g
  misc_feature 30: m=a or c
ggctgcaatgagccgagatcgcaccackrmactccagtctggcaacagggt

SEQ ID NO: 18703 - DNA, 142 bp, Homo sapiens
tggaaaaatgagctgtcgtcatgaaaaatgaggccaaaaaggctgggatttccctttgctaataaaatgctcaggcttctggaatttctttgtagatgccaatttttagtgacttgagtgaaatgggtggaggttgagggat

SEQ ID NO: 18704 - DNA, 230 bp, Homo sapiens
ttttaggggggtttggttcgtttttgaactgtatacagatgaaattatacagaatgctttttttttggtatatggcctttttcactctgtagtgtatttgtgagattcatcatgttgtattgtgtagttgtggttcattctgtttgctgtgcagtatactattttgtgattattcatacaatagaacatattacatatttatgtatccattctaccattctactgtgtgt

SEQ ID NO: 18705 - DNA, 126 bp, Homo sapiens
cacttttcatattgttaggtattgacagtggctgtaccaactcccacattagtggagtagtttgtgagaatttgtttcccacatcttttcaacatttgctgttagatttcctaattgttgctagtc

SEQ ID NO: 18706 - DNA, 134 bp, Homo sapiens
  misc_feature 49: s=g or c
  misc_feature 54: k=g or t
  misc_feature 57: h=a or c or t
  misc_feature 126: m=a or c
atttcttcgcggcgcgggcggggctgggcgcggggtgaaagaggcgaasgagakcghaggccgcactccagcactgcgcagggaccgccttggaccgcagttgccggccaggaatcccagtgtcamggtggaca

SEQ ID NO: 18707 - DNA, 152 bp, Homo sapiens; identical to SEQ ID NO: 18217

SEQ ID NO: 18708 - DNA, 136 bp, Homo sapiens
tctttgtatggcaatgtatatagatttttttaaaagaataaatgttgttttgcaaatgtaggttcttagagtccacccagggaattttttatctgtctagtctgaacctgaggtggtaagagattaaaaaatgctt

SEQ ID NO: 18709 - DNA, 216 bp, Homo sapiens
  misc_feature 146: n=a, g, c or t
  misc_feature 148: r=a or g
  misc_feature 162: d=a or g or t
  misc_feature 171: w=a or t
  misc_feature 173: d=a or g or t
  misc_feature 174: w=a or t
ttcttatggccgagtgcggtggctcacgcctgtaatcccagcactttgggaggctgaggcgggcagatcacgaggtcaggagatcgtgaccgtcctggctaacacggtgaaaccccgtctctactaaaaatacaaaaaaattagcnarggcgtgaatgggtdgggcgcccwgdwgtcccagctacttgggaggctgaggcaggagaaatggtgtga

SEQ ID NO: 18710 - DNA, 146 bp, Homo sapiens
acagaattagcaccatgtgggaaccagcaatgcttacaatttgcacccttcataggagcagttaggtccacttgagatacagctggggctgccaggcagcactgtactagaatgcagggatcacagtcccaagacagctctgagca

SEQ ID NO: 18711 - DNA, 133 bp, Homo sapiens
  misc_feature 32: k=g or t
  misc_feature 76: k=g or t
  misc_feature 78: w=a or t
  misc_feature 86: r=a or g
  misc_feature 87: r=a or g
  misc_feature 115: r=a or g
tagagtttcctagatgtattataatgtgtttkatttgacagtgtttcaatttgcatatacagtactgtatattttktwcttatttrrtttgaataattttcctattaccaaataraaataaatttatttttac

SEQ ID NO: 18712 - DNA, 190 bp, Homo sapiens
  misc_feature 143: m=a or c
ttaaaaccatcacactacattagcctcagttttctgttccataaagtgggaaagtgatatttcatagtggctcagtaatggtagtaattaaattattctgatgattataattttttatcataatcattatcatctcttaagamcttttacgttcaaccaaattttctgatgcatgaaattctccccacac

SEQ ID NO: 18713 - DNA, 189 bp, Homo sapiens
  misc_feature 126: k=g or t
  misc_feature 127: w=a or t
  misc_feature 131: r=a or g
aggccaaggtgggaggattgcttgaggccaggcagttcgagaccccatctctatttaaaaatacacacacacgtgtgtatgtgtgtgtataaagattatgtaagcagcctattaataagttcctakwtaaraattttaaacacttgcaccaaagccttttagtccctcttccccacccttcaccccact

SEQ ID NO: 18714 - DNA, 145 bp, Homo sapiens
  misc_feature 117: s=g or c
  misc_feature 121: y=c or t
  misc_feature 125: m=a or c
tgtgcagaacgtgcaagtttgttacataggtatacatgtgccatggtggtttgctgcatctatcaacccgtcatctaggttttaagccccacatgcattaggtatttgtcctgatgstctycccmacccatgcccctcaccccct

SEQ ID NO: 18715 - DNA, 106 bp, Homo sapiens
agctagaaacaagttgtgtgcctgaatgttcacgattcccctctgctccgctccctccatcttaatgcaccttttaggtttccttaacaatagcagttttaacatt

SEQ ID NO: 18716 - DNA, 107 bp, Homo sapiens
  misc_feature 62: y=c or t
cgcttcctgttgtcagtggccgagagaccgcatcgtcggctcggaggctgaggggctgccgyggccgggagcgcccctcgcctcgctcctcgctccgcttggtgtca

SEQ ID NO: 18717 - DNA, 111 bp, Homo sapiens
tatacatgtgccatgttggtgggctgcacccattaactcgtcatttaacattaggtatatctcctaatgctagatgatgagttagtgggtgcagcgcaccagcatggcaca

SEQ ID NO: 18718 - DNA, 108 bp, Homo sapiens
gagtttgcagagacacggaggaggagagagcctgtgctttgcctgccgccgcggctgggggagatctggcttttgcaacagcccaccccctttgagatcactctggcc

SEQ ID NO: 18719 - DNA, 140 bp, Homo sapiens
  misc_feature 40: w=a or t
  misc_feature 113: w=a or t
  misc_feature 115: y=c or t
  misc_feature 121: y=c or t
taattttcaagatggcagcagatccagaatgcttagatgwggggctggctgccatggtctgcaaagaattgactctcatgactgaagaagaaacacgattaagagagtctgtwgyacagayggttgagtttgctgagcac

SEQ ID NO: 18720 - DNA, 421 bp, Homo sapiens
  misc_feature 121: n=a, g, c or t
  misc_feature 273: y=c or t
  misc_feature 377: k=g or t
  misc_feature 378: b=c or g or t
  misc_feature 381: n=a, g, c or t
atttttgtatttttagtagagatgtggtttcactatgttaactaggctggtctcgaactcctgaactcaagtgatccacccaccttggcctctcaaagtgctgagattacaggcctgagcnactgtgccctggatgacctaatgaaaaatttctcagaaggtatccccatcttaaagcaatacatgactgtacttctgcaggatctttgcagaatactaagttgttgtgttaaaggtaagaataagatatgtttgggcactactagcaatacyatctaacactgttctagagttctcaatgttgactattgaaatttcagctagataattctttactgtgggagcagttctatgcaatgtagggatgtctaaagcakbtantccctggcctttaccactagctgttcaatagaatccctgc

SEQ ID NO: 18721 - DNA, 84 bp, Homo sapiens
cggaatagaatggaatggaaagaattttaatggaatggaattgaatggagtggaatggaatggaatggaatcaacgagattgca

SEQ ID NO: 18722 - DNA, 270 bp, Homo sapiens
  misc_feature 126: s=g or c
  misc_feature 127: m=a or c
  misc_feature 187: n=a, g, c or t
agtttcgttcttgttgcccaggttggagtgcaatggcgtgatctcggctcactgcaacctctgcttctgggttcaagtgattctcctgcctcagcctcctgagtagctgggattacaggcacctgsmaccacacctggctaatttttgtatttttagtagagatggggtttcaccatgttggccagncttgtctcaaactcctggcctgcctgggctgcaggggttggggtgggtgatggtttgggaagtcataatcagttgaacccaga

SEQ ID NO: 18723 - DNA, 197 bp, Homo sapiens; identical to SEQ ID NO: 18319

SEQ ID NO: 18724 - DNA, 131 bp, Homo sapiens
ggactacaggcgtgcactgccacgcccggctaatttttttatttttagtagagatggggttttgccatgttggccaggctggtctcaaactcctgaccttaagtgatccacccccacccccccgccccaat

SEQ ID NO: 18725 - DNA, 131 bp, Homo sapiens
  misc_feature 10: w=a or t
  misc_feature 11: w=a or t
  misc_feature 114: m=a or c
  misc_feature 124: s=g or c
aaaaaaggawwtaacaggccaggtgtggtggctcatgcctgtaatcccagaattttgggaggccaaggcaagcagatcatttatggtcaggagttcgagaccagcctggccaamatggtgaaasccccgtc

SEQ ID NO: 18726 - DNA, 249 bp, Homo sapiens
  misc_feature 120: r=a or g
  misc_feature 131: r=a or g
  misc_feature 135: s=g or c
  misc_feature 136: y=c or t
  misc_feature 168: w=a or t
  misc_feature 181: m=a or c
  misc_feature 209: m=a or c
  misc_feature 210: m=a or c
cagatggcccttcctttggtgcatgaaaaactgtacaatgaggttcagcacagccagcatcagccgagcttttttgtgaaactcagatcagccacccaggaggaaagagcgggctgaggraaacccagaarggasycaagctctgagaccaaaagttgaccctcgggwagggttgtcctgmctggggccccacttgaaggaggcaggammgaggcaccgaggccagggagacgcccaacgaggcagccc

SEQ ID NO: 18727 - DNA, 107 bp, Homo sapiens
  misc_feature 20: r=a or g
  misc_feature 39: h=a or c or t
  misc_feature 80: w=a or t
  misc_feature 90: w=a or t
  misc_feature 97: w=a or t
atacttacctggcaggggarataccatgatcacgaagghggttttcccagggcgaggcttatccattgcactccggattwgctgaccccwgcgattwccccaaatgt

SEQ ID NO: 18728 - DNA, 106 bp, Homo sapiens
  misc_feature 3: m=a or c
  misc_feature 11: y=c or t
  misc_feature 17: y=c or t
ggmaaattggyaaatgyattaaaaggatggcatatttggatcaagtgattggttatgctcatctatcccacctgtaccttaggctctgattaggacttagaatact

SEQ ID NO: 18729 - DNA, 110 bp, Homo sapiens
  misc_feature 10: y=c or t
  misc_feature 28: w=a or t
  misc_feature 34: w=a or t
  misc_feature 65: w=a or t
  misc_feature 66: y=c or t
  misc_feature 70: y=c or t
  misc_feature 72: w=a or t
  misc_feature 75: y=c or t
ttttctttcyagttcaatccttgttgcwctattwgttcattttcttgctgagttcatattatgtwytatygwggyaaaatatatgtaacaaaatctaccattttaactat

SEQ ID NO: 18730 - DNA, 126 bp, Homo sapiens
gaggaaactggccaggcatggtccctctcacctgtggtcccagcactttgggaggctgaagcgggcagatgccctgagcccaggagttcgagaccaggctggacaacatggtgaagccccatctaa

SEQ ID NO: 18731 - DNA, 154 bp, Homo sapiens
tgtagagttcctggagcacagttaaatgttctgtctttgtatatttggtttaatttttctaaacaaaacaactttggtaatagcagcagcgtattagaatctaaaatacgcctttgttcttttaaaagataacattaaagagatttttgcggga

SEQ ID NO: 18732 - DNA, 251 bp, Homo sapiens
  misc_feature 122: b=c or g or t
  misc_feature 236: n=a, g, c or t
  misc_feature 237: n=a, g, c or t
ttattggtaagcttaaaatcttgggttctgggctgggcgtggtggctcacgcctgtgatcccagcgctttgggaggctgaggtgggcagatcatgaggtcgggagatcgggaccatcctcabcctcccaagcagctgggactacaggcgcatgcaaatgagctaagttttgtattttttgtagagatgaggtttgccatgttgcccagactggtctctaacaaataaattaaacannttcctgacacaaga

SEQ ID NO: 18733 - DNA, 242 bp, Homo sapiens
aaacacccatcaagccttcacattattggcatgtataagattctgttaggtcaagtggcatcctccttaccctttttctgaggatgaccatgtgttaattgctacagaccagaactgtcttcctgaaagttgtccagggctgtgggaaaaaagttgaatatttcagtgcaagttctattgacactaaagctaacactgaatcactcacttatcccagcctatgctttttttttttttttttt

SEQ ID NO: 18734 - DNA, 389 bp, Homo sapiens
  misc_feature 257: n=a, g, c or t
  misc_feature 258: n=a, g, c or t
taatgacttgatgtttttgtgttggcagaaaatagtatctaaactttgtattacatttactttattgaccctgtaagaagagcccaaagaagcctagtgtttgagggttcgcttactgttgaattgtggcatttgatcacttgtaaatgactcagggggattttactattgaaagatgttggcaccatttttttcccctcattcttttaacacttttgctattcctgaaacctggtagaaaaccattatctcgaagnnagtgttagttttcaagcgaagtataagataaagggcttctttgtatgtacatattcttggaagaagggaattattgcctttgacctaaaaggaagaggctgaggcacaaaatatatttgaagagtttactt

SEQ ID NO: 18735 - DNA, 127 bp, Homo sapiens; identical to SEQ ID NO: 18153

SEQ ID NO: 18736 - DNA, 397 bp, Homo sapiens
  misc_feature 351: n=a, g, c or t
  misc_feature 352: n=a, g, c or t
  misc_feature 353: k=g or t
tccctttgcttttgctgttttagacatgaggtccttgcccatgcctatgtcctgaatggtattgcctgggttttcttctagggtttttatggttttgggtctaacatttaagtctttaatccatcggaattaatttttgtataaggtgtaaggaagggatccggtttcagctttctacatatggctagccagttttcccagcaccatttattaaatagggagtcctttccccagtgcttatttttgtcaggtttgtcaaagatcagatggttatagacgtgtagtcttatttctgaggactctgttctgttctattggtctatatctctgttttggtaccagtaccatgcnnktttggttactgtagccttgcagtatagtttgaagtcaggtagtt

SEQ ID NO: 18737 - DNA, 242 bp, Homo sapiens
  misc_feature 132: w=a or t
  misc_feature 144: w=a or t
  misc_feature 147: w=a or t
attactgtctttcatgctcaattttttttaaattaaagcattagttggtagcccatgcaattctgtaggagttgtcatttaatggcattttttatttctggtttatcttttaataagaaaccctgctgatcwgcctttcatttwtcwtcagaagtaactcagctagaagatgaataccaattacagttttctggggtgagctagaaggaaactggtaagcttggaaagcttgtctatggccc

SEQ ID NO: 18738 - DNA, 155 bp, Homo sapiens
atcttcccgaccgcgagccgtccaggctggagtgcagtggctcagtcttggctcattgaaaccttcacctcctgggttcaagcgattctcctgcctcagcctcctgagtagctgggattacaaccgtctcagtgctgtgccccccccagagccta

SEQ ID NO: 18739 - DNA, 186 bp, Homo sapiens
aatatgaaagtgcacattttccaaaaaagtagccagccgtggtggcaggcacctgtagttccagctacttaggaggctgaggcaggagaatcccttgaacctaggaggtggagcttgcagtaagcccagatcaggccactgcactccagcctgggtgacagagcaagactccgtctcaaaaaaaaa

SEQ ID NO: 18740 - DNA, 301 bp, Homo sapiens
  misc_feature 257: k=g or t
tcttttgaagacagtatattgttgggtcttgcttctttatccaacttgccattctgtgccttttaattggggcatttggctcatttacattcaaagttgatactttgatatatgcaaatttaattctgtcatcatgttgctagctgtttattatgaagatttgattgtgtagtttctactttatagtgtcaatggtctatgtatttaagtgtgtttttgtggtggctggtaacagtctttaatttctatgtttagckctcccttctggacctcttgtaaggcacatctggtggtaacaaat

SEQ ID NO: 18741 - DNA, 114 bp, Homo sapiens; identical to SEQ ID NO: 18505

SEQ ID NO: 18742 - DNA, 97 bp, Homo sapiens
attgttctatcagctattcagagagttgtattaaagcctcccactatgattgtgaaattgactatcttttggttcttaatttttttttttttttttt

SEQ ID NO: 18743 - DNA, 151 bp, Homo sapiens
caaaaatataattgtgataatgcatgatagtagcagattaaaggagaaaaatcatgagatcatcttaacagctgatttggttaacattcagtattcattcttaatctcaaaaaggatatcaacaaaaaattatcacaaagcatcaaacttc

SEQ ID NO: 18744 - DNA, 214 bp, Homo sapiens
taagtgtttgaatattaaatgcagtagttcatgcctgtaatcccagcactttgggaggccgaggtgtgtggatcacaaggtcaggagttcaagaccagcctggccaagatgatgaaacctcctctctactaaaaatacaaaaattagccacgcacggtggcaggcgcctgtaatcccagctactcgggaggctgaggcaggagaatcgcttgaa

SEQ ID NO: 18745 - DNA, 63 bp, Homo sapiens
tagggaactgcaaatttaaacaacaacatgatacccactacatgtattagaatagccaaaatc

SEQ ID NO: 18746 - DNA, 187 bp, Homo sapiens
  misc_feature 14: k=g or t
  misc_feature 131: k=g or t
  misc_feature 168: y=c or t
cttttctttgtttkttgtctaacttttattttaggttcagtggtacatgtacaggtttattatataggtttattatataggtgtattatctgtacacttgcaccacaggggtttggtgtacagataatttkgttgcccatgcactaagcatagaaccgaataggtatytttttaaattatctcccca

SEQ ID NO: 18747 - DNA, 262 bp, Homo sapiens
  misc_feature 184: r=a or g
  misc_feature 188: r=a or g
  misc_feature 197: r=a or g
  misc_feature 203: y=c or t
  misc_feature 205: w=a or t
  misc_feature 206: y=c or t
  misc_feature 208: h=a or c or t
  misc_feature 214: w=a or t
  misc_feature 224: s=g or c
  misc_feature 228: r=a or g
  misc_feature 233: m=a or c
  misc_feature 238: m=a or c
  misc_feature 242: k=g or t
  misc_feature 243: k=g or t
tgtctctacaaaaaatacaaaaaattagccagatgtggtggcgggtgcctgtaatcccagctactcgggaggctgaggcaagagaatttcttgaacccaggaggtggagattgtagttagctgagatggagccactgcaccccagcccaggtgatagagcaagactttgtctcaaaaaaataarataraattaaggrccaacyawychtaaaawtaggccgagscggragggmccacmagakktctgtccaacatggtgaaa

SEQ ID NO: 18748 - DNA, 119 bp, Homo sapiens
gtgatgatgagattttttgttcttttttttattatactttaagttctagggtacatgtacacaatgagcaggtttgttacataggtatacatgttccctgttggtttgctgcaccctca

SEQ ID NO: 18749 - DNA, 207 bp, Homo sapiens
  misc_feature 106: s=g or c
  misc_feature 118: v=a or c or g
  misc_feature 121: y=c or t
  misc_feature 124: h=a or c or t
  misc_feature 132: m=a or c
  misc_feature 134: m=a or c
  misc_feature 145: m=a or c
  misc_feature 146: r=a or g
caggatgtgcaattttgttacataggtaaacgtataccatggtggtttgctgcacctatcaacccctcacctaggtgttaagcccagcatgcactagctattttgsctcaggctcttvccycchtaacctcmamccccatcaacmrgccccagtgtgtgttgttcccctccctgtgtccatgtgttctcattgttcagcccccacta

SEQ ID NO: 18750 - DNA, 338 bp, Homo sapiens
  misc_feature 93: r=a or g
  misc_feature 94: w=a or t
  misc_feature 119: w=a or t
  misc_feature 126: m=a or c
  misc_feature 133: v=a or c or g
  misc_feature 141: m=a or c
  misc_feature 212: m=a or c
  misc_feature 273: w=a or t
  misc_feature 274: m=a or c
  misc_feature 326: m=a or c
  misc_feature 331: m=a or c
gtgatatgatatgaattttaaaccttttcacactggaaactgattatacacagtagaaattatgtaatctgaattggtacaacttcctctgcrwgtaagtaaaaggagccatataccawaatttamtttccavtgacttamacaaaataagattatattgaattaataaattgggattttcattctttctttcatatttatactctttcatmtcagggtttcttgcacaagttttagatttttaattctgctggaagccgtataggcagattwmgtcaactatatctcttcatctgatagagagtttcccttccttccttccttcmctccmaccctct

SEQ ID NO: 18751 - DNA, 99 bp, Homo sapiens
catatttcttggaggctttgttcatttttttttactcttttttctctaaacttctctttttgtttcatttcattcatttgctcttcaatccctgacacc

SEQ ID NO: 18752 - DNA, 289 bp, Homo sapiens
  misc_feature 121: m=a or c
  misc_feature 124: w=a or t
  misc_feature 126: r=a or g
  misc_feature 130: r=a or g
  misc_feature 265: r=a or g
  misc_feature 266: d=a or g or t
ctccctccaccccacgacaggccctggtgtgtgatgttccccttcctgtgtccaggtgttctcattgttcaattcccacctatgagtgagaacatttgatgtttggttttttgtccttgcmatwartttrctgagaatgatggtttccagcttcatccacgtccctacaaaggacatgaactcatcctttttatggctgcataaggagtacatgtgaagatttgttatataggtaaactcatgccgagggggtttgatgtacatrdtatttcatcactcaggtactaaa

SEQ ID NO: 18753 - DNA, 233 bp, Homo sapiens
  misc_feature 16: d=a or g or t
  misc_feature 206: n=a, g, c or t
  misc_feature 207: n=a, g, c or t
  misc_feature 208: k=g or t
tagtttcagttcaatdgagtagcctggggggaacacacactaggaaacaacaggagtgctccaacatggagctgtgagatcacccttgaaggatgtcttgaaggaacaggtatcttccagacaaagaaaagttcccatagcaggaagggcatcctaggcaggtgaagtgaagcatgcagaggcccagagagagagcaatgtgatannkgtctttctgtgcctggcttatttca

SEQ ID NO: 18754 - DNA, 130 bp, Homo sapiens
  misc_feature 117: y=c or t
tatagatttttaatacacattgccttatattttttaaaaagtaagattaagaacttacttttttattatttactattactattattttcttttcctgtgattacctccactcagatytccaaagccttgt

SEQ ID NO: 18755 - DNA, 109 bp, Homo sapiens
caggttacacaaaatgagatgcaagtgtagggcagttcattgagtttcccacatttacagtttacattttggaagtggctaactaagcctgttagtagttttttttttt

SEQ ID NO: 18756 - DNA, 81 bp, Homo sapiens
ccgagtgcaatggaatggaatggaatggaatggaatggagtgaaataaactcgagtggaatggaatggaatggaatagaat

SEQ ID NO: 18757 - DNA, 107 bp, Homo sapiens
tggattaatacctagtagtgggattgcaggatcgtgtggtagttctatttttaattttttgagaaatctccaactgtttttcatagtagctgtactaatttacattc

SEQ ID NO: 18758 - DNA, 226 bp, Homo sapiens
  misc_feature 121: r=a or g
  misc_feature 125: b=c or g or t
gtgtgataactcaaaggcggggccgagggcttccaggccatagttagatttaaacatattcattctgattggcaattggttgaaagagtaattatcagtagaaaggaatgtttggagtaargatbaaggggttttggagacctaggttttatcatgaagatgaaggcttcagagagaatagattgtaaatgtttctttcttttttttttttttttttttttttttt

SEQ ID NO: 18759 - DNA, 104 bp, Homo sapiens
cctaaaatacaaacaagcacagacattaaacctggatactatatgataaagagggatgtaactattgaattggatacaaggatcagaatggaaagaaacatcct

SEQ ID NO: 18760 - DNA, 178 bp, Homo sapiens
  misc_feature 122: d=a or g or t
  misc_feature 126: m=a or c
  misc_feature 131: r=a or g
  misc_feature 134: k=g or t
aggaaggagactcataagaccatctcttgcagaatctagaatccatcagtgaaagtggaggccatgacatcaaaatcattctatgtgggcctaagaatgcagctgtctctaaattggatttdatcmaatartakaatctagacttagaataatgggtagtggactgggtgtgtgtttt

SEQ ID NO: 18761 - DNA, 188 bp, Homo sapiens
  misc_feature 120: n=a, g, c or t
  misc_feature 121: w=a or t
  misc_feature 123: k=g or t
attattttggaagtggttattgttacgagtatttgatcagttctctaaactctgtctgaactttacttagaattagtaatgttcatatgctgtaaataacacctgattttcaatacttcnwtkggttatatgaaaagaaccaactgttaacaaaggaataattggtatctagttaaaatttgaggccc

SEQ ID NO: 18762 - DNA, 143 bp, Homo sapiens
  misc_feature 116: k=g or t
  misc_feature 117: r=a or g
  misc_feature 125: m=a or c
tattctaagggagatgtgtcttaccggattttaaaatgtattatacagtaatgattaaaacagtttggaatggctcatattagaaagattggtcaccgaaatcaacaatagctttkraattagamcccagatagatacaggac

SEQ ID NO: 18763 - DNA, 233 bp, Homo sapiens
  misc_feature 116: s=g or c
  misc_feature 119: r=a or g
  misc_feature 128: r=a or g
ctggtcaattgggaagactctacacagggctgttaaatcagtgaatttggcatgaaagggaaaaattagttaaaatggctgactgtgatcactagatggtcattaaaatgaattgscargttggcagratgggatggggattgggtctaatctacagggaatcagttggaatacgctgtcctctctgaccctgagccaaaatggaaagcgtattccaactgattccctgtaga

SEQ ID NO: 18764 - DNA, 67 bp, Homo sapiens
taagtgtttgaatattaaatgcagtagttcatgcctgtaatcccagcactttgggaggccgaggtgt

SEQ ID NO: 18765 - DNA, 56 bp, Homo sapiens
tgtttgcctttttgcacttgtatcttaaagagctttcctttttttttttttttttt

SEQ ID NO: 18766 - DNA, 150 bp, Homo sapiens
  misc_feature 114: y=c or t
  misc_feature 118: m=a or c
  misc_feature 121: w=a or t
  misc_feature 132: w=a or t
ccatactatttattgttctttccttatatagtcaaaataaaaatatggatgttagattatttacttgctttctcttaaacctaaaagaatttggggccagaaatcctggcagcytgamaawccatctaagawttaccaatttagggaatt

SEQ ID NO: 18767 - DNA, 309 bp, Homo sapiens
  misc_feature 110: m=a or c
  misc_feature 112: y=c or t
  misc_feature 113: m=a or c
  misc_feature 122: k=g or t
  misc_feature 127: w=a or t
  misc_feature 128: w=a or t
  misc_feature 135: w=a or t
  misc_feature 136: h=a or c or t
  misc_feature 139: m=a or c
  misc_feature 295: n=a, g, c or t
  misc_feature 309: v=a or c or g
ccttttttgttatttgtttatgtttgatttttgtgggtacatagtaggtgtatatacttaggagttacatgaaatattttgatataggcatgcaatgcataataatcacmtymggataaatkgggtwwccatcawhctmaagcatttatgctttgtgttacaatccaattatactcttttagttatttttaaatgtacaattaaattattttttactgtagttacccactgtgctatcaaatactaggtcttattcattctttctactttttgtagccattatccctccccactnccccaccccgcgcv

SEQ ID NO: 18768 - DNA, 281 bp, Homo sapiens
ttttctttttttctgagagattcttttcaatataccccttcatggttgaactcaaaaatcattgcttatttaaaaactacaactgctgacgttttgtaacgttcgcattccaggtaattgcttttttgtgcatttttctgtatttttctccatcagtctccctagatatttgttagatttaatattttaatatttttctgaagaagtgagcttttgtatttttaaatatatacccagttgctttaattcttctttttcgtgtactatttcctcgttgtttt

SEQ ID NO: 18769 - DNA, 128 bp, Homo sapiens
  misc_feature 120: k=g or t
  misc_feature 125: k=g or t
ggaggctacagctagggctgctcagtaactgccccaaccactaccacgtccccaagtgcaacgggacccacggaactacaggtgtggggcagggtgagcgtggaagaagggacgcggatkggggkttt

SEQ ID NO: 18770 - DNA, 85 bp, Homo sapiens
gggaggcagacgttgcagtgagccaagattgggccactgactctagcctgggcaacagagcgagactccatctcaaaaaaaaaaa

SEQ ID NO: 18771 - DNA, 128 bp, Homo sapiens
  misc_feature 120: h=a or c or t
  misc_feature 125: s=g or c
  misc_feature 127: w=a or t
tgagagattataagtggccgttcttagagtgtgttaaaatacagccaacaagataaatgtgaaaaagcaaggtgcagaatagtgtggaagaggccaccatttgtgtcaaaaagaagggchtgggscwt

SEQ ID NO: 18772 - DNA, 163 bp, Homo sapiens
tttttttaaaatttattattattatactttaagttttagggtacacgtgcacaacgtgcaggtttgttacatatgtatacatgtgccattttggtgtgctgcacccattaacttgtcatttatcattaggtataatctcctaaatgctattccctcccccctc

SEQ ID NO: 18773 - DNA, 108 bp, Homo sapiens; identical to SEQ ID NO: 18064

SEQ ID NO: 18774 - DNA, 93 bp, Homo sapiens
ttaaggatggcttacagaaggaatgagcttgcaaaaactataagagagagagagagagtgtgtgtgtgtgtgtgtgtgtgtgtgtgtgtgtgt

SEQ ID NO: 18775 - DNA, 256 bp, Homo sapiens
  misc_feature 119: m=a or c
  misc_feature 125: m=a or c
  misc_feature 127: r=a or g
  misc_feature 128: m=a or c
  misc_feature 130: s=g or c
gtaatcgcagctattcgggaggctgatgcagaatcgcttgaactcaggaggcagaggctgcagtaagccaagatcgcgtcactgcactccagcctggacgagagcaaaactccgtctcmaaaaamtrmasaataaaaatagaccaggagaggtggctcacgcctgtaatcccagcactctgggagaccaaggcgggtggatcacctgaggtcaggagttcgagaccagcctggccaacatagagaaaccccagcca

SEQ ID NO: 18776 - DNA, 331 bp, Homo sapiens
tatttgtatatatgcctcatcagagtaaccactgagttgattagaaatagggattaatttttagaaggtgcctgtaatccagaattgaaaatcacgtgcagaagataaacatggcaggtgcctgtatggtgcactgtgatgaggatttcttctagtggcctccatgggtgacacatgacacatatctggatcacatggcatcagaaaacatctgtgtgcttggagtaattgccaagtctctgctaactgtatcatctgttggctctagagcccgggaagaatgatcagttgagaccatctgtgcagtaaatatttatttcaaaggatgtct

SEQ ID NO: 18777 - DNA, 158 bp, Homo sapiens
  misc_feature 19: s=g or c
  misc_feature 144: s=g or c
gcgattctcctgcctcagsctcccgagtagctgggactataggcacttgccaccatgcccagctaatttttgtatttttagtagagacagggtttcaccatgttggccaggatagtctcgatctcttgactttcgtgatctgcsctacctcggccccc

SEQ ID NO: 18778 - DNA, 351 bp, Homo sapiens
  misc_feature 132: w=a or t
  misc_feature 138: w=a or t
  misc_feature 244: n=a, g, c or t
  misc_feature 245: n=a, g, c or t
  misc_feature 279: n=a, g, c or t
  misc_feature 280: n=a, g, c or t
ggtcacagatccctatttctccaggattggtccttggtaccttatttagttcatttggtaacgttaacttttcctggatggtgctgatgctagtagattttcttcggtgtctggacatttaagaagttagtwatttawtacagtcttccctgtctgtgcttgttggtatccatccttcttagaggggctttccctatgtttgaaaggacttacttgttattatctgtgctgtaactgctttagnngacactttcatttcagtaatgctgtggttctagnngacttgtggaggtatcaccctgatggtcttggatatgatccaggagaattttctggattaccaggcacata

SEQ ID NO: 18779 - DNA, 99 bp, Homo sapiens
ccctgtctggctaattttttgtatttttagtagagactgggtttctccatgttggccagtctgttcttgaactcctgacctcaagcaatccaccgcctc

SEQ ID NO: 18780 - DNA, 105 bp, Homo sapiens
cagctactcaggaggctgaggcaggagaatcacttgaacccaggaagtggaggttgcattgagctgagatcgtgccaccgcactccagactgggtgacagaatga

SEQ ID NO: 18781 - DNA, 147 bp, Homo sapiens
  misc_feature 122: k=g or t
cgcagaactccgggaggccggggcgggaagattgcttgagcccaggagttggtcttgcggccagcctgggcaatacggtaagaccccatctctacaaaaaataagttacccgggcgcatggktggttgcatgcctgtggtcacagct

SEQ ID NO: 18782 - DNA, 205 bp, Homo sapiens
cagaattaaaaacaaaaatcatatgatcatctcaatagatgcagaaaaagcattcaacaaaatccagcatcccttggccgggcacagttactaatgcctgtaatcccagcactttgggaggctggtgaaggctggtctcaaaactcctgacctcaaggtgatccacccacctcagcctcccaaagtgctgggattacaggcatta

SEQ ID NO: 18783 - DNA, 160 bp, Homo sapiens
tctttgccctacatatggtggcttagtttttccaagagcaaatctacagtctctactctgcctatgggaattagattgtcctctgatcagtcacaaaataaacttctttatcactttgtaaaggaactgtgtctccattgctatttctaccacccaccca

SEQ ID NO: 18784 - DNA, 157 bp, Homo sapiens
  misc_feature 115: r=a or g
  misc_feature 118: k=g or t
  misc_feature 119: k=g or t
  misc_feature 126: m=a or c
ggtcccagcactttgggaggctgaggcgggtggatcatgaggtcagaagattgggaccatcccggctagcgtggtgggaccccgtctgtactaaaaatacaaaaaattggccggrgckktggtggmatgcacctgtggtctcaggggctcgggaaga

SEQ ID NO: 18785 - DNA, 218 bp, Homo sapiens
  misc_feature 107: w=a or t
  misc_feature 118: w=a or t
  misc_feature 121: y=c or t
  misc_feature 126: r=a or g
caattctacctttttatccttagggtcttttatgttttactctttcatttttaatcattttaagaaaactgttttgtctacagccatatcactctgaacatgcccgwtctcagctgawtcyttggraagaaaactgtttttatagtctatgccagagaggtctatttgttaaaagctacactgggaatcaaaccactatgagtaagaatcagcatata

SEQ ID NO: 18786 - DNA, 103 bp, Homo sapiens
  misc_feature 69: r=a or g
tttgaggttttagattttcaaattaggaatgctcaacctgtctgataacatataaaacaagggattgtratacagagggactggcagagggtagcattagttg

SEQ ID NO: 18787 - DNA, 141 bp, Homo sapiens
tgtgtgtgtgcccatgcacatgtacacacatacatatgtgcacatgagactgtacatgtatatgtgtgcatgcatgtacataaggggcaggggtggagccaggtggaggctggtggagttttgtcttagactgggctccat

SEQ ID NO: 18788 - DNA, 127 bp, Homo sapiens
  misc_feature 104: r=a or g
  misc_feature 105: w=a or t
  misc_feature 127: k=g or t
tacaaaaattagccgggcatgttggcatgcacccgtactcccagctcctcagaaggctgaggcaagagaatcacttaacccaggaggtggaggttgcgggtgtrwgtcaccaatgcctggcccgatk

SEQ ID NO: 18789 - DNA, 82 bp, Homo sapiens
atacatttaataattttttatgaatgtatctttatgaacatatttttcataaatgtatcttaaagaataatatggatgtgtc

SEQ ID NO: 18790 - DNA, 100 bp, Homo sapiens
  misc_feature 64: m=a or c
ataaatcacatgttataccacaaaaaaacttgtaacaaattttaaaagattgaaattatacaamatatctattttgatgaaaatgacataaaactagaca

SEQ ID NO: 18791 - DNA, 124 bp, Homo sapiens
ttctacttcaatagacttttgatttgtgttcgttttgggttataacaagcagtatcccaataaacattttttggacatgttgggtgaatttatgtatgcttttctgttggtttgctgggtcact

SEQ ID NO: 18792 - DNA, 219 bp, Homo sapiens
gtccgtggtgtgtgatgttccccttcctgggtgcatgtgttctcattgttcaattcctacctatgagtgagaacatgtggtgtttggttttatgtccttgcgatagtttgctgagaatgatggtttccaatttcatccatgtccctacaaaggacatgaactcatcattttttatggctgcatagtattccatggtgtatatgtgccacattttctttt

SEQ ID NO: 18793 - DNA, 114 bp, Homo sapiens
attttaaggtaaataagaaaggcctaatgccccgtggttagatttttctatctacatattggagataagtttaaattttgtgttagtgtttgggtattacttcctgccaacgta

SEQ ID NO: 18794 - DNA, 292 bp, Homo sapiens
tattcaaaagccctagttacttccagggaaaattatctattgagcaatgaatttcggtagcttcaattggattccaactcttgagcaagttttcatctcccttgcctgaatggccctggggaggactatttaaattggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatca

SEQ ID NO: 18795 - DNA, 79 bp, Homo sapiens
  misc_feature 15: r=a or g
ctatattatcctgaractacatgtacacacacacccctaaaataagttttatggtatttcatatgcctgtacaggagac

SEQ ID NO: 18796 - DNA, 224 bp, Homo sapiens
  misc_feature 155: k=g or t
  misc_feature 156: v=a or c or g
ctacaaaaatagtgctaacttccctgttagcattatttttgctgtgttccacagggtttggtatgtttgtgttttcattttcatttgtttcaaatatatttattttttgtttttctttagagagaggattttattctgtcacccaggctggagtkvggtggcatgattatagcttactgcagtctcacattcttgggcttaattgatcctctcacctcagccct

SEQ ID NO: 18797 - DNA, 232 bp, Homo sapiens
  misc_feature 85: r=a or g
  misc_feature 126: m=a or c
  misc_feature 133: y=c or t
  misc_feature 174: m=a or c
tatcctattggttttgtctctccagaaaactaatacacacacacacacacacacacacacacacacacactcatagagatatgaragtgtagtttcatatcttaacttggcactaagcatttgtamcacttgyatatgtgctgtggcttttgtcatttctgacaacctgatggmcattctgctatggctttaaaactactttgtccaggctgggactgcacaatagggggcc

SEQ ID NO: 18798 - DNA, 157 bp, Homo sapiens
gtgatctcaactaagttacttaacttcttggctcagttcctccctggtaaattgggaacaatcaaaaaacaataatacaatagcagctatgtgcccctcacaaaaaagcgatccccaatttttagtgatcccaagcagctccctgcccctccccact

SEQ ID NO: 18799 - DNA, 89 bp, Homo sapiens
  misc_feature 3: k=g or t
  misc_feature 59: k=g or t
  misc_feature 75: k=g or t
tcktgaactggccaagtgatccacccacctcagcctcccaaagtgctgggattacaggkgtcagccattgtacckggcctggcctctgt

SEQ ID NO: 18800 - DNA, 379 bp, Homo sapiens
  misc_feature 344: w=a or t
gtatatagaaatgtgattgatttttgcatgttgcagccttgctaaattcatttatgagttcttagagtttttttcttcttcaagatttcttgggattttttacttaaataatcatgtaatctgtgaataagaactgttgtatttctctctaacctatatacctttatttacttatttacactgtctgggatgttcagttcaaagttgagtagaaatgatgagagggtttcctcacccaaccagctcttggttttgtgtagctactgtttatcattctcctctattgctaggttactgagtttttaaaatcatgaatggatgctgaattttgtcaaatgattttwctgtatcaattgaaatgatcatgtgatttttttct

SEQ ID NO: 18801 - DNA, 256 bp, Homo sapiens
gaggccgaggcaggtggatcacaaggtcagaaaatcgagaccatcctggctaatgcgttaaaacccagtctctactaaaaatactaaaattagctgggcatcgtggccacaacacaatctcttgaaacctggggagacggagattgcagtgagcagagattgcaccactgcattccaacctgggcaacagagctagatcatgtcccaataaataaataaataagaaaatattgagactgcttttttcctgaattaa

SEQ ID NO: 18802 - DNA, 100 bp, Homo sapiens
  misc_feature 24: m=a or c
  misc_feature 29: s=g or c
  misc_feature 30: w=a or t
  misc_feature 33: m=a or c
  misc_feature 42: k=g or t
  misc_feature 44: h=a or c or t
  misc_feature 55: b=c or g or t
  misc_feature 73: n=a, g, c or t
  misc_feature 74: d=a or g or t
catcgggccctggatccagaccamgatgswggmgatcgggakghtctccattgabatgcatgggaccctggandaccagctcagccacctgcggcagtat

SEQ ID NO: 18803 - DNA, 99 bp, Homo sapiens
tttttttgtggttctttggctagaaagtgcaaatttctctagggaccattgttgcttttgtttttgtttgtctgcacccgtaggcatttccaagtcact

SEQ ID NO: 18804 - DNA, 198 bp, Homo sapiens
aaatggaatggtatttcctgttcatggtttagaatacttaatgttgtgaagatggcagtattcaccaagttgatctacagatttcaaatccttttcaaaatcccagctaggctgggcatggtggctcacgcctgtaatcccagcactttgggaggctgaggtgggcggatcacctgaggtcaggagttcgagactgaa

SEQ ID NO: 18805 - DNA, 143 bp, Homo sapiens
cgtccatgtgtgacagtgtcaaggtcaatggaacaagctattctgccagaggggtttcctttgtgatctgcttccctccctcttcctaataaagagttttgtcgttttcctttggtgattcagtctgagtcactcccacccca

SEQ ID NO: 18806 - DNA, 114 bp, Homo sapiens
ttcccctggctcaagtgatcctcccacctcagcctcctgagtagctgggtctacaggcatgcaccaccatacctggctaatttttgtatttttagtagagactgggtttcacca

SEQ ID NO: 18807 - DNA, 131 bp, Homo sapiens
tgcctggataaattacacacagttaaaggagagaaaattagggaatgtgatatttttgctaacaggttgggccttatttataatgtagtgtcaaggaaactcctagcgtcgcaacattgggcagggtgaaa

SEQ ID NO: 18808 - DNA, 65 bp, Homo sapiens
taaatgtcattcattgggccactgtgtcttggctgattttttttttttttttttttttttttttt

SEQ ID NO: 18809 - DNA, 165 bp, Homo sapiens
cataaacctctgagactgtagcctgcttcttagcttctcattgagattcctagaggtgcgttcgagttttcagagtaattttccagaccaaccagcgtcagtgggaaatctgacctcttttggcaaaactgcgatcattcattttcctgagtcccctggtggggc

SEQ ID NO: 18810 - DNA, 282 bp, Homo sapiens
  misc_feature 126: r=a or g
  misc_feature 127: w=a or t
  misc_feature 129: w=a or t
  misc_feature 130: n=a, g, c or t
actaagaaactatcatcttggaatggcaaaattgtaatgtgaaaactagagcccaaattatttgatccttgcttgcttctagatttatttatttatttatttatttatttttttttatttttattrwtwntaattatactctaagttttagggtacatgtgcactttgtgcaggttagttacatatgtatacatgtgccatgctggtgcgctgcacccactaatgtgtcatctagcattaggtatatctcccaatgctatccatcccccctcccccgaccca

SEQ ID NO: 18811 - DNA, 161 bp, Homo sapiens
aattcgccactaccaagccaccactagaagaactgctaaaaggagctctaaatcttgaaacaagtcatggaaacacatcgaaagcataagtctcacaggacctataaaacaaaaatacacttaaaaaaaaagcaagttatacaggcaacaaatagcatgat

SEQ ID NO: 18812 - DNA, 193 bp, Homo sapiens
  misc_feature 152: h=a or c or t
gccattctcctgcctcagcctcctgagtagctgggactacaggcacctgccaccacgcccggctaatttttgtatttttagtagagacggggtttcactgtgttagccaggatggtctggatctcctgacctcgtgatccgcctgcctcgghctcccaaagtgctgggattacaggcgtgagcactgccccac

SEQ ID NO: 18813 - DNA, 132 bp, Homo sapiens
ttgttttttttgagacagagtttcactcttgtcacccaggctggagtgcagtggcactgtctcggctcactgcaacctccacctccgaggttgaagtgatccttctacttcagcctcctgagtagctgggac

SEQ ID NO: 18814 - DNA, 126 bp, Homo sapiens
cacaattagactcctacagtttaaaacaaactttaaaccactatcttgcactgctaacttttttctacctttgtaaatagaaacatttctgcataaaagtcatacatatgaagcaagggctgaatc

SEQ ID NO: 18815 - DNA, 210 bp, Homo sapiens
  misc_feature 114: m=a or c
  misc_feature 189: n=a, g, c or t
ctaccacactggccactgctaggttttgagggcaaaagacatctgtgcccttagaacttagtgtgttgagaggacctcgtgataccttggcaaagtagggcatcctcacactgmtctggccccaggtggaatcatccctgcttccttgaggggactattatggcagcctggtaaaggtgaccttaccangctgccataatagtcccctca

SEQ ID NO: 18816 - DNA, 369 bp, Homo sapiens
  misc_feature 156: w=a or t
  misc_feature 248: d=a or g or t
  misc_feature 249: n=a, g, c or t
  misc_feature 250: n=a, g, c or t
ttatgttgctcttcaatttaaagtgtactgaggtgaagaatttattcgctatcagaaatattaacctttttgtcaataacgcagtacccatgtgtcctttttaattgcttcattccttgcccacctcctttggctgtgagcagcttaaacagccawagagcattgttttaccttttattttgctctcttctgagtacattttcaattttgtgaattgagagagtggcatagggaaaatgccattaatdnnatcctgcctataaaaatgatatattattcatatgatatatacagctgattgtgtttcatcctttccccgctaccaccagtaacttcagtccaaaatcctttcccctcagctccagagcc

SEQ ID NO: 18817 - DNA, 143 bp, Homo sapiens
  misc_feature 52: y=c or t
  misc_feature 56: w=a or t
  misc_feature 70: y=c or t
  misc_feature 75: y=c or t
  misc_feature 103: w=a or t
  misc_feature 106: y=c or t
  misc_feature 109: k=g or t
  misc_feature 113: y=c or t
  misc_feature 126: w=a or t
tgacttttttctttttcttttcttttcttttttttttgaccctggttttttycttwacctttctcacttyccttyctgcctggcttcagtgatgacagaggcwatycckgtgycaaacacacctcwatcccctggggagcaaa

SEQ ID NO: 18818 - DNA, 199 bp, Homo sapiens
agaaccatttcagaaaataagtggagaggccaggcgcgtgactcatgcctgtagtcccagcactttgggaggccgaggccagtggatcatttgaggccaggagttcgggaccagcctggccggcatggcgaacccgtcactactgaaaatacaaagattagctgggcgtggtggcgtgcacctgttgtcccagctgctc

SEQ ID NO: 18819 - DNA, 101 bp, Homo sapiens; identical to SEQ ID NO: 17078

SEQ ID NO: 18820 - DNA, 96 bp, Homo sapiens
  misc_feature 16: m=a or c
  misc_feature 88: s=g or c
aagcattgcatcctgmtgttctactcttcccccagtccctttttttttgaaacggagtctcgctcttggcgcccaggctggagtgcastggcgcga

SEQ ID NO: 18821 - DNA, 172 bp, Homo sapiens
  misc_feature 129: w=a or t
gttttctttttttaaattattatactttgagttttgggatacatgtgcagaacgttgcaggtttgttacataggtatacacgtgccatggtggtttgcaactcatcatctacattagacatttcttgtwaatgctattcctctcctagtcccccaccccctgacaggcccct

SEQ ID NO: 18822 - DNA, 134 bp, Homo sapiens; identical to SEQ ID NO: 17229

SEQ ID NO: 18823 - DNA, 87 bp, Homo sapiens
ttggttttggtttctgtatttttcacaatgattaatgaacaaaaacaaagagaaaaaaacacacatcaattaaaggagacaaaaaga

SEQ ID NO: 18824 - DNA, 145 bp, Homo sapiens
ttttttttttacttttgtaatgtaggcacttatagctataaacattcttcttagtacttatttttctgtatcccacagattttggcatgctgtgtttctattatcatttgtttcaaaaaacttttcttttctttttttttttttt

SEQ ID NO: 18825 - DNA, 339 bp, Homo sapiens
  misc_feature 284: n=a, g, c or t
  misc_feature 285: h=a or c or t
  misc_feature 286: n=a, g, c or t
  misc_feature 287: b=c or g or t
tttaggtctcttaaagcttctttatagcagtctctataccattcattcgcttttattcaagacattgacttgtcagggaaactgggtcatttgtcctagaatattcattctggattttgctaattgcttcctcatggcaccatttaacttatccttctagtccccacttttcctgttaaccaaaattcagatctagaggcgaggagacagggtttcttcatgccggtcaggctggtctcgaactcccgacctcaggtgatctgccctcctcagtctcccaaagnhnbtgggattacaggcacatgccaccacacctggctttttttttttttttttttt

SEQ ID NO: 18826 - DNA, 63 bp, Homo sapiens
ttgatgtaataaaatttaaaatggaaaaaaaaaaaaaaaaaaaaaaaaaaaaaaaaaaaaaaa

SEQ ID NO: 18827 - DNA, 65 bp, Homo sapiens
atgagatgaagcacagttttcacactctaatcaaaatggcctctcactatacttcatacaccatt

SEQ ID NO: 18828 - DNA, 300 bp, Homo sapiens
  misc_feature 8: r=a or g
  misc_feature 106: n=a, g, c or t
  misc_feature 107: n=a, g, c or t
  misc_feature 108: d=a or g or t
  misc_feature 109: w=a or t
  misc_feature 122: m=a or c
  misc_feature 146: r=a or g
  misc_feature 213: r=a or g
taaagaaraaggaggtttaatgtactcacagttccacaaggctggagaggcctcagaatcatggtggaaggcaaagaaggagcaaaaaggtatgtcttccatggcnndwggcaagagagcamgtgcagggaaactgccctttataraaccatcagatttagtgagatgtattcactatcacgagaacagtatgggaaaaacctgcccccatgrttcgattacctcctaccgggtccctcccacgacacatggggattatgggaactacaattcaagatgaaatttgggtggggacgcagc

SEQ ID NO: 18829 - DNA, 216 bp, Homo sapiens
  misc_feature 143: r=a or g
agagcgggcctttgcagctgagactgggtggagggagaggcgcggagacactggggctctgacgagctggctgaggccctctcagtaggggggtcacgcctcctggaactcagggaccccaagtttctgtgcattcagggcgrggctggccccatgccctgtgcataggggcctggctgcatcccagtcgatcagccagaggcagcagcagtggat

SEQ ID NO: 18830 - DNA, 325 bp, Homo sapiens
ctcagagtagccactaatgattgatcctttgaatttcaatggtatcagttgtgatgtcttttttttaatctctgattttatttatatgggtttctctccatttggcaaaaggtttgtcaattttgttaatcttttcaaagcatcagctttttgttttattatcttctgtatttttttcatttcaacttcatttatttatgctatgatctttattatttattttttctagtaatttagggtttggttgctcttgcttttctagttctttaagattcatcactaggttgttaatttgaaacttttctttttttaatataggcccaat

SEQ ID NO: 18831 - DNA, 177 bp, Homo sapiens
ttggcacgtgcctgtagtaccagccacttgggaggctgaggcacgagaattgcttgaacccgggaggcggaagttgcagtgagctgagatccaatcatcgcgctccagcctgcgtgacaaagcgagactccggctcaaaaaaaagaaaaaaaaaggaccattgcaatttagagatgt

SEQ ID NO: 18832 - DNA, 218 bp, Homo sapiens
  misc_feature 133: m=a or c
  misc_feature 143: s=g or c
  misc_feature 183: r=a or g
  misc_feature 184: k=g or t
tgtgggtggctagggggttggagtgggaggtggcttgatatgttttggctgtgtccccacccacatctcatcttgaactgtagctcccataattcctacatgtcatgggagggaccaggtgggaggtaactgmatcatgggascaactctttcccatgctgttatgatagcaaataagtctcrkgagatctgatggttttataaaggagagttcccct

SEQ ID NO: 18833 - DNA, 228 bp, Homo sapiens
ccagatattgtgattgtagagggacaggtgcaatgaaaggaatgaaaaatccctcaaagatttgagatgggccgggcgcggtggctcacgcctgtaatcccagcactttgggaggccgaggcgggcggatcacgaggttcaggagatcgagaccatcccggctgaaacggtgaaaccccgtctctactaaaagtacaaaaagattggccgggcgtggtggcgagcgcc

SEQ ID NO: 18834 - DNA, 108 bp, Homo sapiens
tgactcaggcagcaaaatggaagatggactgaaatagaggaaatatgcaaggcagagatgaattagaagctcttgtagtagtttagggagagatgagaagggccgaaa

SEQ ID NO: 18835 - DNA, 273 bp, Homo sapiens
  misc_feature 160: w=a or t
  misc_feature 163: r=a or g
  misc_feature 172: y=c or t
  misc_feature 174: y=c or t
  misc_feature 178: y=c or t
  misc_feature 185: y=c or t
  misc_feature 187: m=a or c
  misc_feature 195: y=c or t
  misc_feature 211: y=c or t
  misc_feature 216: m=a or c
  misc_feature 222: y=c or t
  misc_feature 232: s=g or c
  misc_feature 234: y=c or t
  misc_feature 239: s=g or c
  misc_feature 242: w=a or t
  misc_feature 246: m=a or c
  misc_feature 251: y=c or t
  misc_feature 254: m=a or c
  misc_feature 261: s=g or c
  misc_feature 262: s=g or c
  misc_feature 268: m=a or c
  misc_feature 271: n=a, g, c or t
tatggtctcactctgtcacctaagctggagtgcagtggcgtgatcacagctcactgcggccttgtcctcctgggctcaagcaatgatcccacctaagccttctcggtagccaggactacaggtgcccacctccatgcccagctaattttttttttttttwaaraaatggggycycccyctgttgycmaggttgaycacgaactcttgggcycaagmaatgaycccacctaascyttctsggwagcmaggaytamaggtgcssacctcmatngg

SEQ ID NO: 18836 - DNA, 275 bp, Homo sapiens
  misc_feature 80: s=g or c
gaggagtgactgagccccgggctgtgcagtccgacgccgactgaggcacgagcgggtgacgctgggcctgcagcgcggasagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcttc

SEQ ID NO: 18837 - DNA, 81 bp, Homo sapiens
ctatattatcctgaaactacatgtacacacacacccctaaaataagttttatggtatttcatatgcctgtacaggagacga

SEQ ID NO: 18838 - DNA, 79 bp, Homo sapiens
ctagggtttttatagttttaggttttagatttaagtttttaatatattttgagttgatttttgtacatagtgtattgta

SEQ ID NO: 18839 - DNA, 101 bp, Homo sapiens
  misc_feature 32: s=g or c
gcaggagaatggcgtgaacccgggaggcggasttgcagtgagccgagatcccgccactgaactccagcctgggcgacagagcgagactccgtctcaaaaaa

SEQ ID NO: 18840 - DNA, 92 bp, Homo sapiens
  misc_feature 56: r=a or g
  misc_feature 57: r=a or g
tttttttttttttaagtagggacagggtttcaccataatgttcagactggtctcgrrctcctgacctcaggtgatccacccacctcggccac

SEQ ID NO: 18841 - DNA, 96 bp, Homo sapiens
agcagtgtgaaaatggactaatacaagctggatagaaactctgccttgattagctatgaaaccaatattgccaaagcacctttttttttttttttt

SEQ ID NO: 18842 - DNA, 322 bp, Homo sapiens
  misc_feature 312: d=a or g or t
aggaatgctgcatggcctacccatagcggcggtgggagcctccgccggggagagcccgctcgggggcaggaagtggcccggccctcctcgtggagggcgtttccggagcgcctactgtgctccttgccggggtgggggtcgttaccgagtgggaacttctgcaaatcctgacttttgtcacttcgcgccccgcacaagatgtcctgccggcggtgcgattggtcccgttgcttcgaggggaaactgaggccacttagtccgggcacttacccgcagctagttaaggactaggctctgatggagacgcttgtdacgacctcaa

SEQ ID NO: 18843 - DNA, 171 bp, Homo sapiens
agtatagtataaaaggcttgataggccaggtgcggtggcttatgcctgtaatcccagcactttgggaggccgaggtgggtggatcacctgaggtcaggagttcaagaccagcccgaccaacatggaggaaaccccatctctactaaaaatacaaaattagctgggcgtggt

SEQ ID NO: 18844 - DNA, 73 bp, Homo sapiens
cacaaatgaattgctttatcactaaactcttactgtgaatgatactaaagaacatagtaagggtttagtgata

SEQ ID NO: 18845 - DNA, 247 bp, Homo sapiens
  misc_feature 10: y=c or t
  misc_feature 78: y=c or t
  misc_feature 114: y=c or t
  misc_feature 117: n=a, g, c or t
tagtcgtgtytgaaaagttcagctgtaggccaatgtcatccactactttcagcaatctgtaaagaaaggttggcagtytattatttatttatttatttattttgagacggagtycgnctctgttgccaggctggggtgcagtggcgtgatctcggctcactgcaacctctgcctcctgggttcaagcaattctactgcctcagcctctcaagtggctgggactacagatgcacaccaccacacccaa

SEQ ID NO: 18846 - DNA, 131 bp, Homo sapiens
agtagctgggattataggcacccatcaccacgcccagctaacttttgtattttagtagagatggggtttcaccatactggtcaggctggtctcatactcctgacctcaggtgatccacctgcctcggcctg

SEQ ID NO: 18847 - DNA, 92 bp, Homo sapiens
  misc_feature 92: h=a or c or t
tgatccatttatccattccttcaccaatttcacactgtctggattaccatagctttttattaagtcttgaagtcaagcagtgactattctth

SEQ ID NO: 18848 - DNA, 270 bp, Homo sapiens
  misc_feature 13: w=a or t
  misc_feature 25: b=c or g or t
  misc_feature 236: y=c or t
cataagagatgtwgaaaagccagtbtacaggtagatccaagtattttaattctgcatgatgtctaaggaggagtaagggtgacctggcaggctagagtgctctggctttgcaggtgaaagcaagccgagctcagacttctaaggatgaataaaagcatcagatctctgctttccacttgtcacacttcatcgagatgactcttcaggggtgatggctgaatcctttcccatgtgtyctctaggactgccaactttaatgcactggcctgt

SEQ ID NO: 18849 - DNA, 198 bp, Homo sapiens
  misc_feature 169: k=g or t
tcccaaagtgctgagattacaggcatgagccacctcacccggccctgaacctcttctgattctgagtgctaattgattcaggaattgttctttactcagataaactgttaaacttgtttctaaagcttctttttttttaacaaggatatacagaaattctttttatttkatttatatatttatagttttttttttttt

SEQ ID NO: 18850 - DNA, 136 bp, Homo sapiens
  misc_feature 5: w=a or t
  misc_feature 111: s=g or c
gtgtwatcacgtgacccaggtgcgtacgcgacggagcggggtgtgaagatggcggacgaagaggccgagcaggagaggttgagttgcggcgaaggcggctgcgtcgcggastgcagcgcctgggcgagcggcaccc

SEQ ID NO: 18851 - DNA, 161 bp, Homo sapiens
  misc_feature 86: m=a or c
  misc_feature 138: b=c or g or t
aattcgccactaccaagccaccactacaagaactgctaaaaggagctctaaatcttgaaacaagtcatggaaacacatcgaaagcmtaagtctcacaggacctataaaacaaaaatacacttaaaaaaaaagcaagtbatacaggcaacaaatagcatgat

SEQ ID NO: 18852 - DNA, 143 bp, Homo sapiens
tagttatcttcaatgggttagtattgtttggggcaggacattaaactagaagggattctataggatgaggtgatacctagaaggtaatatattgtaaggcaaaagagattagaagaaatggggaaaggatagtaaaaggcaaa

SEQ ID NO: 18853 - DNA, 172 bp, Homo sapiens
  misc_feature 89: k=g or t
  misc_feature 109: y=c or t
  misc_feature 127: r=a or g
  misc_feature 133: y=c or t
  misc_feature 140: k=g or t
atttgagttgcttttgagtgaatttttcctattggagtctacctttgtttttttgtgtgtgcgcgttttttgttttttgtttttttttkgtttgtttgtttagttttgyctttgtgttttttttgaractggyctctgtkgcccagtctgctggagtgcagtggcgcgatct

SEQ ID NO: 18854 - DNA, 158 bp, Homo sapiens
  misc_feature 41: y=c or t
  misc_feature 53: y=c or t
  misc_feature 101: r=a or g
  misc_feature 102: r=a or g
  misc_feature 114: r=a or g
  misc_feature 115: r=a or g
  misc_feature 139: r=a or g
  misc_feature 140: k=g or t
aaaataaattatattacatatgaaacccttatgtatatggycaaatgattttyttcacaagggtgctgagaccattcaatgggaaaagggcagtcttttcrrcaaatgtgggarractggatgtccacatgcaaacgarkgaatttgaaccctcacca

SEQ ID NO: 18855 - DNA, 224 bp, Homo sapiens
tattatctcccttcttgtgctttctttgggcttattttactgcttcttctcttattagtgttttttttaaacctttgttagattctaataaatgaactgaggttgtaaaatttacttgaagtgctgctttagccatagtaagtcttgattggtagagcttccaatttttatttatatattaatggtgaatggttttattttggttttattttgttgttgttttt

SEQ ID NO: 18856 - DNA, 340 bp, Homo sapiens
ctttagtttaattagaccccatttgtcaattttggcttttgttgcaattgcttttggtgttttagtcatgaagtctttgcccatgcctatgtcctgaatggtattgcctaggttttcttctagggttttttatggttttagttcttacatttaaatctttaatccatcttttttttttaatttttttaatttttattatactttaagttttagggtacatgtgcacattgtgcaggttagttacatatgtatacatgtgccatgctggtgcgctgcaccactaactcgtcatctagcattaggtatatctcccgatgctatccctcccccctcccccccc

SEQ ID NO: 18857 - DNA, 189 bp, Homo sapiens
tgtataggtgtgattttctttctatttattctcctttgaatttgtagaatcttaataacacttgaaaatgatacttctatttcattctcctgccctttgcttgtgggacttcaattaaatctatgtgagacttttcctaaatctcatattttttacactcttttctatattatctatcttcccccgccc

SEQ ID NO: 18858 - DNA, 167 bp, Homo sapiens
aagttggccgagcgtggtggcgggcgcctgtggtcccggctgcttgggaggctgaggcgggagaatggcgtgacccggaaagcggaggttgcagtgagccgagatcgccccactgcactccagcctgggcaacagagcgagactccgtctcaaaaaaaaaaaaaaaa

SEQ ID NO: 18859 - DNA, 126 bp, Homo sapiens
tgttacccaggctggagtgcagtggcctgatcatagttcattgtagccttgatttcctgggcttcatgcgatcctcctaagtctctcaagtggctgagactacaggcatgtgtcaccacacccggt

SEQ ID NO: 18860 - DNA, 176 bp, Homo sapiens
ctcttaacagtaagttcagaccatgtactatgctattcgtagcactccccagtatggcctgacccacttctcagccttaacttctactgttattcatgaacctctgcgttattcaaacacatctacctagaccttgagtatttttagccttgctttataccactttgcccctggta

SEQ ID NO: 18861 - DNA, 158 bp, Homo sapiens; identical to SEQ ID NO: 18701

SEQ ID NO: 18862 - DNA, 153 bp, Homo sapiens
cagcataacagactatgaagaaacagggcttaagtgcccatctagaacaagatggtctagattacaataaggaccccatgggacagaacatcaaaacattcaactttcaagtaaatgtcttggaagtaaacatttaaaatttataggacttcc

SEQ ID NO: 18863 - DNA, 178 bp, Homo sapiens
tgtcagatgtataccttgtaaatgtttttttttccattctgtaggttgtctcttcactgtgttaataatttcctttgtggtgcaaaatctttttagttttatgtaaccccatttgtctatttttgcttttgttgtctgtgtctttaaggtcttattttaaatccttgcccagcccaac

SEQ ID NO: 18864 - DNA, 86 bp, Homo sapiens
tgctggccttttccagaggcagagaaaggggtttctaggatttggcagtgtcgggcaaaaagaccatgctgggaaaaaaaaaaaaa

SEQ ID NO: 18865 - DNA, 310 bp, Homo sapiens
cctggagcctttttggactaaactcttggtcaacatgaggaagaaagctcagtcttctctttgttaccgtgtccatagggtttttttttcgtccacatggaccttataaagttacatagcatgagattaattagggccagtgctcaaagtcagtaaaatgatgacacctcttctctaatcactctcagttaatgcttctctttgagaattggggctaactttgtatagggcggtggtccttgacattttcttgcctttctgcctatttctttttccataaaagagaaaaaaattctgtaacctgccacct

SEQ ID NO: 18866 - DNA, 260 bp, Homo sapiens
atcttgatacttgtagatgtttgtctgtgtctgggcattgaagagttaggtatttattttagtctttatagtctgggctcctttgtaactgtccttcttgggaaggctttccaagtattcaaagggacttggatgttgtgaactaagtctttgtttgctgcagctatatcttctttatggagcacctcaagaccaccaaggcagtatctctatgaatctgtaagagccacagtgttgctgggcttgaggtgctccataaa

SEQ ID NO: 18867 - DNA, 340 bp, Homo sapiens
  misc_feature 335: y=c or t
agggctctgcctcttccctataccatgctgtcttccatagccttcctcctgtcctactcatgagactgcctccatttcttccttctgcaaccctgctcctatcagctgaatccttctttcggagtgttagtgagtacccgtctctccccagcccctcagctggtgggcctgggtgtgtcagcggcaaatggggctctggttccaatgggccactctcatctctctcttgttccttgtgcagaaaacctttgcttcactccactgccctctctagttcccgaccctttttctctcctggctttccctgccaaatttctccaaggagtggtctacaycctct

SEQ ID NO: 18868 - DNA, 105 bp, Homo sapiens
catatgaacaatttttttattatttttatctgaaattgcccagttctctacttactttgatcagtaaaagtatatactttattacacacacacacacacacaccc

SEQ ID NO: 18869 - DNA, 138 bp, Homo sapiens
  misc_feature 7: w=a or t
  misc_feature 32: k=g or t
gccacawggatgagcctaagggacattatgtkaagtgaaataaaccaggcacagaaagatgaataccacatgctctcattcatatgtcaaagcttaaaaagttgatctcactgatgtggagagtagaatagtggtcac

SEQ ID NO: 18870 - DNA, 101 bp, Homo sapiens
ccacgcccggctacttttttgtacttttagtagagatggggtttcaccatgttagccaggatggtcttgatttcctgacctcgtgatctgcctgcctcggc

SEQ ID NO: 18871 - DNA, 166 bp, Homo sapiens
gaaggagaggtgagaggccagggttcccatactcttgggtcctagggaggatgggggccagagggctggaaaactgggtcccggaggaggatgcactgggtgccagtactttaggtcctgggaaaagaggaggctgggaccctggactcttgggtctgggggagga

SEQ ID NO: 18872 - DNA, 228 bp, Homo sapiens
tctcaccacaacctctgcctcctgggttcaagtgattcttgtgcctcagccttctgagtagctgggactacaggtgcctgccaccacacccagctaatttttgtatttttagtagagacggggttttgccatgttgaccatgctggtcttgaacttgcaacctcaggtgacctgcctgcctcagcctcccaaaatgctgggataaccagcaccagccaccgccccaaa

SEQ ID NO: 18873 - DNA, 172 bp, Homo sapiens
ggctgaggcaggggaatagcttgaactcgggaggtggaggttgcagtgagccgcaatcgcaccattacactccagcgtgggtaacagagtgagactccatttccaaaaaaataaaaaaataaaaaaatgtagatactcccgctgggcacggtggctcatgcctgtaatcctg

SEQ ID NO: 18874 - DNA, 116 bp, Homo sapiens
tgaggtcaggagttcgagaccagcctggccaatatggtgaaaccccgtctctactaaaaatacaaaaattagccgggcgtggtggcaggcgcctgtaatcccagctactctggagg

SEQ ID NO: 18875 - DNA, 113 bp, Homo sapiens
gattacaggcgtgcgccaccatgcccggctaatttttgtatttttagtagacggggtttcaccatgttggtcaagctggtattgaactcctgaccttgtgatctacccgccca

SEQ ID NO: 18876 - DNA, 141 bp, Homo sapiens
gtgttggtaaagatgtgttgaaaacaaactcttgcccactgttggtagaaatgtaaactagtacagtcattatggaggtttctcaaaacattaaaaacagaactgccctatgatcccagccatctcttttttttttttttt

SEQ ID NO: 18877 - DNA, 232 bp, Homo sapiens
  misc_feature 111: r=a or g
  misc_feature 115: r=a or g
  misc_feature 116: m=a or c
  misc_feature 127: r=a or g
tatttttccctattcctccctctaagtgcaactaaaagccttggtcattatatctaaaacaaatataagatgactctgaaaggtggagaaaagaaagtaaaacggctaggratgrmcaccagtggtragctctctgggttttctttttgcctcatgtgttcctgacttgtagctgaagaagccagcaacctggaaactccaaggagtatccaggttgctggcttcttcagct

SEQ ID NO: 18878 - DNA, 52 bp, Homo sapiens
aatgatctgctgtcatcatcttgaaattctttttttttcttttttttttttt

SEQ ID NO: 18879 - DNA, 146 bp, Homo sapiens
  misc_feature 120: r=a or g
  misc_feature 125: r=a or g
  misc_feature 127: b=c or g or t
tgcagaggagcgcgaccgggctgaggcggaggcccgagagaaggagaccaaggctctgtcgctggcccgggccctggaggaagccatggagcagctggtcagacaggtgcgggagatggrggcarabctggaggacgagaggaagc

SEQ ID NO: 18880 - DNA, 106 bp, Homo sapiens
atggagttttgctcttgttgcccaggctggagtgcactggcacaatgtcggctcactgcaacctccgcctcccgggttcaagtgattgtcctgcctcagcctccct

SEQ ID NO: 18881 - DNA, 128 bp, Homo sapiens
  misc_feature 73: s=g or c
ggctggtcttgaactcctgacctcgtgatccacccaactcggcctcccaaagtgctgggattacaggcgtgascactgcgcctggcgactctgtctcttaaaaatattttaatttttttttttttttt

SEQ ID NO: 18882 - DNA, 99 bp, Homo sapiens
  misc_feature 95: m=a or c
catatttcttggaggctttgttcatttttttttactcttttttctctaaacttctctttttgtttcatttcattcatttgctcttcaatccctgmcacc

SEQ ID NO: 18883 - DNA, 101 bp, Homo sapiens
tgagcctgggaagcggaggctgcagtgggtcaagatcatgccactgcactccagcctgggtgacagggcaagatcctatctgattaaaaaaaaaaataggc

SEQ ID NO: 18884 - DNA, 123 bp, Homo sapiens
gtgtgcagtttacatgtgtgtactttgcgtgtgtggtttatatgtgtatgtagtgtgtgtgtgtagtttatgtgtttgtgtatagtttgtgtatgtggtttatatgtgtgtgtgttatcgtac

SEQ ID NO: 18885 - DNA, 190 bp, Homo sapiens
tacatcaactcatccatttttatggctgcatagtattccatggtatatatgtgccacattttctttattcagtctatcactaatggacatttgtgttggttccaagtctttgctattgtgtttattgccacaaataaacatatgtatgcatgtgtctttatggtatctagatctagaaataccatttgac

SEQ ID NO: 18886 - DNA, 92 bp, Homo sapiens
cacatgacattttaatttctgaataaatttggtaagcaagagagggaggactatagaaaggtcacttagatagtaatgtacattcctgccat

SEQ ID NO: 18887 - DNA, 159 bp, Homo sapiens
  misc_feature 16: k=g or t
cttgtcattgtaaatkatttctttgtccatttgagatggatataaacctctttaaaagtcttggccgggcgcggtggctcacgcccgtaatcccagtactttgggaggccaaggcgggtggatcacgaggtcaggagttcgagaccagcccggccaaca

SEQ ID NO: 18888 - DNA, 258 bp, Homo sapiens
  misc_feature 147: w=a or t
gtcctgggggacctcagagccaaatgtaatacccaattgtagtaaccaacttatcctaggttcccgagagcatttcttgattctactttacgtgatagtttatctacctttgtattcttgaagttttttctttaaaactctttattwaagtgttacggtatattattatttttaaaataataactgttaaaatatatttactattttccataaatattaaaaaatccaattaatatagttctcggacacagggacgca

SEQ ID NO: 18889 - DNA, 237 bp, Homo sapiens
tgaaaattttctcccattctgggttgtctgtttactctgctgattatttcttttggtgtgcagaagctttttagttcagttaagtcctatctatttatctttgcttttgttgcatttgcttttgggttcttggtcatgaagtctttgctgaagccaatgtctagaagtgtttttccaatgttatcttccagaatttttatggtttcgggtcttagatttcagtcttttttttttttt

SEQ ID NO: 18890 - DNA, 173 bp, Homo sapiens
  misc_feature 17: y=c or t
  misc_feature 47: y=c or t
  misc_feature 110: y=c or t
  misc_feature 114: w=a or t
  misc_feature 118: m=a or c
  misc_feature 129: m=a or c
  misc_feature 158: y=c or t
agtaactgtgagcattygagctgtttctgtgccttcctcttcaaggyacctttcctctcgtgttggaactgtgtcccagttcatagaggtcaaagtcatcactgatctcytcawggamcctcacaaaamcagcatcttctgggtcatcaagcacagtyctgcaaaaaaaaagc

SEQ ID NO: 18891 - DNA, 194 bp, Homo sapiens
aggatcacttgagcccaagggtttgaggctgcagtgagccgtgattgtgccactgcgttccagcagaaagaaacattctgaacctgcctcaaatttttacatggccaaacaaaatactgctcctgctccacttggagggataaacattagggccaagtcctcttccagcgccagcccctgcctctgccaccctc

SEQ ID NO: 18892 - DNA, 61 bp, Homo sapiens
cagtgaaaaccaatgaaagagggtgaaaccccgtgtctaccaaaaaaaaaaaaaaaaaaaa

SEQ ID NO: 18893 - DNA, 418 bp, Homo sapiens
  misc_feature 106: h=a or c or t
  misc_feature 107: n=a, g, c or t
  misc_feature 156: w=a or t
  misc_feature 252: r=a or g
  misc_feature 253: r=a or g
  misc_feature 254: r=a or g
  misc_feature 268: h=a or c or t
  misc_feature 269: n=a, g, c or t
  misc_feature 275: b=c or g or t
  misc_feature 276: k=g or t
  misc_feature 331: b=c or g or t
  misc_feature 332: w=a or t
  misc_feature 339: n=a, g, c or t
  misc_feature 340: n=a, g, c or t
  misc_feature 342: n=a, g, c or t
  misc_feature 343: v=a or c or g
  misc_feature 385: n=a, g, c or t
  misc_feature 386: b=c or g or t
  misc_feature 387: d=a or g or t
caagatttatggaaggtgttcaccgaagcttttctgaagagatcttttagaataaatttaaatacaatgacagagcaagctatgtgattgcacccattatttggghnaatatcctttcaggcagagggaaacaaatgggaacaatggccctgcagwgagaataagcttgcaatatgtgtctggaagtgattaatcaagagggagattaggaggggtcagagagagaagtgtgagatcatatgtgcctttgtrrrctgtggaaaataahngggatbktactctgaatgagatggaagccattagatgtttgagcagggatgtggtgtgactbwagcatanngnvcaggatggtgggagattagttggaaggctatttcagtccttnbdatgaaatatgttgaggtcttggatgtaagga

SEQ ID NO: 18894 - DNA, 255 bp, Homo sapiens
  misc_feature 108: k=g or t
  misc_feature 115: k=g or t
  misc_feature 116: k=g or t
  misc_feature 117: d=a or g or t
  misc_feature 120: w=a or t
  misc_feature 125: h=a or c or t
caattttaattattacacgccttggggtagtcttatttgaatttaatcttctttaatctctgccttccagtacctagatacttatattatactctaagttcagaaagkgttctgkkdatwaatthctttgaataaactctatacctcttggcgtttcttgatttcttggatatccatcattcttcaatttgctcttgtgaggttattctctctatcttgtggattgttttctttttttttctttttttttttttt

SEQ ID NO: 18895 - DNA, 130 bp, Homo sapiens
atgatggcgagtgcctataatctcagctactcgggaggctgaggcaggaggatcacttgaaccagggaggtggaagttgcagtgagccaagattgtgccattgcactccagcctgggtgacaagagcaaa

SEQ ID NO: 18896 - DNA, 56 bp, Homo sapiens
  misc_feature 1: r=a or g
  misc_feature 40: k=g or t
  misc_feature 47: k=g or t
raagtatgttcatgtcccatgccaactttccaatgggttktcttttkcttgtaaat

SEQ ID NO: 18897 - DNA, 186 bp, Homo sapiens
  misc_feature 153: r=a or g
caagaaagcacgaaagcaagcaagcaagaaagcaagaaaacaaggaagcaagaaagaaagaaacaaaagaaagaaagaaaacaagaaagcaagaaagcacgaaagcaatcaagcaagaaagcaagccaggaaagaaacaaaagaaagaaagaratcgagaaaacaagacagcacgaaagcaagcaa

SEQ ID NO: 18898 - DNA, 239 bp, Homo sapiens
agatgtatcttggtaaaatgttaccatggttgtgatggcattgttaatagggaagcaagcacattttaaaagtgagctttaggccagttgcagcagtttatgcctataatcccagcactttgggaggctgaagttggaggatagcttaaggccaggaaagtctggcaacatagcaagagcctgtctacaaaaagctgggcacggtggcacacagctgtagtgtagctccctgggaggct

SEQ ID NO: 18899 - DNA, 256 bp, Homo sapiens
ttgtttgtttgttttagagacaggatctccctcagttgcccagactgtagcagagtggtgcgatcatggcttactgcagccttgaactcctgtgctcaagcaatcctctcgcatcagcctcctgagtagctgggactgtaggcacacaccaccatgcccagctaattttttattttactttagagacagggtttcattctgtttcccaggctggccttgaactcctggtctcaagtgatcctcctgcctcagcctc

SEQ ID NO: 18900 - DNA, 170 bp, Homo sapiens
caagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagagagct

SEQ ID NO: 18901 - DNA, 178 bp, Homo sapiens
  misc_feature 159: d=a or g or t
tatttttttgtagaaacaaggtttccaccatgttgcccaggctggtctcgaactccagggctcaagtgatccatccgcctcccaaagtgctgggactacaggcgtgagcattgtgcctggcctcaatttttaattttcttgaagtcaggggagaaactdtagttttaatatgggaagc

SEQ ID NO: 18902 - DNA, 348 bp, Homo sapiens
  misc_feature 155: m=a or c
  misc_feature 207: n=a, g, c or t
  misc_feature 208: n=a, g, c or t
  misc_feature 209: k=g or t
  misc_feature 306: m=a or c
  misc_feature 346: y=c or t
  misc_feature 347: d=a or g or t
tgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgamggcaccggccacaagtggcttccctccaccgctgtagatacttgcagaagcnnkgaagctcctggagggtctcctttgcagtctggaagatttcctccacgagaaacaagtccactaagtgggcacagacatcctcacagcaacgggccamacggaccctctggtctgtctctactgcattcttcaacaaydt

SEQ ID NO: 18903 - DNA, 180 bp, Homo sapiens
  misc_feature 162: k=g or t
tatttttttgtagaaacaaggtttccaccatgttgcccaggctggtctcgaactccagggctcaagtgatccatccgcctcccaaagtgctgggactacaggcgtgagcatttgtgcctggccctcaatttttaattttcttgaagtcaggggagaaacttkagttttaatatgggaagc

SEQ ID NO: 18904 - DNA, 128 bp, Homo sapiens
  misc_feature 117: r=a or g
  misc_feature 118: d=a or g or t
  misc_feature 119: m=a or c
taagaaacacaggcacaggtactcatttttttcttgagggaaaacctaaagaatttacacaaagctggaccacacatagcaagagagccagctgcctactccggcctgaagggcgardmcccacccca

SEQ ID NO: 18905 - DNA, 99 bp, Homo sapiens
tgttggccaggctggtttcgacctcctgacttcgtgatctgcctgccttggcctcccaaagtgctgggattacaggcatgagccaccgcacccggcctt

SEQ ID NO: 18906 - DNA, 221 bp, Homo sapiens
  misc_feature 207: n=a, g, c or t
  misc_feature 208: n=a, g, c or t
cctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttacnnaacagcccacccc

SEQ ID NO: 18907 - DNA, 75 bp, Homo sapiens
ttcattccattccactgcattccactctattccactccactccattctactacactccattacactccactccac

SEQ ID NO: 18908 - DNA, 245 bp, Homo sapiens
tcttattcctgtatgcttgatagaggagctgcttatttttggaatatagagacgacagatcaagaggaaaatttattttattttattttattttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccctca

SEQ ID NO: 18909 - DNA, 333 bp, Homo sapiens
cttcgggaggtcgagtcggaaggatcacttgagcccaggagtttgagaccagccggggcaacatagtgagactttgtacaaaaaaaaatttaaaaattagccgggcatggtggcatgcatctgtggtctcagctgctctggaggctgaggtgggaggatcacttgagcccaggaggctgaggctgcaatgagccgagatcaagcaggtgttaggtatatcagacagctgagaagacgcaagtgtgccctggggttcaaactggtacccctgtctccctgttccaggaataacatgagtgccgggacaatgcatctttattatgagaggaatgt

SEQ ID NO: 18910 - DNA, 199 bp, Homo sapiens
aaaatgccttttattgaattgaggaagttcctctctatttctgtttctctgaaagtgttgtcatgaatgggtattgaactttatctaacactgcactaataaataggattatctgacttttctacttattaatttggtgcattacattattaatttccaaatattgagccacccttatattattgaagcatgcccccct

SEQ ID NO: 18911 - DNA, 133 bp, Homo sapiens
  misc_feature 119: w=a or t
ctaagttttagggtacatgtgcacattgtgcaggttagttacatatgtatacatgtgtcatgctggtgcgctgcaccactaatgtgtcatctagcattaggtatatctcccaatgctawccctcccccccccc

SEQ ID NO: 18912 - DNA, 245 bp, Homo sapiens
ctgcacatctccagagagaagcagagatgagagaccactgaattatggagagaagagagtaagccacgtccctgatagctttctggtcccatccttttaagatgcttaattatctttcctacttttgagttttcatgagatgtccccttattcttcccgtaatttatataatcaagtctgaattttattgtgttacctttagccaaataaccgtaatgaaaagatgtaattctttttcttttttt

SEQ ID NO: 18913 - DNA, 107 bp, Homo sapiens
  misc_feature 35: w=a or t
gatgcagaattagctgggcgtggtggcgcatgccwgtggtcccagctactcgggaggctgaggcaggagaattgcttgaacctaggaggctgaggttgcagtgagct

SEQ ID NO: 18914 - DNA, 60 bp, Homo sapiens
cattgaaatattgggtgaaaatctgtattactatttgtttcctttttttttttttttttt

SEQ ID NO: 18915 - DNA, 258 bp, Homo sapiens
  misc_feature 128: r=a or g
  misc_feature 129: r=a or g
  misc_feature 249: w=a or t
gattccaaaaataggtatgcatttttcgatcaagggaaaaatataacccatggatttttactagcttattacttatggtagaagacagactcataggaaaaatgataaaactgtataaatgttattgrrtgcctgttagcactgagattactaagaatgagtgagacaaggtctccatcctcaaaaggtacacagagctttggaaggtgagataggcaggtattttaatcaagttttttgttttttgtwttttgtttt

SEQ ID NO: 18916 - DNA, 146 bp, Homo sapiens
  misc_feature 115: r=a or g
  misc_feature 116: w=a or t
aaaaaatatgttatttgtaacacataatggacttgtcattgtttttgttttgtgtgtgtgtatgtgtgtttgaggcggggtctcgctctgtcacctaggctggagcgcagtcacrwtatcgcggctcactgcagcctcaacctccc

SEQ ID NO: 18917 - DNA, 318 bp, Homo sapiens
  misc_feature 247: s=g or c
  misc_feature 283: n=a, g, c or t
cattaaaatagcaaatagaaaagatttacaggccgggcgcggtggctcacgcctgtggtcccagcactttgggaggccgaggcgggcggatcgcggggtcaggagatcgagaccattccggctggaacggtgaaaccccgtctctactaaaggtacaggaaattggccgggcgtggtggtgggcgcctgtagtcccagctgcttgggaggctgaggcaggagaatggcgtggacccgggaggcggasttgcagtgagccgagatcccgccactgcactccagnctgggcaacagagcgagactccgtctcaaaaaaaa

SEQ ID NO: 18918 - DNA, 151 bp, Homo sapiens
  misc_feature 140: m=a or c
  misc_feature 146: m=a or c
ttatactctaagttttagggtacatgtgcacattgtgcaggttagttacatatgtatacatgtgccatgctggtgcgctgcacccactaacgtgtcatctagcattaggtatatctcccaatgctatccctcccccctcmcccgcmccact

SEQ ID NO: 18919 - DNA, 118 bp, Homo sapiens
ttcccagtgatgttcatttagttccaatcattctgaatttccacctgctgtaattttccataagcttcaagaacccccttttgaatttcatatagtttaggtcttctgggaatgaatt

SEQ ID NO: 18920 - DNA, 119 bp, Homo sapiens
aagagagtgagattacttatctggtaccatggtgcaaattagaaaaacctccaaaagaaggagtctatgaactggccacttttcagatgaaacctggtgggccagctctgtggggtgcc

SEQ ID NO: 18921 - DNA, 122 bp, Homo sapiens
ttggtagaggcgcggtttcaccgtgttagccaggatggtcttgatctcctgacctcgtgatccgcctgcctcggcctcccaaagtgctgggattacaggtgtgagccaccacgtccggcctc

SEQ ID NO: 18922 - DNA, 180 bp, Homo sapiens
tttcttttctttcttccttttttaataatagtggtggggtctccctatgttgcccaggatggtcttgatctcccaggctcatgtgatctcccaccttggcctcccaggcttggtatggtggctcacacctctaatccagcattttgggaggccaaggtgggagatcacatgagcctggga

SEQ ID NO: 18923 - DNA, 177 bp, Homo sapiens
  misc_feature 115: r=a or g
ccatgcatagtaataataactgctgtctctggagtgtgcagagactagagtaagcactttaccatcatcaaactttaatctgcaaaacagtccttataagatagagggaagagcrtcatctacttttcgtagatgagggaactgacggacagagaggaaattagctggaggtcacaa

SEQ ID NO: 18924 - DNA, 113 bp, Homo sapiens
  misc_feature 38: r=a or g
  misc_feature 89: w=a or t
  misc_feature 92: m=a or c
agttggctgggcgtggtggtgcgtgcttgtggtcccgrctgctcgggaggctgaggcgggagagtcgcttgagcccgggaggtggaggwtgmagtgggccgggattgcacaat

SEQ ID NO: 18925 - DNA, 80 bp, Homo sapiens
  misc_feature 28: w=a or t
  misc_feature 34: y=c or t
  misc_feature 39: w=a or t
tagatggacttttctcagtttttttttwcttttyctttwaactttcattttaggtttgggggtacatgtgaaggttaaaa

SEQ ID NO: 18926 - DNA, 357 bp, Homo sapiens
  misc_feature 111: r=a or g
  misc_feature 112: w=a or t
  misc_feature 113: w=a or t
  misc_feature 122: m=a or c
  misc_feature 123: y=c or t
  misc_feature 134: r=a or g
  misc_feature 137: r=a or g
  misc_feature 277: n=a, g, c or t
tccacaagatcatttggctagcaactgtggaatcctttgttctctcagaaatgactagctaaaagtgttttggtaaacgttttcccaactctttaaagtctgcattttgtrwwcattgggamytctgttttggragrggaacatcagtttgctcaagttactcttcccacctgtgattctgttgtgaagaatctgtgtgtgccaattctcagtatgtatggaccacttacaggcaaggttgggacatagggtggcaggtgggaaccagacatttaantgtcatcaacttcattacaaatgtctgtttatttaatcagtgctgtttaaagcaccaggtcatggaaaactcaggaactc

SEQ ID NO: 18927 - DNA, 272 bp, Homo sapiens
  misc_feature 135: b=c or g or t
  misc_feature 144: y=c or t
  misc_feature 151: m=a or c
  misc_feature 202: n=a, g, c or t
  misc_feature 229: s=g or c
  misc_feature 232: y=c or t
  misc_feature 233: s=g or c
  misc_feature 234: m=a or c
tggacacaccagtgattcacccggggggtgaggtttgcagtttgcatggagaaactgtgcttgccagatggcagctgttaatctgcttgcatcaggggtgcgaggaggcctacgtttgcctggcccctaagccabtggggctcyccctcamctctgattatacaatgaccttgtggcaggccctgttctccactcccagcangcctgaaggcactggggggattggatsccysmtgaagggaaggaatactttttctggccttcttacaaga

SEQ ID NO: 18928 - DNA, 141 bp, Homo sapiens
tttttcagattaaggattttggggtaccaaaaagccatgtgacttagtagtggtttgaagtgcatcattttcttaccaatgggacaagatatctgaatacactgaattagaaaatgttaagataaaagcaaaattcaagcc

SEQ ID NO: 18929 - DNA, 56 bp, Homo sapiens
  misc_feature 31: m=a or c
tctcctgcctcagtctcctgagtagctgggmttacaggcgtgtgccaccacaccca

SEQ ID NO: 18930 - DNA, 145 bp, Homo sapiens
ttttttattcatctctaaaaatttacttatcctggcagggcacggtggctctcgcgtgtaatcccagcaatttgggaggccgaggcgggtggatctctaggtcaagagatcgagaccatcctggccaacatggtgaaaccccgtc

SEQ ID NO: 18931 - DNA, 128 bp, Homo sapiens
taagaaacatgccttttgggaggctgcaggcaggagaatggtgtgtgcacccgggagccagagcttgcagtgagctcagattgtgccactgcactccagcctgactccatctcaaaaaaaaaaaaaaa

SEQ ID NO: 18932 - DNA, 186 bp, Homo sapiens
  misc_feature 173: d=a or g or t
ttcttgcagagatatttacgtagctgggcaaaaatggcccagtttacaccatattctcttccaaagaaagcaaacagatattcaaaacctgattgctcttcattcaactatatgttttaatagacaaacaaatatatagctagtgagaacttagctgtcattaccttgccctdaagtatcccccct

SEQ ID NO: 18933 - DNA, 349 bp, Homo sapiens
  misc_feature 343: s=g or c
  misc_feature 344: b=c or g or t
actccacccttgcatcctctctaatctctgtcatttctgtattatgtaagagctcctttaatgtgctgtgatgtgttaggcctcagtgctttcaaacattctgtttcctcctttgcaatattgaatcccacctccacccctaatgtggccagactgctgcttatctttcaaaacccaacttgaggattacttcatttcttgcttttcattttggctttttgtgctgtatcacaattcttttatcacatttgtctttttaatagactgcccttcaagacaatagagatagatcagtaatattcttacatgtcttatttccattgcctactatgatgtcttgacsbagata

SEQ ID NO: 18934 - DNA, 143 bp, Homo sapiens
actttaagttttagggtacatgtgcacaatgtgcaggttagttacatatgtatacctgtgccatgctggtgtgctgcacccattaactcgtcatttagcattaggtatatcgcctaatgctatccctcccccctccccccaca

SEQ ID NO: 18935 - DNA, 192 bp, Homo sapiens
  misc_feature 131: r=a or g
gtgacaaagtaccacagactgggtggttgaaacacagaaatttattttctcacaatttcggaggctctagaagtctgagatcaaggtgttggcaggtttggtttattctaaggcctttctctatgggcttrtagatggccttctatctctggtgttttcatgcggtctttttcactgtgtgtgtgtgtgtgc

SEQ ID NO: 18936 - DNA, 133 bp, Homo sapiens; identical to SEQ ID NO: 18568

SEQ ID NO: 18937 - DNA, 139 bp, Homo sapiens
cttgggactcggagagcgtctggaggcggggcctggacttcacgcccggcgcgctcctcccctttaaggcgcgcggccgggcggggcccctatgacccctttaaggcgcggccagagtcctcccgcagaaaaacgaccc

SEQ ID NO: 18938 - DNA, 72 bp, Homo sapiens
tctttacaccattcccccccaccccgcccaagtgagctgtgtcctagaggttcattctttcttttttttttt

SEQ ID NO: 18939 - DNA, 188 bp, Homo sapiens
  misc_feature 41: m=a or c
  misc_feature 126: m=a or c
  misc_feature 129: r=a or g
  misc_feature 132: w=a or t
  misc_feature 139: w=a or t
  misc_feature 141: y=c or t
  misc_feature 142: r=a or g
  misc_feature 143: m=a or c
aatcttgacttgcaggggccctttgcaaagcattgggaggmgccctaacaatgtgtagttgtaattctgtgttctttttcttaaaagggtgtgctcccagatgagtaaattcggtacccacaaaamttrggwtgcactwcyrmgcttctaccttcttttggaagggaactatgcatttggagggccaa

SEQ ID NO: 18940 - DNA, 77 bp, Homo sapiens
atctccgtgtccctgtgactcgagaccgcggctgtcgggtctccccctctctgaccctgcgtctctgtccccgccgt

SEQ ID NO: 18941 - DNA, 148 bp, Homo sapiens
  misc_feature 125: w=a or t
  misc_feature 127: y=c or t
agccttttaagccaggtggtgggagagcagctgagctctgtcagccaccccgctgccccctatgggtatgccctgctccccaactctggcccctgaatccctttagtccactaagaataaacatwcytcctttatgaaaaatgccaat

SEQ ID NO: 18942 - DNA, 325 bp, Homo sapiens
  misc_feature 124: w=a or t
  misc_feature 127: w=a or t
  misc_feature 130: w=a or t
  misc_feature 143: m=a or c
  misc_feature 151: w=a or t
  misc_feature 308: n=a, g, c or t
  misc_feature 309: n=a, g, c or t
atccaccatgatcaagtgggtttcaaatgcagggatggcttaatatatgcaagccaataaatgtgatacaccacataaacagaattttttttttatgtttaactttttttttaattattattawaawttwaagttttagggtmcatgtgcwcaatgtgcaggttagttacatatgtatacatgtgccatgctggtgtgctgcacccattaactcgtcatttagcattaggtatatctcctaaggctatccctcccccccaggaggggggaggagaggaaaggatggaaagctggtcaacgtggtgaannccgtctgtactaaaaa

SEQ ID NO: 18943 - DNA, 55 bp, Homo sapiens
  misc_feature 5: w=a or t
  misc_feature 7: y=c or t
  misc_feature 15: r=a or g
  misc_feature 26: m=a or c
  misc_feature 27: r=a or g
  misc_feature 41: w=a or t
atttwtygtaaagcraacagaacccmrtgcctccctttgcwcctggatgccccac

SEQ ID NO: 18944 - DNA, 193 bp, Homo sapiens
aaggcagagggatcagttgagcctgggagttcgagtccagcctgggcgacatagtgagaccccttctaaaaattaggcaaggtggtgcacgcttatattcctagctacttgggaggctgaggtgggaggattgtttgaatctaggatttgaaggttacagctatgattgtgccactgcactccaacctgggca

SEQ ID NO: 18945 - DNA, 108 bp, Homo sapiens
attctggttgaactaaatatttccctcctctcactctcatataaaacccattgagggctgggcgcggtggctcacgcctgtggtcccagcactttgggaggctgaggt

SEQ ID NO: 18946 - DNA, 126 bp, Homo sapiens
ggcgcgcccagctccccgagagcaagcgtttcggcaacactgggcaggctgttagaggctcccgggctctgtcttgtcagagagaaatcaaacttctgcgtgcgaggagacagcgtggccagggca

SEQ ID NO: 18947 - DNA, 132 bp, Homo sapiens
gatattgagagtccaaaaccagtttctttgggagaaatataaaaggtgagtcagatgtatgaaaagttcaagacggccgggcgcagtggctcaagcctgtaatcccagcactttgggaggccgaggcaggca

SEQ ID NO: 18948 - DNA, 246 bp, Homo sapiens
  misc_feature 11: w=a or t
  misc_feature 12: w=a or t
  misc_feature 137: m=a or c
  misc_feature 148: r=a or g
ctttgggaggwwgaggcgggtggatcatctgaggtcaggagttcgagactagcctagccaacatgacaaaaccccatctttactaagagtacaaaaattagctgggcgtggtggcacgtgcctgtagtcccagctamttgggaggctraggcaggagaatcgcttgaacccgggaggcggaggttgctgtgagccaggatcgcgccactgcactccagcttgagcaacagagtgagactccatctc

SEQ ID NO: 18949 - DNA, 274 bp, Homo sapiens
  misc_feature 103: r=a or g
  misc_feature 104: r=a or g
  misc_feature 140: m=a or c
  misc_feature 256: n=a, g, c or t
  misc_feature 257: n=a, g, c or t
  misc_feature 258: b=c or g or t
agtggcggccaggccgggacacggagcctgcaggcctgaaccagggtgatgctgaagatgatgaccttcttccaaggcctctagagccatcagcctgtgccarrcaccctcgacttgcctagaggcccccaaaagtttgmcagtccacatcagaggcagagtcagaggcctccatgtcggaggcctcctctgaggacctggtgccacccctggaggctggggcagccccatatagggaggaggaagaggcggcgannbagaagaaggagaagaa

SEQ ID NO: 18950 - DNA, 165 bp, Homo sapiens
  misc_feature 12: k=g or t
  misc_feature 15: w=a or t
  misc_feature 16: w=a or t
  misc_feature 88: r=a or g
  misc_feature 113: h=a or c or t
  misc_feature 114: n=a, g, c or t
tgcttttggttktgwwttaagagatggcctattgctctattgcccaagtgggagtacagtggtacaatcatagctcactgcagccttraactcctgggcccaagcaatcctchngtctcggcctccgaagtactgggactacaggcatgtgccaccatgcccagc

SEQ ID NO: 18951 - DNA, 223 bp, Homo sapiens
aggcataaagttgtttgtaacatcctcttgtgatctttttaaagtcaatgggactgtagtaatgtttcctttttattcctgacattgagatttgtgcgtccactcttttttgttgttgtttttttgagacaagatcttgctttgtcacccaggctggagtgcagtggtgcgatcatggctcactgcagctttgaactcctgagctcaagcggtcttcccccca

SEQ ID NO: 18952 - DNA, 140 bp, Homo sapiens
  misc_feature 117: m=a or c
tcaatggattattataatgactaaattataagaaagattcatggaaagcatttagccagtgcctagaatatagaaattgttcttcaagaatattcaatatttacccgaactcatcamtccaggcttccctcctgcccaat

SEQ ID NO: 18953 - DNA, 162 bp, Homo sapiens
agattggcctggcgtggtggcgcgtgcttgtggtcccggctactcgggaggctgaggcaggagaaccatttgagcccgggaggtggagtttgcggtgagccaggattgcgccattgcactccagcctggcaatagagtgagactccgtcttaaaaagaaaaa

SEQ ID NO: 18954 - DNA, 187 bp, Homo sapiens
  misc_feature 122: m=a or c
tcttcgggaactctcactctctcataaactactttattaccatcccaccatatcctgtcctctttttttggcctacttagatctgttttcctttcttgccttaaatgggaattgctagaggmatatgtttctaactttttttttctgcacacaagttcatggtccttctatacttgatagcccagct

SEQ ID NO: 18955 - DNA, 68 bp, Homo sapiens
  misc_feature 15: b=c or g or t
gcagccactgcttabactgaagagggaggacgggagaggagtgtgtgtgtgtgtgtgtgtgtgtgtgt

SEQ ID NO: 18956 - DNA, 309 bp, Homo sapiens
  misc_feature 126: r=a or g
  misc_feature 128: w=a or t
  misc_feature 130: r=a or g
  misc_feature 131: r=a or g
  misc_feature 136: w=a or t
taatcccagcactttgggaagttgaggcaggtggaccacctgaggtcagaagttcgagaccagcctggctaacatggcgaatccatgtctgtactaaaaattaaaacaaaaaaatagctgggcatrgwgrrcaagwgcctataatcccagctagtcaggagactgaggcaggagaatcatttgaacccaggaggcggaggctgaagtgagacgaagttgtgccattgctctccagcctgagcaacaagagtgacagggcaagactccatctcaaaaaaaatgaaaaaaatttgccaaacgctgttagtt

SEQ ID NO: 18957 - DNA, 189 bp, Homo sapiens
cgcctcagcctcccgagtgctgggactacaggtgcctgccaccacacccagctaattttttgtatttttagtagagatggtatttcactgtgttagctaggatggtctcgatctcctgacctcatgatctgcccacctctgcctcccaaagtgttgggattataggtgtgagccaccacgcccgaccaa

SEQ ID NO: 18958 - DNA, 189 bp, Homo sapiens
gtaggaggcatatgcactatactcagcaaactaaagcagcaacagaaaaccaaataccacatgttctcacttgaaagtgggagctaaatgatggaacacatgaacacacagaggggaacaacacacacggggactgattgggggtttgtggtacagatttgatcactcaggtattaaacctagaaccca

SEQ ID NO: 18959 - DNA, 98 bp, Homo sapiens; identical to SEQ ID NO: 18439

SEQ ID NO: 18960 - DNA, 222 bp, Homo sapiens
  misc_feature 128: r=a or g
  misc_feature 136: y=c or t
  misc_feature 137: w=a or t
tttcctgaatgtttatagggctattcaagtgatgtattttgtatgtgtaagttgtggtagtttgtgtttttttgaagaagtggtccgtttcatctaacttgttgaattaatatgtgtagagtttacartgtttccywtattatccttttgatgtctgcaggatctgtagtgatatctcctgttttattcccgatgttgctaattgtgtttgtctgtgggggc

SEQ ID NO: 18961 - DNA, 101 bp, Homo sapiens
ctgaaaccatggaaaacaaaacctcggataaaaggagactactgtatatactttttaaaactgatgaaatattaaactcatgtttcttctatatcccacca

SEQ ID NO: 18962 - DNA, 119 bp, Homo sapiens
  misc_feature 47: s=g or c
tcttgggaggctgaggcaggagaatggcatgaacccgggaggcggasttgcagtgagctgagatggcgccactgcactccagcctgggcgacagagcgagactccgtctaaaaaaaaaa

SEQ ID NO: 18963 - DNA, 95 bp, Homo sapiens
  misc_feature 16: w=a or t
  misc_feature 17: w=a or t
agagcaagttcacagwwattgatacaaaaacttttttgaatcttgaaaagatgctcaatttcataaaatgccagtttcttttttttttttccttt

SEQ ID NO: 18964 - DNA, 190 bp, Homo sapiens
aaagcatttgaatttttattttctgtgtaaaaagaatacctaattgtattttaaacagagtataataaatattttatttttctaagtaattattaccctttttaaaacctgacctctgattataacttggtttctttgagtccccacccaaatcttatctcgaattagaatccccataatccccacggtt

SEQ ID NO: 18965 - DNA, 331 bp, Homo sapiens
  misc_feature 297: b=c or g or t
tgtgcatttcatcagcaagcttgggactagaaaaattgaacttgggctgggcgcagtgtctcacgcctgtaatcccagcactttgggaggccaaggcgggtggatcgcctgaggtcaggagttcgagaccagcctggccgatatggtgaaaccccatctctaccaaaaatacaaaaattggccaggcgtggtggcacacacctgtaattccagctactcgggaggctgaggcagaattgcttgatcctgggaggcggaggttgcagtgagctgagatcgcaccattgcactacagcbtgggtgacagagtgagactccatctcaaaaaaaa

SEQ ID NO: 18966 - DNA, 86 bp, Homo sapiens
tgtcttgtgccagttttcaaagggaatgcttccagtttttgcccatccagtatgtaattggctttgggtttatcataaatagctct

SEQ ID NO: 18967 - DNA, 124 bp, Homo sapiens
  misc_feature 108: v=a or c or g
taattttttttgtatttttaatggcgacagggtttcaccatgttagccaggatggtctcgatctcctgacctcgtgatcccaaagtgctgggattacaggcgtgagcvaccatacccgtcacca

SEQ ID NO: 18968 - DNA, 96 bp, Homo sapiens
cggtggctcacgcctgtaatcccagcactttgggaggcctaggtgggcggatcacctgaggtcaggcagttcgagacctcctggccaacatggtga

SEQ ID NO: 18969 - DNA, 251 bp, Homo sapiens
  misc_feature 119: r=a or g
tatttatttatttattttgagacagagtctcgctctgttttccaagctggagtacagtggcacaatctcggctcactgcaacctccgcctcccgggttcaagtgattctcctgcctcarcctcctgagtagctcggactacaggcgcgtaccacaacgtccggctaattttttgtatttttagtagagacagggtttcaccatgttagtcaggatggtcttgatctactgacctcatgatccgcccgccaa

SEQ ID NO: 18970 - DNA, 99 bp, Homo sapiens
ggtctcactctgttgcccaggctggagtgcagtggtgtgatcttggctcactgcaacctccacctcctgggttcaggcatagtggtacgtgccggtagt

SEQ ID NO: 18971 - DNA, 173 bp, Homo sapiens
  misc_feature 128: s=g or c
  misc_feature 130: y=c or t
  misc_feature 134: m=a or c
gtagctggcactacatgtgcacaccaccatgcccagctaattgtttgtattttttagtagagacagaatttcaccgtgttagccaggatagtctcaatctcctgacttcgtgatctgcccgcctcagscytccmaaagtgctgggattacaggcttgagccaccgcacccgcc

SEQ ID NO: 18972 - DNA, 88 bp, Homo sapiens
tttagaaataatttcctagttttctgaacatctaaatattttcacttatactttttttgcattagtcccaatatatttgtactttttt

SEQ ID NO: 18973 - DNA, 312 bp, Homo sapiens
  misc_feature 150: d=a or g or t
ctttctgaattgggaggaaaaccaaccaatgtatgtatgagaaactcagaagtctgaatagaaaaacaaagtaaatggcagaagattctcgagtttatgcccgcgtaggtttggagtgttgaaaaaagctaaaatgtttagtttcacttdgccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccgtc

SEQ ID NO: 18974 - DNA, 250 bp, Homo sapiens
agagtttaaagtgagaaaatatgatttatctgaataaatggcccagggccaggtttatgtaagaacgtatttcatgtttttgtccaaataagctctcaggctttgaaacttccttttataaagatgagtgctatttattccagctaagaaaattcttccccatttatccattgtctgtgaggggatcatgtgtgtgcgatgctttaagaatcctagctcaggaacagaagttaacactccacaccccact

SEQ ID NO: 18975 - DNA, 65 bp, Homo sapiens
tatttttgggcacatttttacaacttttaaaaaaagctttttttttttttttttttttttttttt

SEQ ID NO: 18976 - DNA, 309 bp, Homo sapiens
  misc_feature 222: s=g or c
  misc_feature 273: n=a, g, c or t
  misc_feature 274: n=a, g, c or t
  misc_feature 276: n=a, g, c or t
  misc_feature 277: n=a, g, c or t
  misc_feature 294: n=a, g, c or t
  misc_feature 295: n=a, g, c or t
  misc_feature 296: n=a, g, c or t
tctgattttttttcaaggtttttacctcctttgccacggttttgaacttcctcctttagttcgaggtagtttgatcgtgtgaagccttcttctgatgactcatcaaagtcattctccatccagctttgttccattggtgatgaggagctgcattcctttggaggaggagaggcactctgatttttagagtttccagtttttctgctctgttttttccctatstttgtggttttatctacctttggtctttggtgatggtggctcacccctgtnncnnagcactttgggaggctnnngcgggtggatcac

SEQ ID NO: 18977 - DNA, 88 bp, Homo sapiens
aaaacaggatgttgaattttgtcaaatactttttctgtatctattgagatgaccatatgattgttatcctttattctgttaatatggt

SEQ ID NO: 18978 - DNA, 131 bp, Homo sapiens
  misc_feature 126: k=g or t
agacaccagttgtttttttcttctttttttctatttttttgtttttatttttgagacaccatttaaaaaatgcttttaatacactttgttttcaaatttttttgagacatattcttgctgtgtcakcctta

SEQ ID NO: 18979 - DNA, 206 bp, Homo sapiens
  misc_feature 133: w=a or t
catacactttctctgtatctgggtatctcagtctcagcactgttgatgcttgaagccagataactctttgttgagggagccattctgtgcattgtgaggtgtttagcagcatcctggccttcaccttcccagwtgccagtagcactcaacctccccaaaatgtctccagacactggcagatgtcccctgcggggcaaaccacccca

SEQ ID NO: 18980 - DNA, 63 bp, Homo sapiens
  misc_feature 39: r=a or g
caatgaatgaccagctaccaaagctctctagttcacgaraaggaaaggtgttcaccataaata

SEQ ID NO: 18981 - DNA, 116 bp, Homo sapiens
cttggaaaattcccttcccatggagctttgtggatgcacaaggacttgcacaaagaaaacattcaatatccaggactataaaattccacaaatgattgtgcttattaccaagaatt

SEQ ID NO: 18982 - DNA, 97 bp, Homo sapiens
  misc_feature 16: r=a or g
  misc_feature 53: m=a or c
ttcaaaagagtaaaartagtagatatgaacttaaatttacaaataaatatgcmaatcgaacaaataatacaaataattccctaaagtcttctacaga

SEQ ID NO: 18983 - DNA, 103 bp, Homo sapiens
gccatttgtatatatttgaaaaatatctattcaaatacattgcctgctttaaaatactgttattggtctttttatcattggattgtatgagttctttatatat

SEQ ID NO: 18984 - DNA, 112 bp, Homo sapiens
  misc_feature 13: v=a or c or g
  misc_feature 68: h=a or c or t
  misc_feature 73: m=a or c
  misc_feature 74: m=a or c
gacgggttttgcvatgttggacaggttggtcttgaactcctgatgtcaggtgatccacccatctcgghccctmmccaaagtgctgggattacaggtgtgagccaccatcccc

SEQ ID NO: 18985 - DNA, 77 bp, Homo sapiens
ctttaagtttgactattttagattccacatatgtgagatcatacagtatttgtcttttttttttttttttttttttt

SEQ ID NO: 18986 - DNA, 246 bp, Homo sapiens
  misc_feature 222: n=a, g, c or t
aatagacgaaaaaaaataaaagaaggaaccagccaggcatggtggctcacctgaggtgaggagttcaagaccagcctggccaacatggcgaaaccctgtctctactaaaaatacaaaaattagctgggcgtggtggcggatgcctgtaatctcagctactcaggagtctaaggcaagagaattgctggaacccaggaggcggaggttgcagttgcagtgagncaacattgcgccactgcactccaa

SEQ ID NO: 18987 - DNA, 131 bp, Homo sapiens
aggtacatgtgcacaatgtgcaggttagttacatatgtatacatgtgccatgctggtgtgctgcacccattaactcgtcatttagcattaggtgtatctcttaaagctacccctcccccctccccccacaa

SEQ ID NO: 18988 - DNA, 165 bp, Homo sapiens
  misc_feature 78: k=g or t
  misc_feature 104: k=g or t
  misc_feature 123: k=g or t
  misc_feature 127: r=a or g
  misc_feature 131: k=g or t
  misc_feature 148: w=a or t
  misc_feature 163: k=g or t
  misc_feature 164: w=a or t
tgtagataagaaattttcattttgagtttttagtatatcaagcatgtggtattgtacctaggaagttttattgttttkttgttgttgttttgttcttttgcttktttttttaaaaaaaaccakaaarccaktactggaaaaatagggwtttggtgagggccakwa

SEQ ID NO: 18989 - DNA, 88 bp, Homo sapiens
  misc_feature 81: y=c or t
atttatacaagtacattattgggtattataaataattaggctctgtataaggttattagaccttttggcttaaaagtataycatttga

SEQ ID NO: 18990 - DNA, 162 bp, Homo sapiens
ccttttattcccttaaccttagcagcaatactgatctttattctgtactgtattctttagaatttagaatagtcagtaacaatatctactgaaatacagcatttggattaactaatgtgtctacacatccacttattcctaataactttcgatgtagagaaa

SEQ ID NO: 18991 - DNA, 209 bp, Homo sapiens
  misc_feature 173: d=a or g or t
aaaacctcaatgcaccaccacctgccccagttcatctgggagaaacttcagccacttctttttgatcccaagttttctgctttaaacctcaggggtaggtaatggaaaaaaaaatacaaaaaacaaaaaaacagattagtgctaagaagctaaggatcacacagcaagttttdggatgggtctgcccacctccgtgcggctttgtcatc

SEQ ID NO: 18992 - DNA, 127 bp, Homo sapiens
  misc_feature 15: k=g or t
  misc_feature 16: k=g or t
tttatttatttattkktttgagatagagttttgcacttgttgcccaggctggagtgcggtaacacgatctcgactcactgcaacctccgcctcctgggttaaagcaactctcctcacccagcccccc

SEQ ID NO: 18993 - DNA, 75 bp, Homo sapiens
ttgagagatttcatctactaaagagcatttggtttttcaaaacatccctgaactgtataatttacaaaaaaaaaa

SEQ ID NO: 18994 - DNA, 226 bp, Homo sapiens
  misc_feature 98: d=a or g or t
  misc_feature 130: r=a or g
  misc_feature 131: r=a or g
  misc_feature 198: r=a or g
  misc_feature 209: h=a or c or t
  misc_feature 225: y=c or t
cctccgcctcccgagttcaagtgattctcctgcctcagcctcctcaatagctgggattacaggcacctgccaccacacccagctaatttttgtatttdtagtagagacacagttttaccgtgttggccarrctggcctcgaactcctgaccttcgggtggatccgcgtgcctctgcctcccaaagtgttgggattacragcattaagchcaccatgcccggccayt

SEQ ID NO: 18995 - DNA, 81 bp, Homo sapiens
  misc_feature 46: w=a or t
ttgctgtctaggggtgccaaagctgccagagacaatgcataagcgwataggtgtggccgtgtgccaatataactttttttt

SEQ ID NO: 18996 - DNA, 173 bp, Homo sapiens
gagtgaggctctagggaccatcagtttttgtctttagtgctaaaatggtggctgagtgacacaccatgattttttttctcaatatttcatcattctaccagtgttggaaaagggagagaaggactctctgaaggagactgtgctaaggattcttttttttttttttttttttt

SEQ ID NO: 18997 - DNA, 51 bp, Homo sapiens
gcactccagcctgggcaacagagtgagactccatctcaaaaaaaaaaaaaa

SEQ ID NO: 18998 - DNA, 141 bp, Homo sapiens
  misc_feature 82: w=a or t
acttaaaaatgtcattgtataaagcctcctgacttagccgagactataggcgtgtgcccccatgcctggctaatttttgtawttttagtagagactgggtttcaccatgctggccaggctggtctcgaactcctgacctca

SEQ ID NO: 18999 - DNA, 132 bp, Homo sapiens
  misc_feature 115: r=a or g
  misc_feature 116: r=a or g
gatattgagagtccaaaaccagtttctttgggagaaatataaaaggtgagtcagatgtatgaaaagttcaagacggccgggcgcagtggctcaagcctgtaatcccagcactttrrgaggccgaggcaggca

SEQ ID NO: 19000 - DNA, 95 bp, Homo sapiens
tgttatacaaactgttgtgcactttaatgtttggaaggagtaatttttaatttggtggttataagtctggtgctggtaatacagaaagaggtaac

SEQ ID NO: 19001 - DNA, 158 bp, Homo sapiens
aaaataaattatattacatatgaaacccttatgtatatggtcaaatgatttttttcacaagggtgctgagaccattcaatgggaaaagggcagtcttttcaacaaatgtgggaaaactggatgtccacatgcaaacgaatgaatttgaaccctcacca

SEQ ID NO: 19002 - DNA, 107 bp, Homo sapiens
ttaaattattgttgactatagtcaccctgttgtgctatcaaacactcgatcttactcattctatctaactatactttgtacctaactcctagttttttttttttttt

SEQ ID NO: 19003 - DNA, 174 bp, Homo sapiens
agaggccacgcccccggaagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggaggacc

SEQ ID NO: 19004 - DNA, 121 bp, Homo sapiens
taaaccctattaaacaagatgtgaaaaaaggaaaacttcgctatgttgcgaatttgttcccgtataaaggatatatctggaactatggtgccatccctcagacttgggaagacccagggca

SEQ ID NO: 19005 - DNA, 138 bp, Homo sapiens
ttaagttctgggatacatgtgcaggatgtgaagatttgttacataggttaacgtgtgccgtggtggttgctgcacctgtcaacccctcacctaggtattaagcccaacatgctttagctatttttcctgatgctttcc

SEQ ID NO: 19006 - DNA, 141 bp, Homo sapiens
  misc_feature 121: w=a or t
  misc_feature 122: y=c or t
agacggagtcttgctttgtcgcccaggctagagtgcagtggcacaatctcggctcactgcaacctctgcctcatgggttcaagcgattctcctgcctcagcctcctgagtagctgggattwyaggtacgcgccatcactcc

SEQ ID NO: 19007 - DNA, 128 bp, Homo sapiens
caggtagtttcagcagccagacttgcatagcacttgaggagaattatatttctagagcaatgttatgtacctgagtgctatttctcctgttccttccgattggggtcaaactttcacatttctcttcc

SEQ ID NO: 19008 - DNA, 148 bp, Homo sapiens
  misc_feature 20: s=g or c
cgtgaacctgggaggcggasttgcagtgagccgagatagtgccactgcactccagcctgggcgacagagcgagactctctcaaaaaaattaaaataaaataaaaacattaaaaaaaaaagagtataggatgcttctcctctccccgca

SEQ ID NO: 19009 - DNA, 148 bp, Homo sapiens
  misc_feature 147: m=a or c
cattagtgattcatctccttttatcatatgaaaagttaatgattacaacatataatatagtaatttgttttggaaaatgccctctttcaaacactgttagtgtttcacaaaactttaaaaaaaaaaaacttactaggggccgggcama

SEQ ID NO: 19010 - DNA, 54 bp, Homo sapiens
  misc_feature 8: w=a or t
  misc_feature 50: w=a or t
aaaaaaawtcaaaatacaaaaccttcatttgtgaaaaatgaaagttttgwattt

SEQ ID NO: 19011 - DNA, 143 bp, Homo sapiens
  misc_feature 11: y=c or t
  misc_feature 42: w=a or t
  misc_feature 80: y=c or t
  misc_feature 92: w=a or t
  misc_feature 93: k=g or t
  misc_feature 118: k=g or t
  misc_feature 121: y=c or t
  misc_feature 127: d=a or g or t
tttcattaatyagtgatatttgggggtgtaaatataccttcwtattaaacacactctcttttttctgcctgctccatgtyatattcctttcwkgccctttttcagattgataagattkttyactatdtcatttccccctgcct

SEQ ID NO: 19012 - DNA, 89 bp, Homo sapiens
cccagaccggtcttgaactcctggcctcaactgatgctcctgcctctgggtctcaaagtgctgggattacaggcgagaggcaccacgct

SEQ ID NO: 19013 - DNA, 214 bp, Homo sapiens
  misc_feature 184: m=a or c
catctttcaaactttatcttcctcttccagtgttcccatccacattgataatctcactcctaatttgggtgctttcactttgttgccaaggctggagtgcagtggcatggtcttggttcactgcagcctcaacctaccagggctcaggtggtcttcctacctcagcctcctgagtagctggaamtacacatgtgtagcacctttttctatcttt

SEQ ID NO: 19014 - DNA, 119 bp, Homo sapiens
  misc_feature 41: r=a or g
tagcattatgttactctgtgtattaaaagcacatcaaaatrgcactgtgtgtaaatcatttgatttaagtcatattcagaatgtagtgcctttaatttcataatacacaaaatatacat

SEQ ID NO: 19015 - DNA, 153 bp, Homo sapiens
  misc_feature 56: m=a or c
  misc_feature 145: r=a or g
tggacaggacagaaaagcgagtcgcaggaggaagggagatgcagccgcacaggggmtgattaccctcctaggaccgcggtggctaagtcattgcaggaacggggctgtgttctctgctgggacaaaacaggagctcatctctttrgggtcaca

SEQ ID NO: 19016 - DNA, 145 bp, Homo sapiens
caattggatagtgcatgttggaggaaacagcatgcagctgggagttgagacaagtcaggcatgtttggggagacagtaaagagacccttttagtggtaggtaagactatatagtggtagtttaaattagattgatagaggcctaa

SEQ ID NO: 19017 - DNA, 125 bp, Homo sapiens
cccactcattaacacttacttgccacctttcttggattggccctcatccaagggggacatccctacccccactcctcagccccccttctgtttcctaatctctctcttttttttttttttttttt

SEQ ID NO: 19018 - DNA, 109 bp, Homo sapiens
  misc_feature 100: y=c or t
  misc_feature 101: w=a or t
ggatgtgagggcgatctggctgcgacatctgtcaccccattgatcgccagggttgattcggctgatctggctggctaggcgggtgtccccttcctccctywccgcccct

SEQ ID NO: 19019 - DNA, 145 bp, Homo sapiens
gcatggtggtgcacaactgtagtctcaactactttggaggctgaggcaggaggattgcttgaacccaagaagtcgaggctgtgttaagccttgagcatcccactgcactccagcctgggtgacagagtgcaatactcttccagaa

SEQ ID NO: 19020 - DNA, 161 bp, Homo sapiens
tacaaaaaattagccaggcgcagtggtgggcgcctgtagtcccagctactcgggaggctgaggcaggagaatggcgtgaacccaggaggcagagcttgcagtgagctgagatcacaccactgtattccagcctgggccacagaatgagacgccatctcaaa

SEQ ID NO: 19021 - DNA, 352 bp, Homo sapiens
atcattcagtgatactgtgtcatttgtataggtccttccctgtggttctgaagaataaattagtatcttggtcatttgaaaaagtaattttagcttgtagacttcctgtcacacttgagtagcttttggaaagtataatatttttacccaaatcccattaaatgttaggcgctctttctatatgccctttactgtccttttactgattagtgaaatatttatgtgaacccagaaggctgatttatttattttattgtcttttttaataacttgcttctccctagtgctgggtgctttctgaggcccagacaaccatcatgatttctttggtgataatcttctgccctcccac

SEQ ID NO: 19022 - DNA, 66 bp, Homo sapiens
tctcggctactgcaatctctgcctcccaggttcaagtgattatcttgcttcagcctcctgagtatt

SEQ ID NO: 19023 - DNA, 126 bp, Homo sapiens
  misc_feature 65: m=a or c
ctgtccattcccacccctttccccccagcatctggtaaccaccattctactctctacttctaggmgttaaactcttttagagtccagataaaagtgagatcatatggtttctgtctctctgtgcct

SEQ ID NO: 19024 - DNA, 442 bp, Homo sapiens
  misc_feature 230: n=a, g, c or t
gtggccttctcagaccctgtaggaaaggactctgcttatccagtgaaagtgtctacctagactaagaggcattttagttatcttactcggggcatgttgagtaaagctaatttgccagtcctgggtgggggcaaatccttgagcttgatgtgtagggaagggagggggcctgcgtctcgctctgttgtgcaggctggagagcaatggcgtgatatcggctcaccgcaacntccgcctcccgggtccaagccattctccttcctcagccccccgagtagctgggaccacaggcgcctgccaccatgcctgggtaattttttgtatttttagtagaaacagggcttcaccatgctggccaggctggtctccaactcctggcctcaggtgatctgcctgccttggcctcccaaagtgctgggattacaggtgtgagccactgcac

SEQ ID NO: 19025 - DNA, 167 bp, Homo sapiens
  misc_feature 17: n=a, g, c or t
  misc_feature 18: w=a or t
  misc_feature 116: r=a or g
  misc_feature 145: d=a or g or t
aggtgtgtggtgtgtgnwgtatatgtgtggggtgtttgtgtgtggggtgtgtgtgttgtgttgtgtgtgttgtgtgtgggtgtgtggtatgtatgggtatggggggttctgaggartgtgtggtttgaggtatgtatggtgtgtdggggatgtgatgggtgagatat

SEQ ID NO: 19026 - DNA, 126 bp, Homo sapiens
  misc_feature 115: k=g or t
ctactgagaggattaggaggattaatgaaatcatacctgagaaggtctgagaaccgtgtctgcctggccatcaccatcgtcattgtcatctcttggccttctcactgccctggckcaaccgcccct

SEQ ID NO: 19027 - DNA, 114 bp, Homo sapiens
tgatcagttgacaaaaattttgtatcttgagacttatatttgccatagaagaaatgattcagtatttgctaattcagtgttcatggcaacttttttcgttttgttttttttttt

SEQ ID NO: 19028 - DNA, 371 bp, Homo sapiens
ggatagatggatggatagatagatagatagacgaatgatagatagatgattgatagacgacggacagacggacggacggatggatagacagacagacagatagattccccaaaagaatcatctgatcattgtaggtctcaagaatgtatcaaacagtcagagtgcttggcatctaattgacacattcactagtatccattacaccttcctaacagcatcttgatatccttttacagaaattgtctcttccttgttagtaagcagaaaaacaagtatgttgccctcacaatgggagctctaaagatttcttctgacttcttccaacagattaccttagagagagaacacaactagcaagtattccctgccct

SEQ ID NO: 19029 - DNA, 102 bp, Homo sapiens
  misc_feature 16: b=c or g or t
  misc_feature 17: h=a or c or t
  misc_feature 34: s=g or c
  misc_feature 44: m=a or c
  misc_feature 49: s=g or c
  misc_feature 60: m=a or c
  misc_feature 63: s=g or c
  misc_feature 68: s=g or c
  misc_feature 69: s=g or c
  misc_feature 79: m=a or c
ctggaaagggaggagbhaaaaggggaacgctttsttgattgtcmcagcstcattaggagmtascacassgctctcctgmatgctccttgttttctttgtgct

SEQ ID NO: 19030 - DNA, 82 bp, Homo sapiens
  misc_feature 62: w=a or t
  misc_feature 65: w=a or t
agagacctggcagtgtaaagtgcatggcatgttccacaggacagagtctgttccttattgtwgcwggagtactgggaggtga

SEQ ID NO: 19031 - DNA, 198 bp, Homo sapiens
  misc_feature 115: y=c or t
  misc_feature 121: s=g or c
  misc_feature 122: s=g or c
  misc_feature 138: w=a or t
caaaaaaggtacccttgattataaccaaaaatcccttcctgttcattcccttccctaactaactgtataatagctatattaaaacttagagcaaaagaaaaatggaaaacaatgyttgaassaaaaatgcaaaaccawaccaaaaaacaccctagagaagcagaacaatataaaattaaacacacacacacacacaca

SEQ ID NO: 19032 - DNA, 243 bp, Homo sapiens
  misc_feature 149: w=a or t
  misc_feature 161: b=c or g or t
ctcaaactcctgacctcgggtgatccacccgcctcggcctcccaaggtgctggaattgcaggcgtgagccaacgtgcccagcctgtttttgttttttgtgttttgaggcagggtctcgcttcagttcccccaggctggagtgcagtgawcacgataatggbttactgtagctgcaatctcccgggctcaagcgatcctcccgcctcagcctcctgaacggttgggactgcaggcgcaccacca

SEQ ID NO: 19033 - DNA, 179 bp, Homo sapiens
ttcaagaccagcctgaccaacatggagaaaatgtctctactaaaaatataaaattagccgggcgtgatggcgcatgcctgtaatcccctcaggaggctgaggcagcagaatcgtttgaacccaggaggcaagaggctgtggtgagctgagatcatgccattgcactccaacctggacaa

SEQ ID NO: 19034 - DNA, 358 bp, Homo sapiens
  misc_feature 304: r=a or g
  misc_feature 305: r=a or g
ctaatattttcttgacacttagaagccaggagactttcaacactaattaaaacctaggaacataagctactcaatcaaattaggaattaaattaaatgtatgatttggttctgattcttgctaccctgggtgattatcaaaagggttttaaatcatatagaccttaattccataaccacgggatagagtctgtagtattcttttacatatgcccactgtatgactggagtttatgagacagaaatataaaatagcatattaattttcacagaaggaaattagctattatcttataatttttagrrttttccatcagttaaatatgctgccttgagtctcataatatcctgttagctaa

SEQ ID NO: 19035 - DNA, 52 bp, Homo sapiens
  misc_feature 4: k=g or t
  misc_feature 9: k=g or t
  misc_feature 11: w=a or t
  misc_feature 15: d=a or g or t
  misc_feature 25: d=a or g or t
ccckacacktwcggdtcccggcctdgccagttgccagcggccaggggcgcag

SEQ ID NO: 19036 - DNA, 97 bp, Homo sapiens
atttttctttcttggaaacaaggtcttgctatgttgcccaggctgatctcaaattcttggcctcatgtgatccttccacctcagcctcccacatcat

SEQ ID NO: 19037 - DNA, 253 bp, Homo sapiens
  misc_feature 5: m=a or c
  misc_feature 6: m=a or c
  misc_feature 187: m=a or c
  misc_feature 191: m=a or c
taagmmggacttgggattttatctgtgatgtaggcttgatgaaactagtttaatgtaatgtcttaaaatctgttcagatagtaaaaattggtccagaagagccactcagaagtcataatgaagtcattagtaaaaatgttcagtagatgggaagctgcttacataagctaatttgcactgaccaacmaggmacacagtcagtcctctgtacctgtgggttctgcatttgtggattcaaccgtccatggagaga

SEQ ID NO: 19038 - DNA, 115 bp, Homo sapiens
cctcacccggctaacttttttttttcatttttagtagagacgacagggtttcatcgtgttagccaggatggtctcgatctcctgacctcatgatccgcctgcctcaacctccctc

SEQ ID NO: 19039 - DNA, 264 bp, Homo sapiens
  misc_feature 126: w=a or t
tgaatgtgtttgctcttgcttttctagttcctttaattgtgatgttagggtgtcaatttttgatctttcctgctttctcttgtaggcatttagtgctataaatttccctctacacactgctttgawgcgtccagagattctggtatgtggtgtcttttttctcgttggtttcaaagaacatctttatttctgcctcctgaatgactactgggtacatatcgaaatgaaggcagaaataaagatgttctttgaaaccaacgagaa

SEQ ID NO: 19040 - DNA, 97 bp, Homo sapiens
aattctagcagaggtacaaagaggagctggtaccatttcttctgaaactattcccatcaatagaaaaagagggaatcctccctaattcattttatga

SEQ ID NO: 19041 - DNA, 270 bp, Homo sapiens
  misc_feature 257: n=a, g, c or t
tataaagagataaccatactgttgaaatatttggggaatgttctctttcacttactataatactgctaagattccataatttttgcattgttgtggttcattcgctttagctgctgtgtgatattccattgtgtgaagatatcacagtttataaaatcactgtctcttatagatggacatttgagttatttccaggttatcactatcttggttggtactactattaacatacatgtgtctctggttagatgaccaangcttctctggggt

SEQ ID NO: 19042 - DNA, 229 bp, Homo sapiens
cttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagtcattcagtaaaatgcagtcctgctgttttataagcccatgcacaatcacctca

SEQ ID NO: 19043 - DNA, 51 bp, Homo sapiens
  misc_feature 27: w=a or t
gctattactctctcatggaaactgggwgataggagttctatttctctatta

SEQ ID NO: 19044 - DNA, 108 bp, Homo sapiens
  misc_feature 28: m=a or c
cctgtagtcccagctacctggaggccgmggtggaaggatcaattgagtctgggaggttgaggctgcagtgagctgtgatcgcaccacagcactccagcctgggtgaca

SEQ ID NO: 19045 - DNA, 212 bp, Homo sapiens
agcaaaagtaattagttagctgagtatttttgtctaacagcttcaatctgtaaagcacttatttggaggtcataacctcatgtttctttttattttattttatttttttttaagaagttgagttcttactctgttgcccaggctgggtgcagtggtgctatcatggctcactgcagcctcaaactcctgggctaaagcaatcctcctgccca

SEQ ID NO: 19046 - DNA, 140 bp, Homo sapiens
tcttagcctcctgagtcactggaattacaagcacgcccggctaattttggtatttttagtagagatggggtttcaccgtcttggctaggctggtcttgaacacctgacctcaggtggaatccacccacctcggcctccct

SEQ ID NO: 19047 - DNA, 116 bp, Homo sapiens
  misc_feature 112: v=a or c or g
tgggcacctgtaatctcagctgcttggagactgaggcaggagaatcacttgaacctgggaggcagaggttgcagtgagcctagatcgcgccactgcactccagcctgggtgvcaga

SEQ ID NO: 19048 - DNA, 267 bp, Homo sapiens
  misc_feature 117: r=a or g
tgagtttggtttccgtgtgtacaaggaagaaggtgatgagcctggctccagtctgctggcgaactcccctctgatggaggatgctccacagaggctgcggtggcaggcccacctggragtttcacccataaccacgatgtgggggatctcacctgggacaagattgccgtctccctaccccgctctgagaagctccgctccctggtgctggccggcatcccacatggcatgaggccacagctgtggatgcggctctctggggaccct

SEQ ID NO: 19049 - DNA, 120 bp, Homo sapiens
ttttgggttttttttggagacagggtcttgctctgttgcctggactggagtgcagtggtgcaatcacacctgattgcaacctctgcctgctgggctaaagcaatcctcccacctcagccc

SEQ ID NO: 19050 - DNA, 111 bp, Homo sapiens
aaagtgatcaagaaggtaagagtagtaatgattggttttgagaatttaattttctgtgcttatcatggaataaatttagctgaattaaaatgcattataattacaagagtt

SEQ ID NO: 19051 - DNA, 361 bp, Homo sapiens
  misc_feature 70: y=c or t
  misc_feature 146: w=a or t
  misc_feature 348: m=a or c
gctggagtgcagtggcgtgctcttggctcaccgctacatctgcctcccaggttcaagtgagtctcctgcytcagactcctgagtagctgggattacaggcacacaccaccacacttagatggtttttgtatttttagtagagatgwggtttcaccatattggccaggttggtctcgaactgctgacctcaggtgatccacccactttgatctcccaaagtgctgggattataggcatgagccaccgcgcccagcctcattttaataaattaataaattctgctctctctggaggtctagacctttgagaaggcttaaaacaaaaaaggaggccaggcatggggctcamgcctgtaatccca

SEQ ID NO: 19052 - DNA, 125 bp, Homo sapiens
tgactaagtcagttatgtatttttaaatgttaatagtgattatagttaagcctttgagttaagggtgattccctctattttctctgtaatgcggttatattacttttgtaatagccaaaaggaga

SEQ ID NO: 19053 - DNA, 159 bp, Homo sapiens
agacatactttataaagaaacctccaacgtcctcagctctactgcttagctgttgtttgattatatttgaccacattgttacccagtagaatacttctgtgatgggggttttggtatttttcaaaaattaatcccctctgggcatagtctctccctggc

SEQ ID NO: 19054 - DNA, 358 bp, Homo sapiens
  misc_feature 255: s=g or c
  misc_feature 288: n=a, g, c or t
  misc_feature 289: n=a, g, c or t
ctgataatgtcttttgctgtgcagaagctgcttagtttaattaggtcccatctatttatttatttttgttttgttgcatttgattttgggttcttggtcatgaactctttgcctaagtcaatgtctacaagagtttttcccatgttcttctagaatttttatggtttcaggtcttagatttaagtatttgatccatcttgcattgatttttgtgtaagttaagaggcaaggatccagcttcattctacatgtggsttgccaattatcctagcaccatttgttgaatannatgtcctttacccactttatgcttttgtttgctttgtcaaagattagttggctttaagtatttggtttt

SEQ ID NO: 19055 - DNA, 260 bp, Homo sapiens
agcactttgggaggctgaggcaggccgatcacctgaggtcaggagtcccagaccagcctggtcaacatggtgaaaccctgtctctactaaaaatacaaaaattagcgaagtatagtggcgcgcgcctgttaatcccagctactccagaggctgaggcaggagaatcacttgaaccccggaggcagaagttgcagtgagccaaaatcgtgccactgcactccagcctgggcaacagagcaagactttgaccctcccctcac

SEQ ID NO: 19056 - DNA, 167 bp, Homo sapiens
attgttgttgcctggggtctttcagctgttgaaagttcttgtttatctagatgtgacttaaaaaatgaaacacttcaagaatttacgtgtcattcttggcacaggggccatgctaatcttgattgtttgaatttttaatatttttgctaacaaaatgagccctagat

SEQ ID NO: 19057 - DNA, 76 bp, Homo sapiens
  misc_feature 47: m=a or c
cagtgtttgaaatggcaattatcagtgttggatttagttccaactamttgatttacaaaaatgtacatttagagaa

SEQ ID NO: 19058 - DNA, 128 bp, Homo sapiens
  misc_feature 83: s=g or c
agccgggagtggtagcgagcacctgtagtcccagctactcgggaggctgaggcaggagaatggcgtgaacccgggaggcggasttgcagtgagccgagatggcgccactgcactccagcctccatgac

SEQ ID NO: 19059 - DNA, 290 bp, Homo sapiens
  misc_feature 132: m=a or c
  misc_feature 255: m=a or c
  misc_feature 256: n=a, g, c or t
  misc_feature 257: n=a, g, c or t
  misc_feature 276: w=a or t
  misc_feature 284: m=a or c
  misc_feature 289: w=a or t
  misc_feature 290: r=a or g
tgaactacacttttagatcacaccattcaagacataagcttagggcggggcacggtggctcacgctgtaatcccagcactttgggaggccaaggtgggtggatcacctgaggtcaggagtttgagaccagcmtgaccaacatggtgaaactctgtctctactaaaaatacaaaaattaggtgtggtggcacgcgcctgtaatcccagctactcaggaggctgaggcaggagaatcacccaggaggtggaggttgmnntgagccaagatcacatcawtgcactcmagccwr

SEQ ID NO: 19060 - DNA, 281 bp, Homo sapiens
  misc_feature 126: r=a or g
  misc_feature 241: v=a or c or g
  misc_feature 242: d=a or g or t
  misc_feature 278: r=a or g
gtgtgtgtgagagagagagagagagagaatgacgaggaggaggaggagggaagtgagatggcggaaaggaaaactgcttaaatgatttttaaaggtggtgatttttgcttcctgctatttggtttrgcaactcctgtcattttgcagccttgctaagatctgacaagagtgcttaggtgactttattcttctggatgtgtgcagtgggaaactgccttatgcagtgacacagtgcggattvdaggcagtgtagccctggcttgtagagtgcgttggargcc

SEQ ID NO: 19061 - DNA, 116 bp, Homo sapiens
tgagaggagagacatacacagagtatggaatgattacttttatttcagcaaatcacagatgaccaggcatttatcaagcagacaaggattctacaggcatgtcagaaaaaaaagaa

SEQ ID NO: 19062 - DNA, 189 bp, Homo sapiens
ggtcttcttttgagaagtgtctgttcatgtgctttgcccactttttaatgggattgtttgttttttgctcattgacttatttaagttccttatagattctggataataggcctttgccagatgcctagtttagtgagtattttctcccattctgtagggtgtctgtttacttctttgatagtttctctt

SEQ ID NO: 19063 - DNA, 157 bp, Homo sapiens
tgtggtgtatgctgtggtgatcttgctgggaatgattataagtgtgtgtgtggtgggggagtgggtattacatgcattgctgaagagtcatcctggtgttcctcattcctcccaccttcccgtggtcattttaattacggggcagtgtcaccgcagt

SEQ ID NO: 19064 - DNA, 54 bp, Homo sapiens
aagactatactttcagggatcatttctatagtgtgttactagagaagtttctct

SEQ ID NO: 19065 - DNA, 252 bp, Homo sapiens
  misc_feature 121: m=a or c
  misc_feature 137: r=a or g
agccagttcgtggcaggccaaatcctgtttcagtggtcttaccaccacagctcacttccagccacccctgcttacacatactcacctccctgggcctctgctggtccctgggcttcaccamtcagtgaagtccagarccctcccttctccgtacacttttggctgtggctacctcactgcctattctgaagcttagagcaatgttcttgtgattttttctgcagcgcatgtctattgcaattgcctccacat

SEQ ID NO: 19066 - DNA, 226 bp, Homo sapiens
  misc_feature 121: m=a or c
acaacaacaacaagattcaaccttctgctgtcttcaggagacccatctcacctgtaatgacacccataggttcaacataaaggaatggagaaagatctgtcacaaacatggaaagtaaaamaaaacaggcatcattaatttcttgcacagaataaaacagactttaaaaaagacaaataaggccattacataatgataaagcattcagttcaacaagaagacttca

SEQ ID NO: 19067 - DNA, 97 bp, Homo sapiens
gaaccgtttggctctttcccttagtaacagcttttaccttctgcctcaattcctctccccgctcgcgcccttcccccgcgcgccgcctcccaccgcc

SEQ ID NO: 19068 - DNA, 306 bp, Homo sapiens
  misc_feature 15: w=a or t
  misc_feature 16: n=a, g, c or t
  misc_feature 258: n=a, g, c or t
  misc_feature 259: n=a, g, c or t
  misc_feature 278: w=a or t
  misc_feature 279: w=a or t
gtgtggtgctgggawnaatgtatattctgttgatttggggtggagagttctttagatgtctattaggtccacttggtgcagagctgagttcaattcctggatatccttgttaactttctgtctcgtttgatctctctaatgctgacagtggggtgttaaagtctcccattattattgtgtgggagtctaagtgtctttgtaggtctctaaggacttgctttatgaatctgggtgctcctgtattgggtgcatatatanntaggatagttagctcttcwwgttgaattaatccatttaccattacgt

SEQ ID NO: 19069 - DNA, 86 bp, Homo sapiens
ctttgtgaggccgaggtgggaggatcacgaggtcaggagatcgagaccatcctggctaacacagttaaaccccgtctctactaaaa

SEQ ID NO: 19070 - DNA, 94 bp, Homo sapiens
  misc_feature 12: s=g or c
  misc_feature 27: m=a or c
tggattaatacstagtagtgggattgmaggatcgtgtggtagttctatttttaattttttgagaaatctccaactgtttttcatagtagctgta

SEQ ID NO: 19071 - DNA, 102 bp, Homo sapiens
tttgtgatattttggtgcaatcatcacctgagcaacaaacactgaacccaaattatagtcttttatccctcaccccctcccaccctttccctctgagccccc

SEQ ID NO: 19072 - DNA, 135 bp, Homo sapiens
  misc_feature 112: w=a or t
  misc_feature 117: s=g or c
tttttgtatttttagtagagatggggtttcaccatgttagccaggatggtctcgatctcctgacctcatgatccacctgccttggcctcccaaagtgctgggattacaggcwtgaascaccgcgcctggccagca

SEQ ID NO: 19073 - DNA, 192 bp, Homo sapiens
  misc_feature 109: h=a or c or t
  misc_feature 111: w=a or t
  misc_feature 138: m=a or c
  misc_feature 148: k=g or t
  misc_feature 149: m=a or c
  misc_feature 155: h=a or c or t
  misc_feature 171: m=a or c
ttatatttctatgttgctatctatatagaaagagagagaaagcaaatattagcaatcggtgaatctatgttaagggtaaatgggtgctagttttactgttccttccathtwtctgtaagttgaagtttttaaaaatamaaagggtgakmaattahaatgttttaaaaaacmaatatcaaagctttttttttt

SEQ ID NO: 19074 - DNA, 127 bp, Homo sapiens
  misc_feature 112: k=g or t
tatttttagtagagatggagtttcactatgttggccaggctggtcttgaactcctgacctcaggtaatcctcccacctcggcctcccaaaatgctgggattactggcgtgakcaccttgcccggcct

SEQ ID NO: 19075 - DNA, 115 bp, Homo sapiens
tctaccacagatagcatgtcctacaaaaggtccgggcacatctggtctgacatgtgactaggtatatggccaggtattggtatgaatcttgagcctgaggacgacccccgacaaa

SEQ ID NO: 19076 - DNA, 106 bp, Homo sapiens
caagattagtgtacagaaatcagtagctcttatatccacaacagcaaccaaacagagaatcaaatcaagaactcaaccccttttacagtagctgcaaaaaaaaaaa

SEQ ID NO: 19077 - DNA, 124 bp, Homo sapiens
  misc_feature 85: w=a or t
  misc_feature 94: d=a or g or t
ccctcctgccgcgagccacccagggcggcggcctgcagctgcaccagtcgcgggacagataaccacaatggacactgccagccawagccttgtdcttctccagcagctgaacatgcagcgagaa

SEQ ID NO: 19078 - DNA, 102 bp, Homo sapiens
agtggagcatttaggccacttacattcaatgttagtattgcagtgtgaggtcctattctattcatcatgatatttgttgcctgaataccttgttttctttct

SEQ ID NO: 19079 - DNA, 94 bp, Homo sapiens
aatttataatttgagtatgaaatgtatacttttctccacccagagtgattatttttaaaattaaccagtttttgttttttttttttggcccttt

SEQ ID NO: 19080 - DNA, 177 bp, Homo sapiens
ggtgcttaaaacagaaaatgtatgatgggtgtagttattgataataacaatattgaggtcagtgattctcaaccctggctatatattaaagttgccaggggagctggcaaaaaatattgatgactgtcttcactttcagagattctgactacaattgttctggtatgggccctgcat

SEQ ID NO: 19081 - DNA, 393 bp, Homo sapiens
  misc_feature 265: w=a or t
  misc_feature 332: w=a or t
  misc_feature 333: d=a or g or t
  misc_feature 393: w=a or t
taatggttaaatctccctgtcttacagattctatcaattgacttattttcatggaatatttttgactttgtataatcctgtatggctttacttactttcagggatctctttaatagtgcctatctataattttagccattagttccattaaaaaaaatctgtcattaggcatttctagcctagaaaaccagaaaatcatatatcggagcatatatttgagggcctcccagcctgcttcttaaaagtccattcaaaagagttttawttagctgggcatagtggctcacgcctgtaaccctagcactttggaaggctgaagttgggggatcccwdcaactcaggagtttgagaccagcctgggcaatatgaggagacctacttaaaaaacaaacw

SEQ ID NO: 19082 - DNA, 122 bp, Homo sapiens
ccattgaaagctttattttacatctcgatgatgtaaataaaattaaacttgcttaaaattttacattccagtttttggttgtattgaaatacatacttcacagtgtaattcttaagacccac

SEQ ID NO: 19083 - DNA, 188 bp, Homo sapiens
  misc_feature 111: w=a or t
  misc_feature 119: w=a or t
  misc_feature 120: w=a or t
  misc_feature 128: w=a or t
  misc_feature 136: w=a or t
  misc_feature 177: w=a or t
  misc_feature 180: w=a or t
ccagattttgtttgccaagtaggtattattaagtacataccacaattgaggtcttgaagagtgcaccacactaatgggaaatttgagtgtttttccttgacctcatcctgwagttttgwwaaagattwctttaggwtttccacacatggaatcacatggcatcactacccattcccwgcwcctgccaa

SEQ ID NO: 19084 - DNA, 86 bp, Homo sapiens
  misc_feature 43: r=a or g
  misc_feature 50: k=g or t
  misc_feature 51: w=a or t
  misc_feature 60: s=g or c
  misc_feature 82: r=a or g
aagcaacatggctcggaaacgcgcggccggcggggagccgcgrggacgckwactgcgcascagaaatccaaggccaagagcraggc

SEQ ID NO: 19085 - DNA, 145 bp, Homo sapiens
  misc_feature 76: s=g or c
  misc_feature 77: v=a or c or g
  misc_feature 97: m=a or c
  misc_feature 102: w=a or t
  misc_feature 113: w=a or t
  misc_feature 119: v=a or c or g
  misc_feature 122: w=a or t
  misc_feature 138: m=a or c
  misc_feature 142: w=a or t
  misc_feature 145: w=a or t
acactcagcccgtgatgcaggtgctcgatctcggcaagacgcggccggagaaccgccatcagatgcagcgcgacasvacgtggcggcatccctcgamgcttwgcaggccctgwgccccvaawctcaagcgcgtctccmtcgwggw

SEQ ID NO: 19086 - DNA, 328 bp, Homo sapiens
  misc_feature 126: w=a or t
gtttatttcgcctttcattttgtcgatttttacttcatgtattatggggctctattcttaggttgatgtagttgcatttacacctgccattttgtgatttgttttatgtctcatcttttttttgtwcctttgtttcttctttattgtactcttttgtgttaatattttctcatgtttcatttcaattccttttcctcatgttttgaattattttcttagtgattgcatgtatgatatatgtcttaagttatcacagtgtacttcagatcagtactaaaattctctagaacatggaaactttcctccagtatagctccatttcatcccc

SEQ ID NO: 19087 - DNA, 73 bp, Homo sapiens
agaatggttactccatagaaagagcagccccaagggctgctgattgcgcctttttcttttttttttttttttt

SEQ ID NO: 19088 - DNA, 181 bp, Homo sapiens
ccaaatagaatcaacccgaatggaatggagtggaacggaatgcaaaggaatggaatggaatggtacggaatagaatggaacgaaatggaatagaatggattcaaaccaattggtatggaatggaatggagtgtaaaggaattgaatggactcaacccgaatggaatggagtggaacggaat

SEQ ID NO: 19089 - DNA, 88 bp, Homo sapiens
acacacttaatagatgatgacatggtctcagtacaaagtgacatatatgagatcatatagatgggattgaaaaattcaatcctcagct

SEQ ID NO: 19090 - DNA, 249 bp, Homo sapiens
agtctctggcctgagttttcaattttcttgtcttttatattttgcatttcttttttttctttttaaatatatttttcttctccttttttgttttttattattatactttaagttctagggtacatgttcacaacatgcaggtttgttacataggtatacatgtgccatgttggtttgctgcacccatcaactcgtcatttacattaggtatttcttctaatgatatcccgcccccagtaccccacccaa

SEQ ID NO: 19091 - DNA, 279 bp, Homo sapiens
  misc_feature 15: d=a or g or t
agcagagaggaaagdgaaactgggagagggaggaagggagaaagtgagaagggaaatcggaaagagaaaagggaggaaacggcagagccagagagaaagaggaagagactgagtgtgaaggagagccaggtatggtggtgcatgcctgtagtcctagctatatggaaggccaaggtgggaagatcccttaagcccaggagtttgacgctgcagtgagctgtgattgtgccactgcactccagcctgggcaaacagagcgagaccctgaaaaaaaaaaaa

SEQ ID NO: 19092 - DNA, 110 bp, Homo sapiens
cttctactctgagggatatttgaaatatttcctcataaaaatcattttacatatttttatttcctaaaaactaaaactgttgtgaacttttcacattgggaaaaaaaaaa

SEQ ID NO: 19093 - DNA, 191 bp, Homo sapiens
  misc_feature 33: r=a or g
  misc_feature 34: m=a or c
  misc_feature 125: d=a or g or t
  misc_feature 126: s=g or c
  misc_feature 134: m=a or c
gagagtagtcagagcaccaaatgaccgacgatrmagagtttatgctgaggaatatttaagtttggaccattttggctacaagtagcaataacccggccaagctaacttaatcaaaggaggaatgdsattgctgmattttagggatatcctacccaattcaagaggagggatgtagttgcctctagggacac

SEQ ID NO: 19094 - DNA, 148 bp, Homo sapiens
  misc_feature 20: s=g or c
  misc_feature 92: r=a or g
  misc_feature 112: v=a or c or g
  misc_feature 129: w=a or t
  misc_feature 144: m=a or c
  misc_feature 145: m=a or c
cgtgaacctgggaggcggasttgcagtgagccgagatagtgccactgcactccagcctgggcgacagagcgagactctctcaaaaaaattaraataaaataaaaacattaavaaaaaaagagtataggwtgcttctcctctccmmgca

SEQ ID NO: 19095 - DNA, 116 bp, Homo sapiens
gaatggaatggaaacaacccgactgcaggggaatggagtggaatggaatgcaatggaatggattcaacttgaatggaatggaaagaatggaatcaacacgagtggaatggcagtac

SEQ ID NO: 19096 - DNA, 364 bp, Homo sapiens
  misc_feature 283: w=a or t
  misc_feature 284: n=a, g, c or t
  misc_feature 285: n=a, g, c or t
  misc_feature 286: k=g or t
  misc_feature 345: r=a or g
  misc_feature 346: n=a, g, c or t
  misc_feature 347: n=a, g, c or t
gatctaacacacagttataatttcaattgtgagtgaacacccattcaatccctaagacagtaatccctggcaaagctttaacacatagggtgaaatctcccaaggctagaactttttcttggcagagaaacatcaaggagatggaatatgctcttgaaaaaggacctgttgttttaatttgtacacattaaagtcatcttttcaaggtgcttcttaaaagttcagcctgcaatgtccaaaggacaaaaagtagatgtccctctgagattttgctacaatgaawnnkattaaagggttttatgtggtttacaccttcagaaatagccagaagaccccagcactcarnnttcacagcctgcctcca

SEQ ID NO: 19097 - DNA, 101 bp, Homo sapiens; identical to SEQ ID NO: 17871

SEQ ID NO: 19098 - DNA, 204 bp, Homo sapiens
  misc_feature 20: s=g or c
  misc_feature 68: h=a or c or t
  misc_feature 69: h=a or c or t
  misc_feature 138: v=a or c or g
  misc_feature 139: r=a or g
tgagacagagtcttgctctstcgtccaggctgtagtgcagtggcacgatctgggttgaagtgaatcthhtgcctcagccccctgagtggctgggatggcaggcacctgccaccatgcctggctggtttttgtgttttvrtggagatggggttttaccatgttggtcacactggtcttgaactcctgaactcaagcagtccgccc

SEQ ID NO: 19099 - DNA, 210 bp, Homo sapiens
  misc_feature 131: s=g or c
ggaaagctaactgctacctttcagggtagtgataaggaacaaatgaggtaatccaaataaaacactgactcttggggtcccggtgagccagtggttctcatggaggcgagtaggaggcctgggcatcagcstgtgaatgcagtgaggccccttccgcaggatgcctgacctacgacctacctgaaattcaccaactgacagggcaacctt

SEQ ID NO: 19100 - DNA, 171 bp, Homo sapiens
  misc_feature 23: n=a, g, c or t
ctgtggccttccttccttccttncttccttcctggaatttcgctctgttgcccaggctggagcgcagtgacgtaatcatagtttgctgcggccctgaccccaatggcacaaatgagcctcctgcctcaatctcctaagtagctgggactacaggcatatgccactacgccc

SEQ ID NO: 19101 - DNA, 80 bp, Homo sapiens
  misc_feature 33: w=a or t
cccaggtatgaaattctgggttggaaattcttwtctttaagaatgttaaaatattggcccccaagctcttttggcttgta

SEQ ID NO: 19102 - DNA, 342 bp, Homo sapiens
  misc_feature 299: v=a or c or g
  misc_feature 300: n=a, g, c or t
  misc_feature 301: n=a, g, c or t
  misc_feature 302: k=g or t
  misc_feature 339: d=a or g or t
  misc_feature 340: n=a, g, c or t
  misc_feature 341: k=g or t
  misc_feature 342: w=a or t
gtaagtgtcatatttaatctaattaagcccctgttggatttatttctgttcttaggctgtagctggaaaaataaaatttatgatcctaaagtatacagaatattcatgaattaattaccaaattatttttataatcattagacataatacagtttgaaatattttctaagttttgtttatttttatttgtttgtttatttatttcaatagttttggggaacaggtggtttttggttacatggataagttctttagtggtgatttctgagattttggtgcacttgtcacccaagtagtgvnnkctgtacccaatacatggtcttttacatctcacccccdnkw

SEQ ID NO: 19103 - DNA, 323 bp, Homo sapiens
  misc_feature 100: y=c or t
  misc_feature 104: m=a or c
  misc_feature 118: v=a or c or g
  misc_feature 131: m=a or c
  misc_feature 145: s=g or c
  misc_feature 147: m=a or c
  misc_feature 190: s=g or c
  misc_feature 238: w=a or t
  misc_feature 263: w=a or t
  misc_feature 281: k=g or t
  misc_feature 312: w=a or t
ctttcttttcccctccctcccggttcggtggcggcggctcctcccactggggggggggtggcgcggcggcggtggcatctgcggccatggcggcgactaytgcmaaccccgaaatggvcatcagatgtacmatcactgggtccascmattgcctctggaaactctggacctggaattcaaggtggaggasccattgtccagagggctattaagcggcgaccagggtgagtttgagtgwagtgtgttatgaatatctctcctawaaaccaactttagttgckgaatttatttagttgctgaactcacttcgcwattcctgacca

SEQ ID NO: 19104 - DNA, 124 bp, Homo sapiens
  misc_feature 62: m=a or c
  misc_feature 110: m=a or c
tctcgcctaggctggagtgcagtggcatcatctcagctcactgaaacctccacctcctgggmtgaagagattctcctgcttcagcctcccaagtagctgggattacaggmgtgcaccaccacga

SEQ ID NO: 19105 - DNA, 170 bp, Homo sapiens
  misc_feature 16: r=a or g
  misc_feature 17: r=a or g
  misc_feature 137: w=a or t
  misc_feature 140: k=g or t
  misc_feature 146: w=a or t
  misc_feature 151: r=a or g
  misc_feature 153: w=a or t
  misc_feature 158: m=a or c
  misc_feature 165: r=a or g
ttccatgtggagatgrraagaatatatattctgtggttattgggtagagtgttctatagatgtctattaggtctaattggtctagtgtcgaatctaagtctagaatttctttattagttttctgcctcaatgatctwtckaatgcwgtcargwggggmattgaartcccc

SEQ ID NO: 19106 - DNA, 70 bp, Homo sapiens
  misc_feature 16: b=c or g or t
  misc_feature 29: y=c or t
  misc_feature 38: w=a or t
  misc_feature 49: m=a or c
  misc_feature 52: w=a or t
atttctttctttaaabaaccagttaattyatttcaggwcaagaatttamcawataatactctttttatat

SEQ ID NO: 19107 - DNA, 132 bp, Homo sapiens
tggtcaattttgttttaagactgagtttcactcttgttgcccaggctggagtgcaatggcacgatctcggctcactgcaacctccacctcctgagttcaagtgattctcctgcctcagtatctcgagtagct

SEQ ID NO: 19108 - DNA, 114 bp, Homo sapiens
  misc_feature 15: s=g or c
  misc_feature 27: y=c or t
  misc_feature 38: w=a or t
  misc_feature 40: m=a or c
  misc_feature 43: w=a or t
  misc_feature 50: y=c or t
  misc_feature 52: m=a or c
  misc_feature 55: r=a or g
  misc_feature 62: r=a or g
  misc_feature 79: m=a or c
  misc_feature 99: w=a or t
aaggcaagatggtgsactacagcgtgygggaccacatwgmggwgtctgaygmtgragacgaracgcaccccaacatcgmcacggccagtctcttccgcwggcggcatcaggccc

SEQ ID NO: 19109 - DNA, 51 bp, Homo sapiens
  misc_feature 14: k=g or t
taatttttattttkatactattcttatcagattatgtcatccgtattatac

SEQ ID NO: 19110 - DNA, 127 bp, Homo sapiens
gcattctcaggacaagagttaaacatttatgtacagatggagcaaaaggccaggtgcggtggttcacgcctggaatcccagcactttgggaggccgaggcaggcggatcacgaggtcaggagatcga

SEQ ID NO: 19111 - DNA, 57 bp, Homo sapiens
  misc_feature 3: y=c or t
  misc_feature 13: y=c or t
  misc_feature 23: r=a or g
  misc_feature 27: y=c or t
gcyttagtctccygagtaactgrgacyacaggcatgtgccactgcacctggctaact

SEQ ID NO: 19112 - DNA, 111 bp, Homo sapiens
  misc_feature 16: w=a or t
  misc_feature 51: h=a or c or t
  misc_feature 52: n=a, g, c or t
  misc_feature 53: k=g or t
tttctaatattagatwaaactctgggtagattgattttcttgagaaatgthnkttctttctatagtgggaatggggctcaagagtaagtttgacttttgcaaattttaagt

SEQ ID NO: 19113 - DNA, 123 bp, Homo sapiens
  misc_feature 14: w=a or t
  misc_feature 17: d=a or g or t
  misc_feature 19: y=c or t
  misc_feature 22: s=g or c
  misc_feature 28: m=a or c
  misc_feature 29: m=a or c
  misc_feature 67: w=a or t
  misc_feature 97: k=g or t
tgtgtttacagttwttdcyttsaatgtmmaatgtacatacagtacaatgtgtaactcaagtcactgwcaacatgtaaagtctttactccagaaagtkcccccatgcctctttcatgtcagtcc

SEQ ID NO: 19114 - DNA, 124 bp, Homo sapiens
aaatgaagatatttcccccagtagattatagtgagaatgaaagaatttatgtaagttataaattgctgttcatatataagatagtggtaccataactattaacagatgtcaagtcaatcagcca

SEQ ID NO: 19115 - DNA, 56 bp, Homo sapiens
  misc_feature 15: m=a or c
  misc_feature 23: r=a or g
  misc_feature 37: d=a or g or t
gctttagtctcctgmgtaactgrgactacaggcatgdgccactgcacctggctaac

SEQ ID NO: 19116 - DNA, 258 bp, Homo sapiens
cagtggcatgatcccagctcactgcagccttgacctcctgtgctcaagtgatcctcccacctcagcctcctgagtagttgggactacaggcacctcccaccacacctggctaatttaaaaatttttattttgtaaagacagggtctcactatgttgcccaggctggtttcagattcctgagttcaagccattctcccatcttagcctctcaaagtgctggctgggattacagacgtgagccaccgtatctggcactca

SEQ ID NO: 19117 - DNA, 120 bp, Homo sapiens
  misc_feature 4: k=g or t
  misc_feature 33: y=c or t
  misc_feature 88: k=g or t
gtgktggtaacaatggatatatgtacatatttyagtttttaaaatttagggatgtgtttaacatctgtttgccagaactgactaggtkccaattctttacggttaacacctattgaagga

SEQ ID NO: 19118 - DNA, 325 bp, Homo sapiens
  misc_feature 126: w=a or t
  misc_feature 128: w=a or t
  misc_feature 134: w=a or t
  misc_feature 135: w=a or t
  misc_feature 137: v=a or c or g
  misc_feature 140: w=a or t
  misc_feature 224: w=a or t
agtatatacccaacaatgggattgctgggtcaaatggtaattctgttttaagtatttggaggaatcaccacactgctttcccagaatggctgaactaatttacactcccacccaaaatgcataagwawtccctwwcvtcwgcaaaatcccagcatctattattttttgactcataaataatagccattctggctggtataagatggtatctcattgtggttttwatttgcatttctctaataattaggctgagcattttataatatgcttattggatgcatgaaatgtcttcttttgagaactgtctgttcatatcctcggccca

SEQ ID NO: 19119 - DNA, 105 bp, Homo sapiens
  misc_feature 18: w=a or t
tggatacgccattttgtwtattcattcaactgatggacatttgggttgtctctatttcttgcctattatgaatgatgctgctatgagcatttgtgtacaagtttt

SEQ ID NO: 19120 - DNA, 120 bp, Homo sapiens
  misc_feature 55: v=a or c or g
  misc_feature 75: m=a or c
tttttggtataataatagctatgttagtacatgtctttgtgatttgttggaagavctctgtaagaatagattggmaggccaagtgtggtgggctcaagcaattctaccactcggcctccc

SEQ ID NO: 19121 - DNA, 193 bp, Homo sapiens
  misc_feature 146: r=a or g
  misc_feature 156: r=a or g
ctttcctttatcactctcttctttcctttctttcttgtctcgttgtgctacccaggctggagtgtagtggtgcaattatggcccactgcagctcaccctcttgggctcaagtgaccctcccgtcttggcctcctgagtagttgggrctaccaggtrgcacaaccaccatgcctgactaattttcttttctttt

SEQ ID NO: 19122 - DNA, 433 bp, Homo sapiens
  misc_feature 148: r=a or g
  misc_feature 151: m=a or c
  misc_feature 163: m=a or c
  misc_feature 323: n=a, g, c or t
  misc_feature 324: n=a, g, c or t
  misc_feature 328: m=a or c
  misc_feature 393: y=c or t
  misc_feature 403: m=a or c
  misc_feature 422: y=c or t
cccaggctggagtgcagtggcacagtctcggctcactgccagctccgccccccgggttcacgccattctcctgcctcagcctcctgagtagctgggactacaggcacccgccaccatgcctggctaattttttgtatttttagtagargamctgggtttcatmacgttagccaggatggtctcgatctcttgacctcatgatctgcccgccaaggtggaggacggacgagaagacacccttcctcaaccggggctgcctggcagtctggtcaccctgagggacagcctgcctcagagggaagctcagagccccaagcccctcnnttcmcatctgagggctgctgtgaggagccaagaaggagcaagctcttcacgtagtgcttggtacacagyaggcgccccmactaggtgctagatggtgycattattgtga

SEQ ID NO: 19123 - DNA, 243 bp, Homo sapiens
  misc_feature 196: n=a, g, c or t
  misc_feature 237: n=a, g, c or t
aaatgagatgaagaaaagtgcttggttggctgggtatggtggctcatgcgtgtaatctcagctactcaagactgagacaggaggatcgcttgagcccaggaggttggggctgtagtgaaccatgatcatgccactgcactccagctgggcaagagtgagaccctgtctcaaacaaaacaaaacaaaacaaacaaanaagaaaactgcctggtgcagatccaattagattcctccccntcccac

SEQ ID NO: 19124 - DNA, 144 bp, Homo sapiens
  misc_feature 105: k=g or t
  misc_feature 106: h=a or c or t
  misc_feature 143: w=a or t
aggagggtctagagtggagccctgaggaatgcctccactgaaggggcaggcaaaggaagaggagtccaacgagacaacagagaatacagaatctcaccagaggckhgctttttgcaggttccctgtgtcttcttaggcaagtwa

SEQ ID NO: 19125 - DNA, 74 bp, Homo sapiens
ctcctacctgaacctctcaagtagagctgggactacagtgcactccaccatgcccaggtaattttttttttttt

SEQ ID NO: 19126 - DNA, 101 bp, Homo sapiens
gggaggatcacttgaacctgggaggcagaggttgcggtgagccaagatcacgccattgcactccagcctgggcaacaagagtgaaactcagtctcagaaaa

SEQ ID NO: 19127 - DNA, 108 bp, Homo sapiens
gtgcgatctcggctcactgcaagctctgcctcccagattcacaccattctctcgcctcagcttcccgagtagctgagactgcaggtgccctccaccacgcccagctga

SEQ ID NO: 19128 - DNA, 277 bp, Homo sapiens
  misc_feature 141: r=a or g
  misc_feature 142: r=a or g
  misc_feature 147: w=a or t
ttctttagggtagttgcatatttcaagggtatttgaagatacgggtacattttggagtttaagagcagtgactattagatttgaaaatataacccaagtaggtatctttcctgttctgactttgtattactgtaaaaatgrrggaawtaaaagtgactgatttttaaatgatcagtttttgattaattgtttttttcctggtggatactgattcacatcaaggggattcttttttgaagctgatttttagatgtcctgtaattaataagaagtcctt

SEQ ID NO: 19129 - DNA, 62 bp, Homo sapiens
cgtaattaaaaatattgtggcaggattaatagcattttggttttgtgggttgtttttttttt

SEQ ID NO: 19130 - DNA, 194 bp, Homo sapiens
  misc_feature 149: s=g or c
  misc_feature 152: y=c or t
  misc_feature 158: n=a, g, c or t
  misc_feature 174: w=a or t
  misc_feature 175: k=g or t
ataaagtttttgattcaatattcatgtatcattatttattttatgtttattttattttttttgagacacagtctcactttattctcaggctgaaatgcaatggcacgatcttggctcactccacctcctgagttcaagcgattctcccsgcytcagcnccctgagtagctgagwktacaggcacacaccacaaa

SEQ ID NO: 19131 - DNA, 229 bp, Homo sapiens
caagcatatcgtgtgtaatgatccaatgaagataattcagataaccatcacctcatgcatttattatttctttatgttagaaatattccaattccactcttctagttatttgaaatatacaataaatgattgttaattatagtcctccacactgtactactaaatgcttaaacttattccttctatctagaggttttgtgcccactaatcattccgcctttacccgccc

SEQ ID NO: 19132 - DNA, 241 bp, Homo sapiens
  misc_feature 147: w=a or t
  misc_feature 148: k=g or t
gggatagattgatttattagctgagtgacctactctcacacagcaagcttgcaacccattatgactcaaatccatacctcagcaaaataatatttaccatatatcatgagcgtatgaggtctgatgtggatacctgaaactatgaawkggtaaaattcttaaatgccaagtgtctaggggcaatagcatagacatactgatagaaattacaactcagggccaggcgtggtggctcatgcct

SEQ ID NO: 19133 - DNA, 118 bp, Homo sapiens
  misc_feature 14: r=a or g
cagatgacctgagraggtgtgggccagtagtgtttttctgaatttgaagtttgtttagtcgtcaagtccaggaaagcacagtcatatggctatggtagacaatatattcgtcatgacc

SEQ ID NO: 19134 - DNA, 120 bp, Homo sapiens
  misc_feature 105: m=a or c
tttttatatagagagagagacagggtttcactacgtaacccaggctggtcttgaactctgggactcaagtgatctgcccacctcagcctcccaaagtgctaggamtacaggcatcagcca

SEQ ID NO: 19135 - DNA, 330 bp, Homo sapiens
  misc_feature 146: w=a or t
  misc_feature 171: w=a or t
tttttacggaatgcaacctggttccaatatatttcctcaggggatagttagcatttctcatagggaattaaatctaaaatttaagccttttgaaaagcttcaaaatttaagaatctcgtcaatctgttccatctggtcactaattwttatattttaagtaatgtttgtgtwtatgatccacattatgctataaacagaattaatgtgaattgtggtgtttttaattaacatactagttattcctaaggaattatctagagtgtgtccttgtataatcagttgaggaaagagattttcaaagagaaaatgaccccacaataaatcacccca

SEQ ID NO: 19136 - DNA, 93 bp, Homo sapiens
  misc_feature 2: m=a or c
  misc_feature 56: k=g or t
  misc_feature 57: r=a or g
  misc_feature 59: m=a or c
  misc_feature 68: m=a or c
tmtatgcagttcatcattgactaaaacgtcattataggacgcatgactgtaaatakramattctagamaatgcaggctaagcgacagttacaa

SEQ ID NO: 19137 - DNA, 100 bp, Homo sapiens
  misc_feature 79: m=a or c
tgactactgctggcccacggggactcccagctcccctggcagcgcctggcgcccactggcaccttggcaatcctctgcmggtgtgatgcgtctgtgctcc

SEQ ID NO: 19138 - DNA, 202 bp, Homo sapiens
  misc_feature 16: r=a or g
  misc_feature 17: k=g or t
  misc_feature 157: v=a or c or g
  misc_feature 176: k=g or t
catgtaacacaagtcrkccatttaaagtgagcagctcagtaacattttgtacgttcataatattgtgcagccaccacctctgtctagttccagaaaattttcatttccccaaaaggaaaccctatccccatcaggagtcattctccccattccctcvcatgctcccagcccctggkaactactaatctgctttctgtcgaac

SEQ ID NO: 19139 - DNA, 365 bp, Homo sapiens
  misc_feature 144: w=a or t
agtgtgaaatcttcagagaagaatttctctttagttctttgcaagaaggtagagatagagagtcttgttatgtcgcccaggatggagtgtagtggtacaatctcggctcactgcagcctccgcctcttcctgggttcaagtgawtctcctgcctcagccttctgagtagatgggactacaggtgcacaccaccatgcctggctgatttttgtacttttggtagagacggggtttcgccatgctggccaggctggtcttgaactcctggcctcaagtaatctgcccaccttggcctcctaaattgctgggattgcagacactttttcaaaaatggcaatggtatcagaattcctcaaacaggccat

SEQ ID NO: 19140 - DNA, 81 bp, Homo sapiens
atggtttttggtatattacatttattttctaaattgtggcaaaatatgtatagcacaaaacttgctattttagcctttttt

SEQ ID NO: 19141 - DNA, 120 bp, Homo sapiens
ctacattttgtttatccactcatccattgatggacatttgagttgtttccacttttttgggtttttatgaataatacttctaagaacatttatatgcatgtttttgtgtgaacatatgtt

SEQ ID NO: 19142 - DNA, 172 bp, Homo sapiens
  misc_feature 139: v=a or c or g
  misc_feature 159: h=a or c or t
  misc_feature 167: b=c or g or t
tgtgactatattaccttcacatagcaaaatggactttgcagatgtgattaaggatcttgagatggaaggagtatcctggatttttcaggtaaactgagtataatcacaagggcctctgtaaaggaggcaggagtgtcavagtgacggaagaaaatgtahtgtaacabtggaa

SEQ ID NO: 19143 - DNA, 159 bp, Homo sapiens
  misc_feature 14: r=a or g
  misc_feature 133: r=a or g
  misc_feature 142: w=a or t
tacgagatcgaggrcaggacgcgggtgcagcccaaattccgttaccccttctactatgagatgtgctggtatgtcctggagagatactgtactgtgtgacccagcgctcccacctcactcaggaataccagarggagtcgawgcttatttgatgccccc

SEQ ID NO: 19144 - DNA, 84 bp, Homo sapiens
  misc_feature 19: m=a or c
  misc_feature 22: b=c or g or t
  misc_feature 34: m=a or c
cggaatagaatggaatggmaabaattttaatggmatggaattgaatggagtggaatggaatggaatggaatcaacgagattgca

SEQ ID NO: 19145 - DNA, 199 bp, Homo sapiens
  misc_feature 26: m=a or c
ggaaaatatactaggtcagggagaamatgaaacacataattgtcatgaatattttagtgtaatgtctaagatgtctgaggaaaatatctattgttaataacagtttggctgtggtattaggagacaggagacattatgcattttctgaaataccagaccagtttttagacgcacatagcaattcataagattttttttt

SEQ ID NO: 19146 - DNA, 160 bp, Homo sapiens
  misc_feature 102: y=c or t
  misc_feature 116: r=a or g
  misc_feature 131: n=a, g, c or t
  misc_feature 132: d=a or g or t
  misc_feature 152: w=a or t
  misc_feature 158: m=a or c
caggcgtgagcaccgtgcctggcaggagttcccttttaagatcgctgtaggaagagtcagaaggtcaaggacaaggcgccgaggtgcctaccctcttagtaytttgtgttggggartggaggctgtccaandgaggctgggccaaaggggawagggcmaa

SEQ ID NO: 19147 - DNA, 217 bp, Homo sapiens
  misc_feature 140: s=g or c
  misc_feature 163: r=a or g
gatgaattaagagccttgcccaggaatcttggttcaggatgggtggtctacacatggtctgcttgttaagtaccagtccattatgtgccaggtagtgattcctatttcagagatgagaagagaaccatgagaaaaagtasgcctgtgttagattaaaagtaaractgcaggcctggtgcagtggttcacgcctgtattcctagcactttgggaggcc

SEQ ID NO: 19148 - DNA, 243 bp, Homo sapiens
tgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccacat

SEQ ID NO: 19149 - DNA, 147 bp, Homo sapiens
ctgctgaatccctctgtcagtgtttctttgctgtcaaacagaatgcccagctggcagtggcaatcccgatggggagggagggctatggatagattgtgttcaccctgcaacaagaatattaggaattcttcttcccaaactataagt

SEQ ID NO: 19150 - DNA, 346 bp, Homo sapiens
  misc_feature 139: r=a or g
  misc_feature 140: s=g or c
  misc_feature 167: b=c or g or t
  misc_feature 168: v=a or c or g
  misc_feature 344: w=a or t
  misc_feature 345: n=a, g, c or t
tgcctttgtcttgttttggtatcagtgtaatactggcctcataaaatgagtttggaagtatttcttctattttcagaatagtttaagtaggattagttattactagttcttctttaaatatttggtagaattctatcarsaggtacgaggaggagctggtaccattbvttctgaaactgttccaatcaatagaaaaagagggaatcctccctaactcattttatgaggccagcatcatcctgatacctaagcctggaagagacacaacaaaaaaagagaattttagaacaatatccctgatgaacattgatgcaaaaatcctcaataaaatactggcaaaccawnt

SEQ ID NO: 19151 - DNA, 58 bp, Homo sapiens
cgtcttttcaaatatgctaaacctcttaagaaaatgttttatatcgcctttttttttt

SEQ ID NO: 19152 - DNA, 162 bp, Homo sapiens
ccataaggatcagaaatgcaattccagggaatctcagggtgagtaccagaaagtgtcagattatggcttggagatttcctccagagatgctggaatgatggaaagtgagtgagcctgacttctgttatccacagactcctctagggaacttccataggctgc

SEQ ID NO: 19153 - DNA, 195 bp, Homo sapiens
taaaaaaatgaaaaatggctgggtgcggtggcgcatgcctgtaatcccagcactttggccaaggcaggtggatcacctgaggtaaggagtccgagaccagcctggccaacatggtgaaaacccgtctctactaaaaatacaaaaattagccgggcgtggtggcatgtgcctgtagtcccagctactcgggaggct

SEQ ID NO: 19154 - DNA, 328 bp, Homo sapiens
tcttttatgttatagttcaggttttgttatgcatagaaaaccctttcaaattcagtgattagtggccgggcacagtggctcacgcctgtagtcccagcactttgggaggccgaggcgggcggatcacggggtcgggagtttggagaccagcctggccaacatggtgaaaccctgtctctactgaaaatgcaaaaaattagctgggcgtggtggcgggtgcctgtggtcccggctactcgggaggctgaggcaggagaactgcttgagcccgggaggcggaggttgcattgagccgaggttgcgccacctcattccagcccgggtgaca

SEQ ID NO: 19155 - DNA, 271 bp, Homo sapiens
tgagatcttttgggacaggcaggcaatgcatggtaatcacatcatggaaaattgggtatccatctcctcaagcatttatccttctttttttgcatttatcctttttattacaagcaatgtaattatactttttaaattattgttaaatgtacaattaaagtattattgactgtagtccccctgttgtgctatgaaatactgtcttatttattctttctaattttttttgtactcatcagccatctccacctccccaccacccacccaccca

SEQ ID NO: 19156 - DNA, 191 bp, Homo sapiens
  misc_feature 46: y=c or t
  misc_feature 144: r=a or g
ttggcatctgttcatatttttgggggtgataggggaggtttgcagyataggatctccctcggtcaccaaggctggaatgcagtggtgcaatcacagctcagtgaagccttgagcttctgggctcaagctgtcctcccgcctcarcctccctgagtagctgggactacaggcgtgcgaccaccataccgggc

SEQ ID NO: 19157 - DNA, 84 bp, Homo sapiens
aagcataattaaaaaaagtgatatccctttcgttctgtcttctggttatttggggagcaataataatgaaattctcaactcacc

SEQ ID NO: 19158 - DNA, 207 bp, Homo sapiens
  misc_feature 14: r=a or g
  misc_feature 15: k=g or t
  misc_feature 117: h=a or c or t
  misc_feature 148: w=a or t
  misc_feature 152: w=a or t
  misc_feature 159: r=a or g
  misc_feature 184: y=c or t
gtgtttttttcgtrkagacggggttttgccatgttggccgggctggtctcgagctcctggcctcgggtggtccacccacctcggcctcccggggtgctgggattgcaggtgtgggchaccgtgcccggccttgactaccaatattttwaaawttactgraggacttttttgttctcttcttttytctttttttaatagcaccccact

SEQ ID NO: 19159 - DNA, 128 bp, Homo sapiens
cgtctctgttcttatatatttgaccttctttctttgaaaggctgggcaatgaaacttggcacgttcttgaatttgctaagggtttaaaaaaagaaatctacttctcaaatagcaactttctagagtga

SEQ ID NO: 19160 - DNA, 357 bp, Homo sapiens
  misc_feature 119: m=a or c
  misc_feature 159: w=a or t
  misc_feature 185: n=a, g, c or t
  misc_feature 333: m=a or c
ccttaagcaaaatatccaaggcactgctgcgaatgctaaaagtaggagaagtgatttgtgcatggctaattggcacaggagatagaagagagcaagtgcctcagaggaggaactggtamttttattgtgactattgaaaggaaaggagagggctgtggwttgctgttggagaatgaggagatttntggaagaagtgctgtttgagctgggctctcagggagcatcaatatttgcagacagcagtgttttgagaccatgtgtctgcaacaggcaggtgtagaggcagcagggtgtggttgggagttgaattgggatgccttgttgggtgtatgmcatggggatgacaattggagatga

SEQ ID NO: 19161 - DNA, 246 bp, Homo sapiens
  misc_feature 43: w=a or t
  misc_feature 56: w=a or t
  misc_feature 57: m=a or c
  misc_feature 116: w=a or t
  misc_feature 137: w=a or t
  misc_feature 142: w=a or t
  misc_feature 150: r=a or g
  misc_feature 161: m=a or c
  misc_feature 163: m=a or c
ctttaccattatgtaatggccttctttgtctcttttgatcttwgttggtttaaagwmtcttttatcagagactaggattcaacccctgctttttttttgctttccatttgcttggwagagtcaagacccatcattgwgctgwatttaggraaacccatctmamgtgcagagacacacataggctcaaaataaagggatggaggaagatctaccaagcaaatggaaagcaaaaaaaaagcaggggtt

SEQ ID NO: 19162 - DNA, 354 bp, Homo sapiens
  misc_feature 128: w=a or t
  misc_feature 134: h=a or c or t
  misc_feature 135: s=g or c
  misc_feature 136: r=a or g
  misc_feature 143: w=a or t
  misc_feature 146: w=a or t
  misc_feature 149: d=a or g or t
  misc_feature 154: m=a or c
  misc_feature 158: d=a or g or t
  misc_feature 159: r=a or g
  misc_feature 163: w=a or t
  misc_feature 172: m=a or c
  misc_feature 188: r=a or g
  misc_feature 197: r=a or g
  misc_feature 271: r=a or g
  misc_feature 272: m=a or c
  misc_feature 273: m=a or c
  misc_feature 298: k=g or t
  misc_feature 304: w=a or t
  misc_feature 307: s=g or c
  misc_feature 320: s=g or c
  misc_feature 323: r=a or g
  misc_feature 343: m=a or c
ccgtcctgagcgtgccgggacctgagggccggccgggtttcgcaggctttcccggacctgcaggacccaagggcaacctgggctctaagggcgaacgaggctccccgggacccaagggtgagaagggwgaaachsrgcagcawctwcadgcccmaacdrcggwgccctgggmcctgcccagaaaggarccaagggaragccgggcttccgaggacccccgggtccatacggacggccggggtacaagggagagattggctttcctggacgrmmgggtcgccccgggatgaacggattkaaaggwgasaaaggggagccgsgaratgccagccttggatttggmatgaggggaat

SEQ ID NO: 19163 - DNA, 200 bp, Homo sapiens
  misc_feature 142: s=g or c
  misc_feature 145: y=c or t
caattctcctgccttagcctcctgagtagctggattacaggcatgcaccaccatgccaggctaattctgtatttttagaagaaacagggtttctccatgtggcccaggctggtctcgaactcctgacagcaggtaaatccgsccytccttggcctcccaaagtgctgggattacaggcgtgagccactgcaccccgccta

SEQ ID NO: 19164 - DNA, 179 bp, Homo sapiens
caggctggagtgcagtggcacaatctcggctcactgcaaagtcgcctcgcaggttcaagcgattcttctccctcagcctccggagtagctgggattatagacacgtgccaccacgcccagctaatttttgtatttttaagtagagacaggggtttcaccatgttagctaggctggcccc

SEQ ID NO: 19165 - DNA, 224 bp, Homo sapiens
  misc_feature 146: k=g or t
  misc_feature 147: r=a or g
  misc_feature 148: m=a or c
agagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtkrmctgtaagcatcaagtgtacctgatttgtgaacctatcttgcttcagttggtttcctcctaaatattaggcagaatt

SEQ ID NO: 19166 - DNA, 269 bp, Homo sapiens
  misc_feature 142: w=a or t
  misc_feature 155: y=c or t
ttttgaaatgtgtgtatttggatttctagccttaatagctattaagcacattttcccaatatagttttttcaagtgaaatactttataagttgaagccagctgaggattcttcgctagctgttagacttaatgcatactcawtttggcttgtatycaaacactggtttcatgttctgtgcagttaagtaatcttaaagaatggcgtgtctaggctgggtgcggtggctcacacctgtaatcccagcactttgggaagccaaggcgggtg

SEQ ID NO: 19167 - DNA, 98 bp, Homo sapiens
taattcctaaatatttttaaaaacttaggctgtttgagggctacataataatccacaaaatcttctttgcgaaattacataaaatcaagccagcaaga

SEQ ID NO: 19168 - DNA, 128 bp, Homo sapiens
tttctctaagatgctgtgtatcctgtcattggagagcataagacttgaagtgatcatagtaaaaatgtagaaataatttccaagtattcatggtggtgttaaatttatgaagaagtaagtgtggactc

SEQ ID NO: 19169 - DNA, 157 bp, Homo sapiens
  misc_feature 133: m=a or c
  misc_feature 148: k=g or t
  misc_feature 149: w=a or t
aaaggaatcaacccgagtggaatggcatgcaatggaatggaatggaatggaatggaacagaatggtacggaaaagaatggaaaggaatcaacccgagtggaatggcatgcaatggaatggaatggaatgggamtggaacaagaatggkwacggaaaa

SEQ ID NO: 19170 - DNA, 118 bp, Homo sapiens
caaatttgtcatttttcaaccattgtttctttgaatactttttaagccccatactctttctcctctttttcttggtttttgatcatgcaaatgctagaccttataaaaatagccccat

SEQ ID NO: 19171 - DNA, 77 bp, Homo sapiens
tgaggcaagattgtgccattgcactccagcctaggcaacaaaagtgagactccgtctcaaaaaaaaaaaaaaaaaaa

SEQ ID NO: 19172 - DNA, 242 bp, Homo sapiens
  misc_feature 142: y=c or t
  misc_feature 153: d=a or g or t
caggcaagttatctagacctctctgtgacccagttgccttatctgtaacataaggaaaattactgaatctattttaaagcactgtcaggaggattaaatgaggaaaacacttagaatagtgcctggcactgcgtaaacactyagttaaatgtdaactgtcatcatcatgttattgttacagaaagagttgcagtattctggaaaaatcactcactcatttaaatagattttttttttttttt

SEQ ID NO: 19173 - DNA, 137 bp, Homo sapiens
gacgtgttggcagacacctgtaatcccagctgctcaggaggctgaggcaggagaatcgcttgaacccaggaggcagaggttgcagtgagctgagaccatgccattgcactccagcctgagtgacagagtgagactcc

SEQ ID NO: 19174 - DNA, 76 bp, Homo sapiens
cagtgagctgagattgggccactgcattccagcctgggtaacagagcaagactctgtcttaaaaaaaaaaaaaaaa

SEQ ID NO: 19175 - DNA, 248 bp, Homo sapiens
  misc_feature 143: k=g or t
  misc_feature 146: y=c or t
  misc_feature 148: m=a or c
  misc_feature 150: r=a or g
  misc_feature 155: k=g or t
  misc_feature 157: y=c or t
  misc_feature 161: w=a or t
  misc_feature 163: b=c or g or t
  misc_feature 168: w=a or t
  misc_feature 169: h=a or c or t
  misc_feature 177: v=a or c or g
  misc_feature 178: m=a or c
tggcagaataccagttttcttgccagtttcttaaaagaagactttcttgaaatggactgtagtgggggtgaggagaaggatacatcttacacatgtgcatgtgtattctggatgggtatgagaatcttgataagattaacggktcycmargtttkgytttwtbgtttwhtttttgavmcggagtttcactctgtagaccaggctggagtgcagtggcacgatctcagctgactgcaagctccgccttc

SEQ ID NO: 19176 - DNA, 150 bp, Homo sapiens
gacgtgttggcagacacctgtaatcccagctgctcaggaggctgaggcaggagaatcgcttgaacccaggaggcagaggttgcagtgagctgagaccatgccattgcactccagcctgagtgacagagtgagactccgtctcaaaaaaaa

SEQ ID NO: 19177 - DNA, 150 bp, Homo sapiens
caaaaattagttgggcgtgttgacacatgtctgtagtcccaggtgtagtcctcaggaggctgaggcagaggctgcagtgagccgagaaggtgccactgtgctccagcctgagtgacagagcaaggctctgtctcaaaaaaaaaaaaaaaa

SEQ ID NO: 19178 - DNA, 56 bp, Homo sapiens
gtttcagaacgtttcacagtgctgtgtgtagacctcgtgctttttttttttttttt

SEQ ID NO: 19179 - DNA, 431 bp, Homo sapiens
  misc_feature 137: w=a or t
  misc_feature 142: w=a or t
  misc_feature 148: h=a or c or t
  misc_feature 152: w=a or t
  misc_feature 346: w=a or t
  misc_feature 365: w=a or t
  misc_feature 379: r=a or g
  misc_feature 404: m=a or c
  misc_feature 405: m=a or c
ttgtgagctaccatgcccaaccttcatttaaagattttgttttgaaaggaaagattgtcattaaaaatatattggactgtttacttatttattatactttaagttctggaatacatgtgcagaacatgcaggtttgwtacawaggtahacawgtgcccatggtggtatgctgcacccatcaatatgtcatctaggttttaagccccacatgcattaggtatttgtcctaatgctgtccatcccttggccccccaccccctgacaggccctggtatgtgatgttcccctccctgtgtccatgtgttctcattgttcaactcccacttgtgagtgagaacatgcggcwtttggttttctgttcctgwgtttgctgagaatratggtttctagcttcatccaatgtmmctggaaaggacatgaactcattcttt

SEQ ID NO: 19180 - DNA, 73 bp, Homo sapiens
  misc_feature 2: m=a or c
  misc_feature 3: n=a, g, c or t
  misc_feature 13: w=a or t
  misc_feature 19: s=g or c
  misc_feature 21: r=a or g
  misc_feature 22: r=a or g
gmnattgcaacgwggaaasgrrcagaggctggaagaattttgagagtcatgataaattgccttaaccacctct

SEQ ID NO: 19181 - DNA, 332 bp, Homo sapiens
  misc_feature 100: s=g or c
  misc_feature 140: s=g or c
  misc_feature 144: m=a or c
  misc_feature 165: r=a or g
  misc_feature 172: b=c or g or t
  misc_feature 173: r=a or g
  misc_feature 185: k=g or t
agattaaagggggggagggaaaaggagctcggccgccattttcccagtgccgccgccaccgctcgccgagccggcgggagaactgagcaccgtagcgaascgatcgggtccgggcgtggtggctcacgcctgtggtcccsgcamctttggggaaggcccaggcgrgtggatbrcggggtcaggakttcaagaccggcctgcccaacatggcaaaaccccgtctctactaaaaatgcagaaaattagctgggcatggtggtggccacctataatctcggctactcgggaggctgaggcgggagaattgcttggacccgggaggcagaggttgc

SEQ ID NO: 19182 - DNA, 151 bp, Homo sapiens
  misc_feature 139: r=a or g
  misc_feature 141: r=a or g
  misc_feature 144: m=a or c
  misc_feature 148: m=a or c
caaagattagccgggcttggtggtgcatgcctgtaatcccagctactcaggaggctgagacaggagaattgcttggacctgggtggcagaggttgcagtgagccgagatcgcaccactgcactccagtctgggtgacarargcmagamcct

SEQ ID NO: 19183 - DNA, 114 bp, Homo sapiens
aagttttgtattaggttgttttcacactgctataaagaaatgcctgagactgggtaatatataaaagaaagaggtttaatttactcacagttctgcatggctgaggaggcctca

SEQ ID NO: 19184 - DNA, 108 bp, Homo sapiens
attaatctggaaaagctgcgttgaagaagggtacagtggtgagatgcttctgcatggaaagcacaggacattttaaaaagttgagtgttgttgaagtgtgtagggtaa

SEQ ID NO: 19185 - DNA, 102 bp, Homo sapiens
  misc_feature 16: v=a or c or g
atagagttgaatagavtggaatgcaatgaaatggaacgaagtgaaatcgagtcgaatggaatcatccggaatggaatggaatggaatggaatgcaaagcaat

SEQ ID NO: 19186 - DNA, 130 bp, Homo sapiens; identical to SEQ ID NO: 18489

SEQ ID NO: 19187 - DNA, 344 bp, Homo sapiens
aatcgttcagaaaaagactaatggcagtgtgtagtgttccatggtgtgtatatgtgtgtgtgtgtgtaccagttttctttatccactcgttgattgatgggcatttggactggtttcatattttcacaattgtgaattgtgctgctataaacatgtatgtgcaagtgtttttttttaaaattattttattttattttattttttttgtgtaatgacttcttttcctctgcatagatgcccagtagtgggattgctgaatcaaatggtagatctacttttagttctttaaggaaactccatgctgttttccatagtggttgtactaatttacattcccaccagca

SEQ ID NO: 19188 - DNA, 125 bp, Homo sapiens
  misc_feature 104: n=a, g, c or t
  misc_feature 120: m=a or c
ctgggattataggtgtaagccactgcgcctggtctctttctttttctttttctttctttctttctttctttcctttctttctttcttccttccttccttccctncttccttccttccctmccctc

SEQ ID NO: 19189 - DNA, 173 bp, Homo sapiens
  misc_feature 117: y=c or t
  misc_feature 119: d=a or g or t
  misc_feature 126: r=a or g
ataatcaccattctgactggtgtgaaatggtatctcattgtggttttgatttgcatttctctaatgaccagtgatgatgagcattttttcatatgtttgatggctgcataaatggtytdcttttgragaagtgtctgttcatatccttcacccactttttgatggggttgtac

SEQ ID NO: 19190 - DNA, 175 bp, Homo sapiens
  misc_feature 118: m=a or c
caattcaacatgagatttagtggtgacaaatatccaaactctatcaacctctaatgctgacctcactgcctttcctcctgcccaccatcagctttctcctcctcttgtatttttttcmaattgctgtcacccatccgtcagttctcatcaacttctctttctccttccccagatc

SEQ ID NO: 19191 - DNA, 135 bp, Homo sapiens
  misc_feature 112: r=a or g
tttttcgagggttgcctggcaagcctgctctcgccgccctgtagccgtagaacacatttctggaagatgaagaaaaacctgcttctctggttctcaccaagcagagcccgaracttcttccaagaacagtgaggt

SEQ ID NO: 19192 - DNA, 102 bp, Homo sapiens
cttgcatgatgaccgtgaaggcgaaggcagtgacaagtgggtgagccggggccggggccgaggagcctttcctcggggtcggggccggttcatgttccggaa

SEQ ID NO: 19193 - DNA, 289 bp, Homo sapiens
  misc_feature 251: s=g or c
tgtccttagcaatgcttttaagataccaaatgatggccgggcgcggtggctcacgcctgtaatcccagcactttgggaggccgaggcgggtggatcatgaggtcaggagatcgagaccatcctggctaacaaggtgaaaccccgtctatactaaaaatacaaaaaattagccgggcacggtggcgggcgcctgtagtcccagctactcgggaggctgaggcaggagaatggtgtgaacccgggaagcggasttgcagtgagctgagatcatgccactgcactccagcct

SEQ ID NO: 19194 - DNA, 377 bp, Homo sapiens
  misc_feature 185: n=a, g, c or t
  misc_feature 293: n=a, g, c or t
  misc_feature 310: n=a, g, c or t
  misc_feature 311: k=g or t
  misc_feature 321: k=g or t
  misc_feature 322: s=g or c
  misc_feature 337: v=a or c or g
  misc_feature 338: n=a, g, c or t
  misc_feature 339: h=a or c or t
aatggagatgtttatccaatgcctatacccccattgaatcttgggggtaactaacttgtttttgattttacaggctcataagtgaaagggatttgccttgtctcagatgagactttgggaacttttgagttaatgctggaatgagtcaagactttaggggactcttgagaaggcatgattgtagnttgcaatgtaagaatgacatctcttcccctcatgatgctcctgcttacatggcaggaacaggaggaagagatagagtggaaagagatttgggaagagccaggggtggnatgatatagtttggacnkttgtccccakscaaatcttgtgttgvnhtgtagtccacaatgctggaagtggggcctggggggact

SEQ ID NO: 19195 - DNA, 300 bp, Homo sapiens
  misc_feature 113: r=a or g
  misc_feature 181: y=c or t
  misc_feature 182: n=a, g, c or t
  misc_feature 202: d=a or g or t
gttgtagaagtaagggctttattcagctgggagcatcggcaagctactgccttaaaatccgagctcctcgagtgcacaatttctgtcccttttaagggctcatggcactgaargattttcacatgaaagggtcgtgattgatttgagcaagcaaggggtatgtgacaggggctgcatgcaynggtggtctgagagaaacagdacagggcagggagtttcacaatgttcttctatacaatgtctggaatctatgaataacgtcggtttctaagtcatgagttgatttttaactactaggtt

SEQ ID NO: 19196 - DNA, 143 bp, Homo sapiens
tgtttttcatatgttgttggagttggttagctagtattttgttaaagattttagcatcaatgttcatcaaggatattggtctgtagttttcttttttggttatgtcctttcctggtttttgttattagggtgatgctggctat

SEQ ID NO: 19197 - DNA, 179 bp, Homo sapiens
  misc_feature 123: w=a or t
tccaaaaaggagttagttatttctgatgatgactgtgcaccacttgctgagctttgtaaagggcttaattttgtttctttttgtatcatactattccagaaaaggtagctagtaggtattttwtccttaccaaaagatgggcatgcttgaagtaaatggttcaattataagagtgtggc

SEQ ID NO: 19198 - DNA, 207 bp, Homo sapiens
cagtggtgcgatctcggctcactgcaagctccgcctcccgggttcacgccattctcctgcctcagcctcctgagtagctgggactacaggcacctgtcaccccgcccagctaattttttgtatttttagtagagacagggtttcaccatgttggccagaatggtctcgatctcttgaccttgcgatccatccacctcggcctcccat

SEQ ID NO: 19199 - DNA, 161 bp, Homo sapiens
tattattatactttaagttttagggtacatgtgtacattgtgcaggttagttacatacatatacatgtgccatgctggtgtgctgcacccactaactcgtcatctagcattaggtgtatctcccaatgctatccctccccactccccccaccccccaacaa

SEQ ID NO: 19200 - DNA, 159 bp, Homo sapiens
attttcttgatattttccttttcactgtgtgtttagtctctttctgatagtcatattaagaggatgttgggcttcatgacatcactccctgttttttatcgcttcaactttttattctattctgtgagatttccttgacttcagattcccagcccatct

SEQ ID NO: 19201 - DNA, 153 bp, Homo sapiens
tttgagacagagtttcactcttgttgcccaggctacagtgcaatggcacggtcttcgctcaccacaacctccgcctcctgggttcaagcgattctcctgcctcagcctcccgagtagctgggattacaggtatgcaccaccacacctggctaa

SEQ ID NO: 19202 - DNA, 512 bp, Homo sapiens
  misc_feature 252: n=a, g, c or t
  misc_feature 473: s=g or c
  misc_feature 486: m=a or c
aaattggaaataaactcttaccatcattttaactggataaaaagtgaagtgtctaaagatgtatatatttggcacgtttgagttcacaagaggaagaacaaatttctagccaggaaaaccatgaaaggattccaaacagagattaaacttgtcctttgaggataggtaatgagtccagaattggtgggttcttggttttgctgacttcaagaatgaagccacagaccctcgcagtgaagtgttacagttctnaaagatggtgtggctggagtttgtttcttcagacgttcagatgcgtctgaagtttcttccttctggtgggttggtggtctgcctgacttcaggagtgaagctgcagaccttcgaggtgagtgctacagctcactaaggcagcgtggaccaaaagagtgagcagcagcaagatttattgtgaaaagcaaaaagagcaaaccttaaacagcttggaaggtgascctagagggttgmagcagctggctaggtggcctgctttt

SEQ ID NO: 19203 - DNA, 239 bp, Homo sapiens
tgagatgatcaaagcttctggtattttcaccaaatccagagtacctgagaaacatggtaaaactagcaagaagaaacaagggaaaggaggcagataattaatgcaggctcaagaagcatccttgaagaggtagcagcagcagaggagtgagagtgtgaagaagctgatgtgagtgtatgagacagacactcataatagaaaagtagcaactgaccagtacagcagtctgtggagaggcc

SEQ ID NO: 19204 - DNA, 278 bp, Homo sapiens
  misc_feature 116: k=g or t
  misc_feature 117: h=a or c or t
  misc_feature 123: r=a or g
tgataattgttgattttcttggatatagtcagaattaaaattgaaaaatcctcacccattatttctttaaatatatatttttttcagtccatctcctttccttcagggactccagkhacatgratattaggctgattgatgttgccccacaactattgataatctgtttatctccatttttttcttcttttgtcttgttttgaacagtttggttgctatatcaagttcactattcattcttctgaaatatctactgtgatagcagtctcctccagtgt

SEQ ID NO: 19205 - DNA, 138 bp, Homo sapiens; identical to SEQ ID NO: 17327

SEQ ID NO: 19206 - DNA, 507 bp, Homo sapiens
  misc_feature 330: n=a, g, c or t
  misc_feature 335: m=a or c
  misc_feature 337: b=c or g or t
  misc_feature 338: y=c or t
  misc_feature 414: m=a or c
  misc_feature 430: w=a or t
  misc_feature 437: m=a or c
  misc_feature 442: v=a or c or g
  misc_feature 451: w=a or t
  misc_feature 454: w=a or t
  misc_feature 455: h=a or c or t
  misc_feature 456: m=a or c
  misc_feature 466: s=g or c
  misc_feature 468: n=a, g, c or t
  misc_feature 469: w=a or t
  misc_feature 476: m=a or c
  misc_feature 480: w=a or t
  misc_feature 492: h=a or c or t
ctgatttagcatgtgcatcctagaatagaaacgaacatctttggccaggtgcagtggctcatgcctgtaatcccatcactttggctgggtggatcacttgaggtcaggagttcaagaccagcctggccaacatggcgaaacccggtctctactaaaaatacaaaaattagctgggtatggtcgcaggcacctgtaatcccagccactcaggaggctgaggtaagagagttgcttgaacctgcagagattgcagtgagccgagatcacgccaccgcactccaagcctgctgggcgacaaagcgagactgtctcaaaaaaaaagaagtagtnctaamabycaagttttaggttatctggtgccgtcagtttaaaagacacatggatttaatagcagacaggtgcttaaaaaaaaamgcattgagttcctgcwaatatgmaaggvccagcatgwtawhmgtaatagtgscnwaaagtgmtggwatactaggcaghaaaagctcttctttt

SEQ ID NO: 19207 - DNA, 112 bp, Homo sapiens
tgacaggagtatgtacagaaaattcaagttttgtttgagacttcataagcttggtgcatttttaagatgttttagctgttcaaatctgtttgtctcttgaaacaatgacaca

SEQ ID NO: 19208 - DNA, 157 bp, Homo sapiens
  misc_feature 59: y=c or t
ctggagcagtgtagtcctgtgaactgcaggcaactacaaactggattcagggtttgtgyaggaccgcgggacgaggctgcagtggtcatggggaccatgggtcccagcttaccctttccccattagaagtagtccttcctgactccaggccacccac

SEQ ID NO: 19209 - DNA, 345 bp, Homo sapiens
tgcagaatgtataaagaactctctaaattcaacagaaaagaaaaatctccaatcagaaaacagaaaaaaaaacactttaccaaggagtatatatgtatggcaaacatgcagataaaaaaaattcacatcattagtcattagagaaatgcaaatttccctaatgatgaaatattactaaaagctgtgatgagatattactacacatctataagaatgattaaaagaaaaacaattagctgggctcggtggctcacgcctgtaatcccagcacttttggaggccgagacagggtttcaccatgttagccaggatgaccttgatctcctgacctcgtgatccgcccgc

SEQ ID NO: 19210 - DNA, 190 bp, Homo sapiens
  misc_feature 18: k=g or t
ctctgtttcccaggctakagtgcagtgacatgatcttggctcactgcaaactccgcctcccgggttcaagagattctcctgcctcagcctctgagcagctgggattacaggtgcccgccaccgtgcccggctaatttttgtattttttagtagagatggggtttcaccaccttggccaggcgcggtggct

SEQ ID NO: 19211 - DNA, 220 bp, Homo sapiens
  misc_feature 212: m=a or c
agcaattctcatgcctcagcctcctgagtagctgggattacaggtgtgtgccaccatgcttggctaatgtctttttttgtgtgtatttttttttgtatttttaggagagatggggtttcaccatgttggtcaagctggtcttgaactcctgacctcgtgatccacccaccttagcctcccaaagtgctgggattacaggcctgagccactgmacccgccc

SEQ ID NO: 19212 - DNA, 162 bp, Homo sapiens
  misc_feature 119: b=c or g or t
  misc_feature 120: h=a or c or t
  misc_feature 130: d=a or g or t
  misc_feature 131: s=g or c
  misc_feature 132: m=a or c
  misc_feature 144: k=g or t
gacagtggttttttttttgtttttttttaccttttaagctcaggggtaccagtggaggtttgttgcataggtaaacaggggtttgttgtacatattatttcatcacccagatattaagbhtagtacccadsmgttatctttcgkgatcctctccctcccctt

SEQ ID NO: 19213 - DNA, 92 bp, Homo sapiens
gctttagtctcctgagtaactgagactacaggcatgtgccactgcacctggctaactgttgtatttctttcttttttttttttttttttttt

SEQ ID NO: 19214 - DNA, 313 bp, Homo sapiens
  misc_feature 291: v=a or c or g
  misc_feature 292: n=a, g, c or t
  misc_feature 296: n=a, g, c or t
  misc_feature 297: n=a, g, c or t
tacttctatcgtgtgcctgtgtggtttaagcttatccaaatggtgactcttttcaaggtcaaaaccactgatcatgttttttgtattcttgttttttatagaaattttgtagaggaaaaactgggtgcgaagtttgtgtagaggaccagattggacttagttaaagcattcgaagaaagcagcccagccacccccatattcttcatcctgtctccgggggtagatgcccttaaagacctggagattcttggtgagtggctgggaggctcgctggcccgccccttctccctvnctcnntttcacccccacccct

SEQ ID NO: 19215 - DNA, 127 bp, Homo sapiens
atagagtctcgctctgtcacccaggctggagtgcggtggtgcgatcttggcttattgcaacctctgcctcccaggttcaagcgattctcctgcctcagcctcccgagtagctgagactacaggcgca

SEQ ID NO: 19216 - DNA, 122 bp, Homo sapiens
gttataatttctacctctatttcacaactgatgagtggataatagtgttttcttactcaagaactgctggccaatgaagttcctccaaacacatgttttctttttaatcttttttttttttt

SEQ ID NO: 19217 - DNA, 177 bp, Homo sapiens
ctttcctttttctgccccaccatactaaaacatccttctttttgcctcttggtcataacatggcttctgaagatactgacaaagggaaagagggcaagttaatcagccccacttactagttcatgaactttaccaatgagttccccttatgtctctctttttttttttttttttttt

SEQ ID NO: 19218 - DNA, 135 bp, Homo sapiens
ccattttcctgcctcagcctcccaagtagctgggactacaggcccccgccaccacgcccggctaatttttttgtatttttagtagagacggggtttctctgtgttagccaggatggtctcgatctcctgacctct

SEQ ID NO: 19219 - DNA, 304 bp, Homo sapiens
  misc_feature 233: m=a or c
ccttcatttctgtctgggaacattgagaatctgttgttacatagtgttcagatttccgtttttattcattgagtgcttcccaaagctagtgagtgttctgaagttcccagacaacgctactactagttttgtatataaaaataaggagacattattattatattcttaatagatacagggtcttgctacattgcccaggctggtctcaaactcatagcctcaaacagtcttcmcgccttggcctcccaaattgttgagattacgtgcttgattcactgtgctgggccacggagataatcttgaa

SEQ ID NO: 19220 - DNA, 187 bp, Homo sapiens
  misc_feature 183: m=a or c
  misc_feature 185: h=a or c or t
ccctaatttttgtgtttttaatagagacggggtttcaccatgtttaccagcctggtcttgaactcctgacctcaggtgacctgccagcctcagcctcccaaggtgctgggattacaggtgagagccaccgcctctgtcttgctctgtcacccaggctgaggcaggagaatggcgtgaacccgmghga

SEQ ID NO: 19221 - DNA, 182 bp, Homo sapiens
caaagaagaaaaaaaattagccaggagtagtggtggacacctgcagtcctggctacttgggaggctgaagcagaagaatcacttgaacccaggaggcagaggttgtagtgagccgagatcgcgtcactgcactccagcctgggtgacagaatgagactccatctcaaaaaaaaaaaaaaaaa

SEQ ID NO: 19222 - DNA, 137 bp, Homo sapiens
ttttagggtacatgtgcacattgtgcaggttagttacatatgtatacatgtgccatgctggtgcgctgcacccactaactcgtcatctagcattaggtatatctcccaatgttatccctcccccctccccccatccc

SEQ ID NO: 19223 - DNA, 277 bp, Homo sapiens
  misc_feature 148: s=g or c
  misc_feature 235: v=a or c or g
tggctggctaatttttgtatttttagtagagacggggctttgctatgttggtcaggctggtctcgaactcctgacctcaaaatcacagctcactgcaacctttccctcctgggttcgggtgattctcctgcctcagcctctggagtgsctggggaattgcaggcacctgccaccacgcctggctggtttttgtatttttagtagaaacggggtttcgaatcttggccaggctggvtctcaagctcctgaccttatgatccacctgcctggaccaccc

SEQ ID NO: 19224 - DNA, 247 bp, Homo sapiens
  misc_feature 16: k=g or t
  misc_feature 136: s=g or c
  misc_feature 137: y=c or t
  misc_feature 138: y=c or t
  misc_feature 164: k=g or t
tttctgtgaagaatgkcattagtgttttgatagggattgcattgaatctgtagattactttgggtagtatggatatttcaacaaaactgattcttccaatccatgaacgtggactatcttttccattttttgtatsyytcaattttttgcaatcagtgtttttkgtttttggtttttgagatggagtttcactcttgttgcccaggctagaatgcaagggtgtgatcttggctcaccgcaacctacc

SEQ ID NO: 19225 - DNA, 139 bp, Homo sapiens
  misc_feature 131: m=a or c
gtatcgctctgtcgcccaggctgtagtgcagtggcatgatctcggcccactgcaagctccgccctccgggttcacaccattctcctgcctcagcttcccgagtagttgggactacaggcgcccgccaccamgcccggct

SEQ ID NO: 19226 - DNA, 76 bp, Homo sapiens
tttctaggtctaaggttttagagcagtcgattgcctccatctttcttttcttttcttctctttttttttttttttt

SEQ ID NO: 19227 - DNA, 209 bp, Homo sapiens
  misc_feature 126: n=a, g, c or t
acattttaagtaatatttttagtttttatttttagacagggtctcactctgtcacccagactggagtgcattgcagcctccaactcctgggctcaagtgatcctccctcctgccttggcctctcanggagctagaactacaggtgtgcaccaccacacctggctaattttttttttagaggcagggcctcgttacgtttcccaggccct

SEQ ID NO: 19228 - DNA, 200 bp, Homo sapiens
  misc_feature 16: w=a or t
  misc_feature 153: r=a or g
  misc_feature 164: r=a or g
tacagtaaatgcttawaaattgctatttctggccaggcacagtggctcacacgtgttatcccagcgctttgggaggccaaggtgggcagatcaccagaggacaagagttcaagaccagcctggccaacatggtgaaaccccgtctctactaaraaatacaaaaratacagctgctcaagaagctgaggcagaagaatggc

SEQ ID NO: 19229 - DNA, 289 bp, Homo sapiens
  misc_feature 86: d=a or g or t
  misc_feature 121: n=a, g, c or t
  misc_feature 276: d=a or g or t
tgaactacacttttagatcacaccattcaagacataagcttagggcggggcacggtggctcacgctgtaatcccagcactttgggdggccaaggtgggtggatcacctgaggtcaggagtntgagaccagcctgaccaacatggtgaaactctgtctctactaaaaatacaaaaattaggtgtggtggcacgcgcctgtaatcccagctactcaggaggctgaggcaggagaatcacccaggaggtggaggttgcagtgagccaagatcacatcadtgcactccagcct

SEQ ID NO: 19230 - DNA, 58 bp, Homo sapiens
aaaaaagaaatcatgtttaatactatttcaatcaaacattatcttttttttttttttt

SEQ ID NO: 19231 - DNA, 376 bp, Homo sapiens
  misc_feature 154: w=a or t
ctcttgcaaatttgtttacgttccttatagatgctggatattagatctttgtcagatgcatagtttgcagatactttctcccattctgtacgttgtctgtttactctgttgatagtttcttttgctgtgcagaagctcttaagtttaattagawtcccaatttgtcaatttttgtttttattgtgattgcttttgtgtctttgtcatgaaatctttgcccgtttctatgtccaggatggtattgctagtttgtcttccaggatttgggttttatatttaagtctttagtctaccttgagttgatttttgtatatggtgtaaggaaggagtccagtttcaattttctgcatatggctagccagttatcccagcacct

SEQ ID NO: 19232 - DNA, 95 bp, Homo sapiens
tcaccctgttgtgctatcaaatactagatcatattcattctatctaactatatttctgtacccattaaccatcgccagtttcctctccccggcca

SEQ ID NO: 19233 - DNA, 127 bp, Homo sapiens
aaattagctggctgtggtggcacatgcctgtaatcccagctggggcaggagaatcacttgaactcaggaggtagaggttgcagtgagccaagatcgcaccactgtattccagcctgggtgacagggc

SEQ ID NO: 19234 - DNA, 467 bp, Homo sapiens
  misc_feature 154: r=a or g
  misc_feature 363: n=a, g, c or t
  misc_feature 410: r=a or g
  misc_feature 420: m=a or c
taatattgatatgtttattagcctcctttaaatagacttttagtttccggaaggctatgttcattttagggttgccaatacctatcttagtaattgacttataggactgtgctgcccaacatggtggccattagctacatgtggctattttagracttaaattaaataaaattaaaaattcagtttctcagtcacactagttacatttcaagtgcttagtagccacacatggctagtggctactgtattatccaatgaatatatagaacatttccattgtcacagaaagttctgtgggacagcattgacataggaagtgctcagtaaatgttggtaaggtaagttaaggatatatgaattacntgtgtttgtttgttttgagacagagttttgctctattgcccaggatratctcggctmactgcaacctccaccttctaggttcaagtaattcttgtgcctcagcc

SEQ ID NO: 19235 - DNA, 150 bp, Homo sapiens
cagagggttggctgggcttggtggtgggcgcctgtggtcccggctacttgggaggctgaggcaggagagtggcgtgaacccgggaggcagggcttgcagtgggccgagattgcgccactgcacccagcttgggcgacagagcgagactcc

SEQ ID NO: 19236 - DNA, 71 bp, Homo sapiens
ttactgtattgaatactgtaagcaattataacacaatggtaagtatttgtgtttctttttttttttttttt

SEQ ID NO: 19237 - DNA, 101 bp, Homo sapiens
ttttatttatttatgtgtttgtttgtttgtttatttttgagatagagtctcgctctgttgcccaggctagagtgcagtggcacgactggctcactgcaaca

SEQ ID NO: 19238 - DNA, 158 bp, Homo sapiens
  misc_feature 144: s=g or c
  misc_feature 148: s=g or c
ttttttttaaagacttgctctgtcacccaggctgtagtgtgcagtggcacgatctctgcacacgatcactgcaagctctgcctcccaggttcatgccattctcctgcctcagcctccagagtagctggtactacaggcgcccgsccascacacccggc

SEQ ID NO: 19239 - DNA, 156 bp, Homo sapiens
  misc_feature 120: s=g or c
  misc_feature 121: b=c or g or t
  misc_feature 122: r=a or g
ctcaaaataaaaatacaaaaattagctgggtgtggtggtgggcgcctgtaatcccagttgcttgggaggctgaggcagaagaatcccttgaacgtgggaggtggaggttgcggtgagccsbrattgtgccactgcactccagcctgggcaaactct

SEQ ID NO: 19240 - DNA, 255 bp, Homo sapiens
  misc_feature 139: m=a or c
  misc_feature 148: y=c or t
  misc_feature 150: y=c or t
gtaaactggttgtttccagttggcaatgacataaagagcttgagccagaacataaatcaattcactacttccttagagaaagtcttgctattaaaaaaaataaaaaagtcatctgaactcatcagttctgcttagtgamaatttggtytyagcaccattaaatttttgcaggttagcagcaaggtaaagagcttgcacaagaatactaagcgactatatcactaagcagaactgatgagttcagatgactttttt

SEQ ID NO: 19241 - DNA, 133 bp, Homo sapiens
ttacagactgaccaggctctcacagagacggaaaaaaagaagaaagaggcacaagtgaaagcagaagctgaaaaggctgaagcgcaaaggttggcggcgattcaaaggcagaacgagcaaatgatgcaggaaa

SEQ ID NO: 19242 - DNA, 377 bp, Homo sapiens
  misc_feature 154: s=g or c
  misc_feature 312: r=a or g
  misc_feature 313: b=c or g or t
  misc_feature 314: b=c or g or t
gattggagtgcagtggcgcgatcttggctcactgcaacctctgccttccgtgttcaagcaatttctcgccattccctcctccccctcagcttctacaggcaccagtctgttttctgtctttgtggatttatgaatagctcatacaaatggaagsatacaacgtgtagctttttgtatccaacttctttcacttagcgtcgtgttttcgaggttcatccacatgtaaatcctgcgcatgcctctattccagacatataagtagggctacctacttccacaaacataccacagccttcacctgctttgctcacrbbctacctccaccctttccctcactcccgccccagctcacctccaagatctttcttccatacccc

SEQ ID NO: 19243 - DNA, 154 bp, Homo sapiens
  misc_feature 154: s=g or c
tttgtagagtcagggtcttgctttgttgcccaggctggtcttgaactcctgggctcaagtgatccttctgcctcaacctcctgagtagttgggattacacgtgtgagccaccacgcccggccagatacctcctaacacaggcatctccccgtcs

SEQ ID NO: 19244 - DNA, 184 bp, Homo sapiens
tgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaa

SEQ ID NO: 19245 - DNA, 208 bp, Homo sapiens
  misc_feature 198: d=a or g or t
acattttaagtaatatttttagtttttatttttagacagggtctcactctgtcacccagactggagtgcattgcagcctccaactcctgggctcaagtgatcctccctcctgccttggcctctcaaggagctagaactacaggtgtgcacaccacacctggctaattttttttttagaggcagggcctcgttacgttdcccaggccct

SEQ ID NO: 19246 - DNA, 88 bp, Homo sapiens
attgttctggttagtacttccagtaatttattgaatagatgtggtggaagtgggcatgcttctctggttccaccacatctattcaata

SEQ ID NO: 19247 - DNA, 197 bp, Homo sapiens
catatgtttttctatgctcatttttgaatagggattgttgtgctctaagaccaacaagcaggttctgtggcatgttccttgcttctgtgtcactctaatttggtaggattctactcttgaagtttgaagtgatgtacttaatttgggatgtctaggaagcattcttctgtgtgtttctgatttgcattttttttttt

SEQ ID NO: 19248 - DNA, 478 bp, Homo sapiens
  misc_feature 305: s=g or c
  misc_feature 316: n=a, g, c or t
  misc_feature 317: n=a, g, c or t
  misc_feature 318: y=c or t
  misc_feature 415: n=a, g, c or t
  misc_feature 416: n=a, g, c or t
acacaaccaacaccattcattttacaggtataaagcaaacagtagttcatcaataactctaatagttatgaaagccaggacccccacttgaaaattgtatgagcaatttttaaaaagagaataatgggtatgtacctgtattagttttctagggctgctgtcacaaattaccataaattgagtggcttaaaacagcagtaatttattctctcaccgttgtggaggccagaagtctgaaatcaaggtataggcacggccatgctatccccagaggttctagggtagaacccatcctgtcttccagsttctggtggtnnyaggaagtctttggcttgtgacagtatcactgcaatctctgcctttgtcttcacatggctttcttccttgtgtctctccagttttctgaggcctttgnnttatgaggacaccagtcagattttgtgcccaccctaaatccaggactgtatcattttaagat

SEQ ID NO: 19249 - DNA, 232 bp, Homo sapiens
  misc_feature 10: r=a or g
  misc_feature 142: w=a or t
  misc_feature 152: y=c or t
acattgttgrttcacttatgtccttactgattttctgcctgctggatctgtcaatttctgatagagaggtgttgatgtctccaactataatagtggactagtttatttctctttgctgttctattagtttttgccgcagatwttttgatgtyctgttgttaatcacatacacattaagaattgttatggcattttggaaagttgatctctttatcagtatgtgatggcccct

SEQ ID NO: 19250 - DNA, 88 bp, Homo sapiens
  misc_feature 66: k=g or t
  misc_feature 67: k=g or t
  misc_feature 87: y=c or t
acctcagctcccaggtatctgggactaaagtcatgcaccgccatgcccagataatttttttttttkkactttttgtagagacaaggyc

SEQ ID NO: 19251 - DNA, 50 bp, Homo sapiens
agatgacaggcgggaaatatgtttgaagtctttttttttttttttttttt

SEQ ID NO: 19252 - DNA, 136 bp, Homo sapiens
caatattttatttaggataagcagtgccgagaggatactaattcacatagataaaaatgtaatggtctggattttacaattttacataaaagaacatttgcagtctgaatgcaaaaagaaaggaggtgggggagtt

SEQ ID NO: 19253 - DNA, 127 bp, Homo sapiens
atctcctggcctcgtgatctgcccaccttggcctcccaaagtgctgtgattacaggtgtgagccaccacacctggcctatgactaaattttaaatcccacttcaattatttgttctttgcccagcca

SEQ ID NO: 19254 - DNA, 327 bp, Homo sapiens
  misc_feature 300: r=a or g
  misc_feature 304: r=a or g
aacaaattatggcttattcacacaatggaatttcctaccgtcatcaaaacaatgaactccagcaatcagtaatatggatgattcctagtttaatattaagtaaaaaaaataaattccttcaaattatcaacagttcaatacacttttcgtaaagttcaaataactaaaatactgggaatatatataaatgcaatacaactgcatgaaaaggaaagcagtggaatgattaacaaaagattcaagaggctgggtgcaatggctcatgcttgtaatctcagtgctttgagaggccaaggcagraggrtcacttaagcccagggtctgaga

SEQ ID NO: 19255 - DNA, 169 bp, Homo sapiens
ttaaaggccattgctggcctcagagcagctccgtaaagtattggggatcagaaaccaaactggtgagtggaaagtaaggaaagaattagagacagcaagtgttaagttgagcgtggtaggaaaaaagagatgacagatactaaatcgtgcattggggttgaggggagtc

SEQ ID NO: 19256 - DNA, 105 bp, Homo sapiens
gtcctttgcccactttttagtggggttgttttgaatttgtttaagtttcctttttattttactttattttatttattttttcttttcttttcttttttttttttt

SEQ ID NO: 19257 - DNA, 206 bp, Homo sapiens
  misc_feature 120: r=a or g
gagtgaaactatttcgtttctgactatttggatcattcagtcctaaaatcttactctcccacgtttttctaattgggttagcttatttaaagtaggtagccattcatccattcattcaartttgcttccccactaagttttggctaaagcctgctctttaggagtgctgcagacagagaaatttcttttttttttttttttttttt

SEQ ID NO: 19258 - DNA, 185 bp, Homo sapiens
  misc_feature 144: k=g or t
ctctgttactcagactggtgtgtagtggtgccatcatggctcactgagcctaggctcaggtgattctcccaccttagcctcccaagtagctgggactacaggtgtacatcaccatccctggcttattttttgtagaaatggggkttccccatggttgctcaggcttgtcctgaactcctgggcaa

SEQ ID NO: 19259 - DNA, 181 bp, Homo sapiens
aaatccgatgtttataaactggtaatcaaaaaggttttttcttttaggtgagtgggaaagtattacccttgttttaaatatctaagcaatgcctatcaacccttttgtgttatgattactgtagtcatatttatgaaaaaaggtttgtgttttactcttgctagtgagaaaagtgggacca

SEQ ID NO: 19260 - DNA, 226 bp, Homo sapiens
  misc_feature 146: r=a or g
  misc_feature 157: d=a or g or t
  misc_feature 159: h=a or c or t
  misc_feature 161: k=g or t
  misc_feature 167: w=a or t
cacattttctttattcagtctaccactgtaggcacttaggttgattgtgtctttgctattgagaatagtgctgcagtggatattcacgtgcatgtctttatggtagaatgacttatattcctttgggtatatattgagtaatgggrattactggtadthckgttttwaggtctttgaggaattgccagactactttccacaatggttgaaccagtttacactccct

SEQ ID NO: 19261 - DNA, 78 bp, Homo sapiens
aactgttatatttcttatctctttctttctttctatttaatgtgtctttcttttcctctgggtacttttttttttttt

SEQ ID NO: 19262 - DNA, 99 bp, Homo sapiens
  misc_feature 9: d=a or g or t
taagaactdatacaagacatctggcaattttaaaagccagagtgttttcttatagccaaatgactgcactagttttccaaaaatggttcttttcttttc

SEQ ID NO: 19263 - DNA, 106 bp, Homo sapiens
  misc_feature 71: y=c or t
caagttttgttcttaacatagatcttagcaacctcatcatatgagcttttttttctttaattttttttttycttttgagttggattctcactttgtcacccacggc

SEQ ID NO: 19264 - DNA, 248 bp, Homo sapiens
gaacagatctcacctctcgatggaagaactggaaattgtactgcaaaaggagtagatataggcaaggctgaagaccacagtcacttttacaatcaacttacccaaacttcatggagtcgtttcttcagatgaagtaatctgctattaatggtgcttcccctccacccctaaatctaagctgtgcaaacattaactcattttatcattgcaaaatagaatttttctttttcttttttttttttttccca

SEQ ID NO: 19265 - DNA, 84 bp, Homo sapiens
atctcatcctgaaaccatcctcacagacacacccagaaataatgattaatctaaacacactgtgactagtcaaactgacaaata

SEQ ID NO: 19266 - DNA, 102 bp, Homo sapiens
tagccaggatggtctggatctcctgaccacgtgatccacccacctcagcctcccaaagtgctgacattacaggcgtgagccactacagccggcccccaagcc

SEQ ID NO: 19267 - DNA, 108 bp, Homo sapiens
  misc_feature 34: k=g or t
  misc_feature 95: k=g or t
ctcaaatcagaaatgagcacacataacttctatkttcaacactttgtctagaactggtaatacaaccccaactgaccacaagagaaccaaggttktagtctggcaata

SEQ ID NO: 19268 - DNA, 94 bp, Homo sapiens
  misc_feature 54: k=g or t
  misc_feature 60: y=c or t
ccatgttccactaatttttgtatttttagtagagatggggtttcaccatgttakccaggytggtcttgaactcctgacttcatgtgatctgccc

SEQ ID NO: 19269 - DNA, 89 bp, Homo sapiens
  misc_feature 51: k=g or t
  misc_feature 57: w=a or t
ccaaaggtgcaaaagtgaagcccccagcgccagacaaggtagttcacacckgtaatwccagcactttgggaggctgaggcaggaggatc

SEQ ID NO: 19270 - DNA, 267 bp, Homo sapiens
ttttttctcagaattgttttggctattcggggtctttcatgggtccatacaattttaggattgtttatttttatttctgtgaagaatgccattaggattttgagatggattgcattgagtctgttatattgctttgggtaatgtgaacatctaaaaaatattaattcttccaatccatgaactcagggatatgttttcatttgtgttttttttcctaatttctttcatcaatgttttatagttttcagtgtatacatggtccccact

SEQ ID NO: 19271 - DNA, 118 bp, Homo sapiens
cacagctatttgagaggctgaggcaggaggatcccttgagcccaggaagttgaggctgcagtgagctgtgatcgcatcactgcacttcagccaaggcaacagagcgagaccctgtctc

SEQ ID NO: 19272 - DNA, 147 bp, Homo sapiens
  misc_feature 114: m=a or c
  misc_feature 141: m=a or c
ccaacaatgatagactggattaagaaaatgtggcacatatataccatggaatactgtgcagccataaaaaatgatgagttcacgtcctttgtggggacatggatgaaattggamaatcattattctcagtaaactattgcmagaaca

SEQ ID NO: 19273 - DNA, 121 bp, Homo sapiens
atatttatttatttatttattgagatgcggttttgctcttgttgccctggctggagtacaatggcatgatctcagctcagctcactgcaacttctgcctcccaggttcaagcgattctcct

SEQ ID NO: 19274 - DNA, 118 bp, Homo sapiens
tagtcccagctactcgagaggctgaagtgggaggattgcttgagcccaggaggtcaagactgcactgagctatgatcatgccattgcactccagcctgggtgacagagcaagactcca

SEQ ID NO: 19275 - DNA, 138 bp, Homo sapiens
cttctgcctcagcttcttgagtagctgggtctacaggcacatgccaccacgcctggctaaattttgtatttttagtagagacaggatttcaccatattggccaggctggtctcaaactcctgaccttgtgatctaccc

SEQ ID NO: 19276 - DNA, 202 bp, Homo sapiens
gcattgggaaactatcggaggctttaatcaggaaacgatgtcttaaaaggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggc

SEQ ID NO: 19277 - DNA, 138 bp, Homo sapiens
  misc_feature 124: s=g or c
tcccgtggctctaatcgctcagctgaagcaacatcagcaccagggaaagaggaaggaaatccagacggtgctatcatcggggagccctgctacctttccccttgctacctgtctctctcaagascaaaccagcaccct

SEQ ID NO: 19278 - DNA, 198 bp, Homo sapiens
  misc_feature 194: m=a or c
ctgtctctactaaaaaaaaatacaaaaaattaactgggtgtggtggcacacacccgtaatcccagctactctggaggctgaggcaggagaatcgcttgaacctgggaggcggaggttgcagtgagccgatatcacgccactgcactccagccttgccgacagagcaagattccgcctctaaaaaaataaaatamataa

SEQ ID NO: 19279 - DNA, 244 bp, Homo sapiens
  misc_feature 157: y=c or t
  misc_feature 236: k=g or t
ctgtcttcatgtttctggaatttgtgatacaaagaaaaatgtataggcaatcactaatcaatgttatttttgtaaaccaatgagaatccctgtcaagcaagtttgtaatagctacttcctgtccccttttttttgcctataaaagccttcttgtaayaaaggctcatatttaaggttacttgggtctgagtcttccaggcagctgttcttatcttggctctagtaaactctttttktttttttt

SEQ ID NO: 19280 - DNA, 340 bp, Homo sapiens
  misc_feature 306: k=g or t
atttgatgtaacaattaaatgtgcaaagagctcagtaagagtatgttgggaaggttgcattctgaagatcagggaagcaattatttaatgagtatagtcttgaagtatatggttctcaaaagttttgccaataaattgccccagctctttagtctctgggaaagatcccttcatgttaacctgtggtggtaagtgggatcttacttaccacttaagatggtggtgtctggatcattagttctcaacattatatgtattaccatccacctctaaagtctcctctgcatagcacagagtttacttttktccaatgaaagaaacttcaaaattaaagagatat

SEQ ID NO: 19281 - DNA, 145 bp, Homo sapiens
  misc_feature 137: n=a, g, c or t
tagattcacagccaacattccgcttccacctgccccttatcatatacttcctgggactacttaggagagcacccaatgtagtctttgtaagttttaaagtcttcacagaggaaggaacatctcagcagatgcttaanagacaagt

SEQ ID NO: 19282 - DNA, 214 bp, Homo sapiens
gccaccttgcaggctgtaaccctttacaagaaataaaatctcctctcctcacaatttataaatttgtgatatttttggttaacattccaaagcatcgtgcacagaatgtgataaacccctcccactggaggttcttaaactgctccttagaatctcaggggctgccgaggtgcccctagggcagcaacccattttaagtagcgctccccacgat

SEQ ID NO: 19283 - DNA, 179 bp, Homo sapiens
ctttcattctaacccctctaactgcccactctgctgtggccacagcaaaagtcaccacatgtgcagctgctcagcatcttccatgggacttcatcctcctgggatcaagcctgggccatgtgtgaggtgtcctgatccccttcctcctgtcttctctcatcttcccttcctccccctct

SEQ ID NO: 19284 - DNA, 431 bp, Homo sapiens
  misc_feature 425: r=a or g
aaataacagctgtcttagtttgcctcttgtgtggtgaagtagtgaaagtctggaaagtcaaattgagggacatattgtgcaagatgttgtactgaatcctggagttattgggaggtgctgaatggcttttgagacaggcaagtggtggtttgatgtctgctttagaaaattagtttcactgttgtgtacactgaagagcccagttacgggctggactagtgaggcgcttgttggttgtaagtgacagaaacccaactcaaattagcttaggccaaaaagagaatatatgggttcatggaacccaaactaagaaaagggacggatctggcttcagggctgattagatccagggcctcaatgctgtcaagtcagatggttgtctcctattcctttacctccttttctctctttccccgtgcttcttratgctt

SEQ ID NO: 19285 - DNA, 331 bp, Homo sapiens
  misc_feature 18: k=g or t
  misc_feature 138: w=a or t
  misc_feature 140: w=a or t
  misc_feature 235: d=a or g or t
  misc_feature 246: r=a or g
  misc_feature 303: w=a or t
gttggctgtaagtatttkgctttatttctgggttctctattctgttccactggtctatgtgactatttttataccagtaccatgctattttggtaactattgccttatagtataaagttaagtgatgcctccagattwgwtctttttgcttagtcttgctttaaactatgtgggctcttttttgttccatatgcatttttggattgttttttctagttctgtgagaatgatggtdgtattttgatrggaattgcattgaatttttggttgcttttggcagtatgctcattttcacatgagcawggaaatatgtttccatttgtttgtgtca

SEQ ID NO: 19286 - DNA, 230 bp, Homo sapiens
  misc_feature 45: d=a or g or t
  misc_feature 47: s=g or c
  misc_feature 48: r=a or g
  misc_feature 118: r=a or g
  misc_feature 119: w=a or t
  misc_feature 136: s=g or c
  misc_feature 169: r=a or g
catgcaccactatgcctggctaatttttaaatttttaaatgtttdgsrgagacaaactcttgctcttttgtcctggcctgaagctctccttctgccttgacctcccaaaatgctaggrwttataggtgtcagccastgcacccggccgtaagttattttcaagtaggaraaaaaggaggctgcctgctccttaactcttcaagcctacccatccctatcaatcatccctt

SEQ ID NO: 19287 - DNA, 197 bp, Homo sapiens
gtttttaccgagagatgaaatgaaattgaattagcataataataagccttcagggccgggtgtggtggcttacgcctgtagtcccagcaccttgagaggtcgaggcaggtggatcacctgaggtcaggagtttcgggaccagcctggtcagcatggtgaaaccctgtctctactaaagatggaaaagtcggccgggt

SEQ ID NO: 19288 - DNA, 305 bp, Homo sapiens
  misc_feature 134: s=g or c
  misc_feature 135: m=a or c
gcgccggcaagggcagcgccacctccaactggaagaagacgcccctcagcacaggcgggacccttgcgtttgtcagcccaagcctggcggtgcacaagagctcctcggccgtggaccgccagcgagagtacctsmtggacatgatcccaccccgctccatcccccagtcagccacatggaaatagtgcgagccaggccccgtggaagacgggctccctcctcccccacctggcccctggtctagaaggacccactgcaccaccctccgctggctcgggaagacaccgtgcccgccccaagagcaa

SEQ ID NO: 19289 - DNA, 106 bp, Homo sapiens
tattagctatcacctttcatagggttctttagaaacaggtcaactgcctgacccacagaaaagccttcaatagaagctttctgcctgtgttaattacctggcaccc

SEQ ID NO: 19290 - DNA, 111 bp, Homo sapiens
gcttattagagtgtatttgatagactttgttttctaggaaagctttagacttttagaaaaattgaggagatattataggttattcccataggcttcccaccacttccccct

SEQ ID NO: 19291 - DNA, 128 bp, Homo sapiens
  misc_feature 124: m=a or c
  misc_feature 125: m=a or c
ttcagattggatctcttaggctttcctctgtcgcggttggacggaagaagaaaagcattacaagatggcaaagatctgtggcttgtccttgttctgttttatttatttattcttttttggagcmmtaa

SEQ ID NO: 19292 - DNA, 125 bp, Homo sapiens
ggaatttaatttgagaaattctaatattgagggattatgtatcagtgaggaacaatttcattttttagaacatgtagactgggtatggtggctcacacctgtaatcctagcactttgggaggcca

SEQ ID NO: 19293 - DNA, 140 bp, Homo sapiens
attacattttaagttttagggtacgtgtgcacaacgtgcaggtttgttacatatgtatacatgtgccatgttggtgtgctgcacccattaactcgtcatttaacattaggtatatctcctaatgctatcctcccccctct

SEQ ID NO: 19294 - DNA, 95 bp, Homo sapiens
gtccttgttgatttgtgtgatattaaagtattagtaataattgccaggaaactatcattagggagggtttagttggttgctgtttggaccgggag

SEQ ID NO: 19295 - DNA, 299 bp, Homo sapiens
gatttagtattttctctttaacctggttattctgatactcacgatggtgtgcttgcttatactcattgtactaggtacacagtggtccttttgatttgttagctcctgttttggaatgtgagtttaggttcaggaagaaagtttttgaattatttctttgataatttcctcagttcttctcatgtttacaaacttaccatattatgtatttgaataatagcacactaatatcacatatttacttacaacataagaatcttacaattttatgcttctacttcctacctctcatccttttt

SEQ ID NO: 19296 - DNA, 149 bp, Homo sapiens
actttgggaggctgaggtgggcgggtcgcctgaggtcaggagtttgagaccggtctggccagcgtggtgaggccccgtctctgctaaaaatacaaggattggctgggcgtgctggcgcgcaccctgtagtctgggctactcaggagcct

SEQ ID NO: 19297 - DNA, 397 bp, Homo sapiens
  misc_feature 123: m=a or c
  misc_feature 125: r=a or g
  misc_feature 346: w=a or t
  misc_feature 347: n=a, g, c or t
  misc_feature 357: r=a or g
  misc_feature 358: s=g or c
ctccaaaaacagttatattctgaggtactagggggttaaggcttcaacatatgaattttgagcaaacacaattttcttccaaagcattttctctgcttaaaagccttcagtgtagccgggcamarcggctcatgcctgtaatcacagcattatgggaggctgaggtgggtggatcactttgaggccaggagttcaagaccatcctggccaacatggtgaaaccccatctctactaaagatacaaaaattaactgggtgtggtggcacatgcctgtaatcccagctactcaggaggctgaggcaggagaatcccttgaacccaggaagcggaggttgcagtgacacwntatcataccrstgcactccagcctgggtgacagagcaaggctctgtctca

SEQ ID NO: 19298 - DNA, 111 bp, Homo sapiens
  misc_feature 87: r=a or g
cattaactcgtcatttagcattaggtatatctcctaatgctatccatcccccctcccccccaccccacaacagtcccctgtgtgtgrtgttccctttcttttttctttttt

SEQ ID NO: 19299 - DNA, 106 bp, Homo sapiens
agaaattgaaatactagcagggggcaagagcctttctctccagctacacactccatctcccgggagcaaggggaaactccgagaggagggcaacagagccagcaca

SEQ ID NO: 19300 - DNA, 122 bp, Homo sapiens
taatttttgtatttttagtagagatgggattttgccatgttgaccacgctggtctggaacttctgacctcaggcgatccgccggcctcgacctcccagagtgctgggattgcaggcgtgagc

SEQ ID NO: 19301 - DNA, 227 bp, Homo sapiens
  misc_feature 10: h=a or c or t
  misc_feature 14: y=c or t
  misc_feature 20: w=a or t
  misc_feature 23: y=c or t
  misc_feature 49: k=g or t
  misc_feature 58: d=a or g or t
  misc_feature 70: k=g or t
  misc_feature 116: w=a or t
  misc_feature 129: s=g or c
  misc_feature 140: d=a or g or t
  misc_feature 143: s=g or c
  misc_feature 147: k=g or t
  misc_feature 171: w=a or t
  misc_feature 189: y=c or t
  misc_feature 202: k=g or t
agtgagaaghtagyggcgcwgcygggacgggggaaaggagacgcttctkcctcttgcdgctcttctcgtkcccgagatcagcggcggcggtgaccgcgagtgggtcggcaccgtcwccggctccgggtscgaacaatgcdgastgakagcggaggcggcggcacctccttwgaggaggacctggactcygtggctccgcgakccgccccagctggggcctcggagcc

SEQ ID NO: 19302 - DNA, 320 bp, Homo sapiens
  misc_feature 239: b=c or g or t
atttccacctcagtgaacaactgtgttgaaaacatgtgtcaacctgaaaataaatttgtttatttatgaaaagcaaattaattcttcctgttctccagaactgacttatttaacctttgcattaaggacatcttactgaatgactttgggtggaataaagaatctaatgatttgtttaagagtaaggagaattagctgagcccttgcttggcacccaagtttttgcttagtactgatgbagctttttggtggacaaggaaatttttccttctaactaatacatgcaaaatcataagagcaaaatacatctcatggcaact

SEQ ID NO: 19303 - DNA, 171 bp, Homo sapiens
  misc_feature 134: s=g or c
  misc_feature 136: s=g or c
ctaaaaatacaaaattagccaggtgtggtggcgtatgctgtaatctcagctactcaggaggctgaggcaggagaactgcttgaacccaggaggcagaagttgcagtgagccaagtcgcacccactaactcgagscstgggagacagagtgagactctgtcttaaaaaaaaa

SEQ ID NO: 19304 - DNA, 85 bp, Homo sapiens
taaaatgtttacatggattccatggtcaaatgtgtaaaacaagatgtattcggaagggtttttcgatccctgtctcctctatcct

SEQ ID NO: 19305 - DNA, 367 bp, Homo sapiens
  misc_feature 25: w=a or t
  misc_feature 109: y=c or t
  misc_feature 115: r=a or g
  misc_feature 128: s=g or c
  misc_feature 134: n=a, g, c or t
  misc_feature 135: m=a or c
  misc_feature 146: r=a or g
  misc_feature 152: n=a, g, c or t
  misc_feature 153: r=a or g
  misc_feature 155: w=a or t
  misc_feature 172: r=a or g
  misc_feature 204: r=a or g
  misc_feature 225: y=c or t
  misc_feature 249: n=a, g, c or t
  misc_feature 250: n=a, g, c or t
  misc_feature 251: n=a, g, c or t
  misc_feature 252: y=c or t
  misc_feature 300: b=c or g or t
  misc_feature 301: k=g or t
tctcagacaatgactctgagcccgwgaaaaggtctgaggaggtcccgggaacctccccatccgccttggtgttggtacaggagcagcccctacccgagccagtcctccycgagcraagtccttgctgscccagnmtagctgcctgraagccnrawagagccagccagatgaragttgtctgtctgctttgcacaactccagtgrcctggaattaagagccacgcyggagccagcacagactggtgttcnnnygcaggtgcatcccacggaagacgaggccagcagtccctggagtgtgcbkatgcagaacttagcagcggcgatgacttcgagacacaggacgatcgcccctgcaccctcgcttcca

SEQ ID NO: 19306 - DNA, 59 bp, Homo sapiens
attaattagagtaggagaatgaagtttttgttgtaagtctttttttttttttttttttt

SEQ ID NO: 19307 - DNA, 291 bp, Homo sapiens
  misc_feature 64: s=g or c
  misc_feature 122: s=g or c
  misc_feature 229: h=a or c or t
gggcttgagccggggtgaatctggaggggccgggccgagcccgggggcgctttcgcacgcgaasaaccgctagagcaggacctggtctcccgagaggtgagccggagaggcaggcctggagsccacgccggaccccgggcagtagcccgagcgggactacttgttgatatttgaggagggaagtgtcttacctgagagcctggctggagaagactgaggtccaaggcthgaagcctaagtgattgccccaggactgtggatgatggctgcagacatcccgagagcgaccaa

SEQ ID NO: 19308 - DNA, 182 bp, Homo sapiens
  misc_feature 3: w=a or t
  misc_feature 16: r=a or g
  misc_feature 17: b=c or g or t
  misc_feature 85: h=a or c or t
  misc_feature 91: r=a or g
  misc_feature 113: m=a or c
  misc_feature 114: m=a or c
  misc_feature 123: w=a or t
  misc_feature 128: h=a or c or t
  misc_feature 138: w=a or t
  misc_feature 164: n=a, g, c or t
cawgaattatgaagarbttttttaaaaagagaaaactgaatttttcaatcattctaaaggagttcaattagtgatcccccatcahaaattraatatttctaccctcatagttmmactgttgtwaatahcttttaaacwagtgctattgacttataatacttaanacctgggacatgctaaac

SEQ ID NO: 19309 - DNA, 192 bp, Homo sapiens
  misc_feature 134: s=g or c
  misc_feature 174: m=a or c
attccagactgtggttggctgttgatcagaagggttcactgactagccactgggaaaggctccaaccagaaatgctgatcattaatctgtataaatccgtagaagctttaattgggattccatctgcttaaggscctgtcccctgttactttcattttccttcctccagagggmgccttataaccatcatcc

SEQ ID NO: 19310 - DNA, 254 bp, Homo sapiens
  misc_feature 135: h=a or c or t
aatctgttggggcgcttcgagctgagcggcatccctccggcccccaggggcgtgccccagatcgaggtgaccttcgacatcgatgccaacggcatcctgaacgtcacggccacggacaagagcaccggcaaggchaacaagatcaccatcaccaacgacaagggccgcctgagcaaggaggagatcgagcgcatggtgcaggaggcggagaagtacaaagcggaggacgaggtgcagcgcgagagggtgtcagc

SEQ ID NO: 19311 - DNA, 75 bp, Homo sapiens
  misc_feature 23: k=g or t
  misc_feature 49: s=g or c
catctactaatttcaatttaaakaaacttcattccaacagtattatttsattataatatcaatacaaaatttttt

SEQ ID NO: 19312 - DNA, 120 bp, Homo sapiens
caattctcctgcctcagcctcccaaagtgctaggagttcaagaccagctgggcaaacagtgaaactccatctactaaaatacaaaaaaaattagccaggcatggcggtatgcccctgtaa

SEQ ID NO: 19313 - DNA, 79 bp, Homo sapiens
  misc_feature 2: n=a, g, c or t
  misc_feature 3: n=a, g, c or t
tnngctaatcttgcttgtacttatgaatcctttattctggttgattctctgctctgggttattatgtaacaagtcattt

SEQ ID NO: 19314 - DNA, 129 bp, Homo sapiens
gtgtttttagtagagacggggtttcaccttgttagccaggatggcctcaatctcctgacctcatgatccgcccgtctcggcctcccaaagtgctgggattacaggcatgagccaccgtgccccgccaca

SEQ ID NO: 19315 - DNA, 310 bp, Homo sapiens
ttagcccttaattatggtgacagttccttattggggagtgtgtgagattatctagcaactattacagtataacacagttaatcttctccacacaccctattgcccagataatttacaattctgttaatagtgaggttgataaagtattactgataaaaaaaaagattaagaaaaaaacagaaaattatttggtgtggccatcttacatgcttatgtgtcttctacacaaagctaaatattctagcagtgatgtaatgaaaaattacaccttactgttgatgtatgtatgttctggtacacagatgtcatt

SEQ ID NO: 19316 - DNA, 218 bp, Homo sapiens
  misc_feature 57: y=c or t
  misc_feature 64: m=a or c
  misc_feature 76: m=a or c
  misc_feature 119: s=g or c
  misc_feature 129: m=a or c
  misc_feature 130: m=a or c
  misc_feature 131: r=a or g
  misc_feature 147: s=g or c
  misc_feature 151: h=a or c or t
  misc_feature 168: y=c or t
  misc_feature 174: m=a or c
  misc_feature 203: s=g or c
  misc_feature 204: v=a or c or g
  misc_feature 211: y=c or t
  misc_feature 216: m=a or c
gttctgcctcctgggttcacgccattctcctgcctcagcctccccagtagctgggaytacaggmgcccgccaccamacctggctaattttttgtatttttagtagagacggggtttcascatgttagcmmraatggtcttgatctcstgahcgcgtgatccacccgcytcggcmtcccaaagtgcttggattacaagcgtgasvaccgcayccggmct

SEQ ID NO: 19317 - DNA, 188 bp, Homo sapiens
  misc_feature 140: r=a or g
  misc_feature 146: m=a or c
catttatttattttgagttggagtttcgctcttgttgtccaggctggagtgcggtggcatgatctcggtccactgcaaccttcacctcccaggttcaagtgattctcctgcctcagcctttcgagtggcggggattgcargtgcamaccgccgcgaccggccaatttttgtgtttttttggtggaaag

SEQ ID NO: 19318 - DNA, 250 bp, Homo sapiens
  misc_feature 211: w=a or t
actcttctccttagtggttgtactaatttacattcccaccaacaatgtaggagagttcccttttctctagatcctcaccagcatttattattgcttatcttttgagaaaaggcattttgactagggtgaggtgatatctcattgtagctttgatttgcatttctctgatgaccagtgatgttgagcaccttttcgtatgtatgtttgccawctgtgtgtcttcttttgagaaatgtctatacatctttta

SEQ ID NO: 19319 - DNA, 135 bp, Homo sapiens
tggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgtt

SEQ ID NO: 19320 - DNA, 226 bp, Homo sapiens
ttacgaatataatgtggagtacttaaagctaattaacacatccatcagctcaaatatcactttttatagtgagaacatttgaaatttactctcatagcaattttgaaatgtacaatatgctattatattcaccatgctgtacagtagatatcaaaaaacctttattcctcgtgaataactgagattttatactttttgacatcatctccttattacccccaccgca

SEQ ID NO: 19321 - DNA, 106 bp, Homo sapiens
cccagtaatgggattactgggtcaaatggtatttcttgttctagatccttggggaatcgccacactgtcatccacaatggtggaactaattcacactcccaccaac

SEQ ID NO: 19322 - DNA, 103 bp, Homo sapiens
aatagtatgggtgtctttaatccgttaatgtgattaatggttttatagttctaattacgttaaactgtctttctttatctgaggtaaattcaactggttcttt

SEQ ID NO: 19323 - DNA, 113 bp, Homo sapiens
  misc_feature 69: n=a, g, c or t
  misc_feature 86: w=a or t
  misc_feature 99: r=a or g
tcaagctctgtagggtgttccagatatgaagcaaggtaagttcaggttgcataggaatttagatttacntttgtggtgtaattcgwtgtgtgttaggaraggctggtaaagta

SEQ ID NO: 19324 - DNA, 112 bp, Homo sapiens
  misc_feature 9: k=g or t
  misc_feature 15: y=c or t
  misc_feature 29: k=g or t
  misc_feature 102: w=a or t
ctgattttkctatgytgattttgtatctkgcaactttactaaatttatcagttctaatactttgtgtgtgtgtgtgtgtgtgtgtgtatgatttatatatawaaaggggagt

SEQ ID NO: 19325 - DNA, 227 bp, Homo sapiens
  misc_feature 40: m=a or c
  misc_feature 136: s=g or c
  misc_feature 137: m=a or c
  misc_feature 142: m=a or c
tgtctaaactacttaagatctttaacttattgggagtggmacgagtgggtgcgggtttcaggagggggagtgttatctcgccgagcaacctgtggaattccgctgagcggttatgctctgggggcataaagacagsmaggcmaataaggagacttttctccccagaggcccgcccatggttccccatgggtgtctcacacaggggagaccaactcatctggcaccct

SEQ ID NO: 19326 - DNA, 206 bp, Homo sapiens
  misc_feature 132: n=a, g, c or t
  misc_feature 134: n=a, g, c or t
  misc_feature 135: w=a or t
tcccagaaagcccttctgggtgtcatcttgccccgagcagtgcgttctcagagttctcccgccctgatgtccctcccagcatgcccagcccagccacaacagggccttgcttctagtcatgtgtctggctgntnwgctgggtccaggccagccctggtagggcacaatgggggcccgctctgccaccccatacctctccccaggtc

SEQ ID NO: 19327 - DNA, 83 bp, Homo sapiens
tgaagtgtccacacccaccaggcctcttgataccaattctccatttccaccagcctcttttatgcctgaaagtgtcactttaa

SEQ ID NO: 19328 - DNA, 116 bp, Homo sapiens
gggtatgtggtcagcagtgagtactgcgtgaacagcagccctcccatccgggaccaatatagggattaccacctgatagaagttgtgtgattctgtgattgttaaaacttacacat

SEQ ID NO: 19329 - DNA, 143 bp, Homo sapiens
tattgcctgaaagggcaccttaagaagcatctttgcattgctccttccctctcttctaaagcaactaacatcttttctctaatcctaacctcgtctttcccaaggatgttgtcttaggtcagcagttctttgccctgcctaca

SEQ ID NO: 19330 - DNA, 198 bp, Homo sapiens
  misc_feature 127: w=a or t
  misc_feature 128: n=a, g, c or t
  misc_feature 130: n=a, g, c or t
taacattaatcttaattattttcctgtcatgcactaaccatttaaattaaataaatgttgaaatttgtgaattggtttccttgtagttccctgcggaagattatatctgaatcttttacaagaaagwngnaagatacttatactatggattgggggcaagttagttctagccagaagtaacagtcaatgagacggccc

SEQ ID NO: 19331 - DNA, 230 bp, Homo sapiens
  misc_feature 118: m=a or c
  misc_feature 182: r=a or g
tttttctgttgcccaggctggagtgcagtggcatgatcttggctcactgcaacctttgcctcccgggttcaagtgatcctcctgcctcagcttcttgagtaactgggataacaggcamctgccaccatgcctggctaatttttgtatttttagtagagatggggttttatcatgttggtcgrgttggttccaaactcctagcctcaagcgatctgcccacctcggcctcc

SEQ ID NO: 19332 - DNA, 111 bp, Homo sapiens
agatcgagaccatcttggctaacatggtgaaaccccgtctctactaaaaactacaaaaaattagccggggtggtggcgagtgcctgcagtcccagctactcgggaggctga

SEQ ID NO: 19333 - DNA, 129 bp, Homo sapiens
acaaaggccgggcgcagtgggtcacgtctgtaatcccaacacccaacactttgggaggccaaggcaggtggatcatttcgagcttaggagtttgagaccagcctgaacagcagggcaaattccagcccc

SEQ ID NO: 19334 - DNA, 85 bp, Homo sapiens
cacctatttgtctttgtttttgttatatttgcttttgggttcttggtcatgaagtctttgcctaagccagggtctagaagggtaa

SEQ ID NO: 19335 - DNA, 197 bp, Homo sapiens
  misc_feature 107: s=g or c
  misc_feature 108: n=a, g, c or t
atctttaggatgtcaacagatgtttcctccgggatggaaacgggaagaggttccaaggacacaggcgtttggggaaaactgagttcaggttaaatggacatttgttsntttgccctgggatgtctcagagcctgtaataagatagtgtatcatctggaccttccgtgggtgctgcgtcatatacagttccccacata

SEQ ID NO: 19336 - DNA, 252 bp, Homo sapiens
  misc_feature 118: r=a or g
  misc_feature 217: r=a or g
cccttcctattctcagtggacagcggggcccgagtggttatctgcgacaaggatgagtctgggggccgggccctggagcaggagctccctggagctgtctttatcctctgtgatgtgrctcaggaagatgatgtgaagaccctggtttctgagaccatccgccgatttggccgcctggattgtgttgtcaacaacgctggccaccgtgagttgtgaraccccagggccattctccacctcctgccccccttt

SEQ ID NO: 19337 - DNA, 228 bp, Homo sapiens
  misc_feature 54: r=a or g
  misc_feature 55: w=a or t
  misc_feature 59: r=a or g
  misc_feature 60: w=a or t
  misc_feature 78: m=a or c
  misc_feature 102: r=a or g
  misc_feature 103: w=a or t
  misc_feature 110: r=a or g
  misc_feature 118: w=a or t
  misc_feature 123: m=a or c
  misc_feature 138: w=a or t
  misc_feature 178: n=a, g, c or t
cacgcctgaactaatttttgtatttttagtagagatagggtttcacgatgttgrwcagrwtggtctcaaactcctgamctcatgatccacagtctcccactrwtgctcargctggaawggcamctagatgcaaatcawagctcattgtagcctcaaaactcctgggctcaagtgatcntcctgctccagcctcccgagtagctaggactacaggtatgcaccatcata

SEQ ID NO: 19338 - DNA, 200 bp, Homo sapiens
  misc_feature 189: b=c or g or t
gccctaccaaaatggagaaaccccgtctcgactaaaaatacaaaattagccgagcacgatggcgcatgcctgtcatcccagctactcaggaggctgaggctggagaattgcttgaacccgggaggtggaggttgcagtgagccgagatcgcgccactgcactccagcctgggcaacaagagcgaaactbtcccccacgca

SEQ ID NO: 19339 - DNA, 201 bp, Homo sapiens
cctggccaacatggtaaaactccgtttctactaaaaatacaaaaattagttgggtgtggtggtgggcgcctgtaacccagctactcaggaggctgagacaggagaatcgcttgaacccggggaggcagaggttgcagtgagccgagatcgagccattgcactccagcctgggcgacaagagtgaaactccacctcaaaaaa

SEQ ID NO: 19340 - DNA, 284 bp, Homo sapiens
  misc_feature 9: y=c or t
  misc_feature 28: w=a or t
  misc_feature 44: w=a or t
  misc_feature 116: r=a or g
  misc_feature 128: r=a or g
  misc_feature 130: m=a or c
  misc_feature 152: w=a or t
  misc_feature 258: s=g or c
atgcagttyctttatagtgctcaatggwctttacaatttggtawgcttttgcagtggctggttccagttgctcctttctatgtttcatgcttccttcaggagctcttgtaaggtargcttggcagtgrcmaaatctctcagcacttgctttwctgtaaaggatttcatttcgctttcgcttatgaagcttagtttgctggatatgaaattccgggttgaaagttcttctctttaagaatgttgaatattcactcccastctcttctggcttgtagggtttctgc

SEQ ID NO: 19341 - DNA, 109 bp, Homo sapiens
ctggggcctaatttcttttatttgtgatgctagaacaaaactattagttttcctgaaattactcattccattaacaggtctgcattaaaaccttgccctcgccataaaa

SEQ ID NO: 19342 - DNA, 372 bp, Homo sapiens
  misc_feature 120: r=a or g
  misc_feature 124: b=c or g or t
  misc_feature 148: s=g or c
  misc_feature 187: y=c or t
  misc_feature 188: w=a or t
  misc_feature 228: k=g or t
  misc_feature 308: k=g or t
  misc_feature 309: n=a, g, c or t
  misc_feature 316: n=a, g, c or t
  misc_feature 317: n=a, g, c or t
  misc_feature 318: m=a or c
  misc_feature 320: w=a or t
  misc_feature 350: y=c or t
gatgtgctgtaatctcattgagtgtatctcattgtggttttatttttaattttaatttttaaatgtatttttattttttattttttatttttttaaattttttgagtacatagtaaggtrtatbatatatatttatggggtacataasatgttttaatacaggcatgcaatgacaaataaacacatywtagggaatggggtatccgtcccctcaacatttatcctttkaattacaaacaattcagttactctttaagttattttaaaatgtacaattaatgggctgttgaatagtaggtcttagtcaknatttacnnmtwtatttattttaacccattaaccatccccayctcctgctgtccccagaccccc

SEQ ID NO: 19343 - DNA, 151 bp, Homo sapiens
  misc_feature 34: y=c or t
  misc_feature 101: y=c or t
  misc_feature 120: y=c or t
  misc_feature 137: m=a or c
attcagtcaatacttccaacatttaagaaagtgyaagtcctttttgatttattgttttatttctaaaagtaataaatatcaatagaaggaaattaatccaytactgttttgaggctgcayggtgctattttttctgmcaatttggcttaat

SEQ ID NO: 19344 - DNA, 79 bp, Homo sapiens
tctgctgttcttcattaaggtcccagttttttagtatttttactgtaactgtatattttgaagaagtgttgaccacaac

SEQ ID NO: 19345 - DNA, 186 bp, Homo sapiens
tagaaaattatatataaaatgtcacctaattaagttcctgcatatattacctcaagatacagtaatctctatttcagaaatggaaagatgattcaacaatataagatccaataatgtaataggccacatttaaagaacaaaggagaaaacccatgtcatcatctcagtagataacctcctcccaca

SEQ ID NO: 19346 - DNA, 155 bp, Homo sapiens
tttttctttcactttattactctgactagaacttctagtatatgttgaataggagtggtgagagtgggcacctttgtcttgcagtttaaggggaatggttccagctttggcctatttttggtatgatgttggctgtgagtttaccatagatggct

SEQ ID NO: 19347 - DNA, 297 bp, Homo sapiens
  misc_feature 109: m=a or c
  misc_feature 112: r=a or g
  misc_feature 117: n=a, g, c or t
  misc_feature 119: w=a or t
tattcagactcaagcaggcataactttagaaagaagcagtaattcggccgggcgcagtggctcacacctgtaatctcagcactttgggaggccgaggtgggcggatcamgargtcangwagattgagaccatcctggcttaacacggtgaaaccccatctctactaaaaatacaaaaaaattagccgggcgtggtggcgggcacctgtagtcccagctacttcggaggctgaggcaggagaattgtgttaacctgggaggcagagcctgcagtgagccgagactccgtttcaaaaaa

SEQ ID NO: 19348 - DNA, 106 bp, Homo sapiens
cctgccaccacgcccggctaatttttgtatttttagtagagacggggttcaccatgttagccaggatggtctcaatctcctgatctcatgatccgacccctcccta

SEQ ID NO: 19349 - DNA, 190 bp, Homo sapiens
acaattctgatggccgggtctcacctgcagaggttctatcattagcctgggatacggcttgggtctcagtatttttaaaaatcagcagagcttgaggatcattgttttaaatcatgccaatttcaaatttaggccaaagggcaatttcttttatcataatctgtctaaggcctaaatttgaaattggcat

SEQ ID NO: 19350 - DNA, 56 bp, Homo sapiens
gttttggtttgtgatgtttccagttttatttgtcttgagatttttttttttttttt

SEQ ID NO: 19351 - DNA, 136 bp, Homo sapiens
  misc_feature 117: w=a or t
agcatattttgaagtcagaaagtgtgatgcctccagctttgttgttttgctctggctattcagggttgtctgtggttccatgtgagttttggaattgttctttctatttctgtgaawaatgtcattggtttttttt

SEQ ID NO: 19352 - DNA, 125 bp, Homo sapiens
  misc_feature 104: b=c or g or t
  misc_feature 106: y=c or t
  misc_feature 107: w=a or t
  misc_feature 120: k=g or t
  misc_feature 123: h=a or c or t
ctgggattataggtgtaagccactgcgcctggtctctttctttttctttttctttctttctttctttctttcctttctttctttcttccttccttccttccctbcywtccttccttccckcchtc

SEQ ID NO: 19353 - DNA, 110 bp, Homo sapiens
  misc_feature 96: y=c or t
agagcaagttcacagaaattgatacaaaaacttttttgaatcttgaaaagatgctcaatttcataaaatgccagtttcttttttttttttcctttycttttttccctttt

SEQ ID NO: 19354 - DNA, 293 bp, Homo sapiens
  misc_feature 121: h=a or c or t
tacatggttattttgctgacttgtttatgtggttgttttacagtggtcgcttgtctgtgtacttaggtgtgtttttttaggaactggtagtagtcttttcttcccatatttagtgcttcghtcaggaactctcataaggcaagtctgttggtaacaaattccctcagcatttacttgtctgaaaaggatcttatttctcctttgcttatgaagcctagtttggctagatatgacattctatgctggaatttctttcctttaagaatgctgaatattggcccacaatctcttct

SEQ ID NO: 19355 - DNA, 181 bp, Homo sapiens
catcaagaacctgcatgatgattcctgctactgcaaagtgaattttataaagagatggggtttcaccatgttggacaggctggtctcgaactccggacctcaagtgatccacccgcctcggcctcccaaagtgctgggattacaggcatcaggcactgcacccgtccaagaactgagccaa

SEQ ID NO: 19356 - DNA, 127 bp, Homo sapiens
  misc_feature 110: y=c or t
cttccttatcatctggcactggttcagaagcactcatctctaccaagttgtattctaattcctctggtatggtgtctattagctcttcagtttctccaaaatccatgtcytgaaatccttccacccc

SEQ ID NO: 19357 - DNA, 147 bp, Homo sapiens
tggaatcaacacgattgcaatggaatggaatggaatggaatggaatggaatggaatggaatggaattaaccggaatagaatggaatggaatggaatggaacggaatggaattggaatggaaaagggaatggaatcaacacgagtaca

SEQ ID NO: 19358 - DNA, 264 bp, Homo sapiens
  misc_feature 199: s=g or c
ggaatgtaaattggtacagcctttaggaaacaaaaacagtaaggaggtttctctaaatattaaaaatagaactaccatatgatccatcaaccccacttctgggtatttatccagaggaacttaaatcaggatcttgaagagatacctgcatgcccgtgtgttgagaggctggagaatggcgtgaacccgggaggcggasttgcagtgagccgaaatagcgccactgcactccagcctgggcgaaagagcgagaatgccgtctaa

SEQ ID NO: 19359 - DNA, 185 bp, Homo sapiens
tgatcctgtcatcagcaaacagcaacagtctgacttcctctatcaagacaggatgctcacttttaccacttctattcaacatagggctggaagtcctagccagagcaatcagagaagagaaagaaaatcaaagggcatccaaatcagtaaagaggaagtcagactgttgctgtttgctgatgaca

SEQ ID NO: 19360 - DNA, 51 bp, Homo sapiens
tctggatgaaacctttttttttttggatttttttctccaccaaaatctttt

SEQ ID NO: 19361 - DNA, 140 bp, Homo sapiens
ctccacctgtatcacctacaagaaaccaaagacaaacataaatcttgaaagatgccagaggggaagaatcatgttgcatgtataggaacaaagataggaattaccaaagatctatttccagaagttgttataaactgaat

SEQ ID NO: 19362 - DNA, 132 bp, Homo sapiens
  misc_feature 116: m=a or c
  misc_feature 125: n=a, g, c or t
cagaagtgtggataaaatccataatgagagatcactaacaccttttaaaatggctaacattaaaaggactgactgtactaagtgttggcaactggaacgctcacattatggtgggmaatgtaganccatgct

SEQ ID NO: 19363 - DNA, 198 bp, Homo sapiens
ccatcacctcaagcatttataatttttttgtgtaaaggacattcaaaattcattttttctagctatttgaaactatgcaataaatcactgttaactatagttgccctacagtgctgtagaatactagaatttattcctcctatcttgctgtaatattatatcccctagcaaacgtttttctcttctccatctcacccc

SEQ ID NO: 19364 - DNA, 102 bp, Homo sapiens
tgtgcgtggctctgatgctgtccttttcactttccctctattttgcttttctccaggatccttcctttctccattttcttttctttcttttttttttttttt

SEQ ID NO: 19365 - DNA, 256 bp, Homo sapiens
cagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcgcc

SEQ ID NO: 19366 - DNA, 130 bp, Homo sapiens
  misc_feature 99: m=a or c
  misc_feature 112: w=a or t
  misc_feature 115: k=g or t
  misc_feature 124: s=g or c
tgtaagagaatgtcagtgctcaggaaacgtgtgagcaaatgaatgaatgaatgaatgaaagggggatgagccatctaagtgccttatcccttttctcamattgcccctagawttkgggtacctsggctga

SEQ ID NO: 19367 - DNA, 129 bp, Homo sapiens
taatcattttcagctgggacaaggacccagctatcgtaattcctaatccaggatttggatacccttacattttgctgtctgcattttaaaagtgccttccttagatgacatctttctaatccccaacct

SEQ ID NO: 19368 - DNA, 138 bp, Homo sapiens
actcctgacctcaagtaatcctacgcctcaacctcccaaagtgctaggattacaggcatgagccactgtgcccggcctatagatgttcttatttaagttaaggaagtttccctttattcctagcttgctgagagtttt

SEQ ID NO: 19369 - DNA, 141 bp, Homo sapiens
ttattattatactttaagttttagggtacatgtgcacaatgtgcaggtttgttacatatgtatacatgtgccatgttggtgtgctgcacccattaactcgtcgtttagcattaggtatatccctccctgctccccctactt

SEQ ID NO: 19370 - DNA, 97 bp, Homo sapiens
  misc_feature 18: k=g or t
  misc_feature 57: k=g or t
tgtggcgccatctcagckcactgcaagctctgtctcccgggttcgcgccattctcckgcctcagtctccagagcagctgggactacaggcacgccat

SEQ ID NO: 19371 - DNA, 105 bp, Homo sapiens
taatgagaaatcaccacagtgaaagtaaaagacgagagttcgaactcagcaagttctcatcgaagcagctttcttttttcttttcttttcttttttttttttttt

SEQ ID NO: 19372 - DNA, 52 bp, Homo sapiens
ttagtcttgctagcggtctatcaattttgttgatcttttgaaaaaaaaaaaa

SEQ ID NO: 19373 - DNA, 115 bp, Homo sapiens
gagtgtgatggatttctattaggaaaattgattttctcctgtttataaggatcttggatgtcaaaagaatatttgtttaacttgagttttgtgctgattctatgtcttaggccct

SEQ ID NO: 19374 - DNA, 101 bp, Homo sapiens
tagtgtgtattctttggaggattgatattttattattgatattctatatattgatattataaaaccataatatatatgggggccaggtatacagtaggtca

SEQ ID NO: 19375 - DNA, 140 bp, Homo sapiens
cctcaagctcccgagtagctgggactacaggcgcctgccaccacgcctggctaatttttttgtattttttagtaaagacggagcttcaccgtgttagtcaggatggtctcaatctcctgacctcgtgatccgcccaccca

SEQ ID NO: 19376 - DNA, 151 bp, Homo sapiens
cgtggctttagcaaattcagtttatttctttatgcacagtctcccagaagtggaaccttttaatcgtgtaaagagaggaatggttttgcacattagtatagaaaaagttggtgattgtgatggtactttgagaatttcaggtctgggggaa

SEQ ID NO: 19377 - DNA, 99 bp, Homo sapiens
ttaaagtatatatgctttgtataatgaaacactgtagttctggcctcttgtgagtctatgtggaaatcatttaggataatgatgaaacttaacatggca

SEQ ID NO: 19378 - DNA, 188 bp, Homo sapiens
cacagcaacctctgcctcctgggttcaagtgattcatgtgcctcagcctcctgagtagctgggttacaggtgtatgccaccatgcctggctaacttttttgtatttttaagtagagatggggttttaccatgttgaccaggctggtcttaaactcctggcctcaaatgatccacccacctcagcctcc

SEQ ID NO: 19379 - DNA, 197 bp, Homo sapiens
  misc_feature 48: w=a or t
  misc_feature 61: w=a or t
  misc_feature 147: y=c or t
tatctttcctaaagaaatacctgcttacctcagttaactttttttttwatatttatacttwaagttctagggtacatgtgcacaacatgcaggtttgttacataggtatacatgtgccatgttggtttgctgcacccatcaacttgycatttacattagatatttctcctaacattattcctcccctaaccccccac

SEQ ID NO: 19380 - DNA, 189 bp, Homo sapiens
  misc_feature 129: w=a or t
ttaccttttaccagtgtacgagtcatgttttaaatgtttgcgttgaggttagaagtcaggtcatctctttgtgtactctttactcttcactagtaatttgttaattcagtcatcaagcttctaggtagwagccagacaaccttagctgtctcctgtccccatctataaaatggttatcatgcccaccct

SEQ ID NO: 19381 - DNA, 250 bp, Homo sapiens
ccttttgaggctattttctaggtcttgtaagcttgcttcatcattttttgtttttcttttgtctcctctggccatatattttcaaactgcctgtcttcaagctcactaatttttttcttctgcttgatcagttccgctgttgagagactcttatgcattgttcaatatatcaattgaatttttcagctccagaatttatgcttaactgtttttaattatttcagtctctgttaatttttttttttttttt

SEQ ID NO: 19382 - DNA, 201 bp, Homo sapiens
  misc_feature 117: d=a or g or t
tccattccattcgatgattccattcgagtcctttcgatgattctcttcgattccatacgataattccgtttttttccgtttgatgttgattccattcgattcctttcgatgataatdccattcgattctatgcgatgattccattccattccatttgaagatgattccattcgagaccattcgatgattgcagtcaattca

SEQ ID NO: 19383 - DNA, 119 bp, Homo sapiens
gcctcagcctctctgagtagctgggattacaggcgcccgccaccaagcccggctaattttttatatttttagtagagacagggtttcactgtggtctcgatctcctgatcctctcccct

SEQ ID NO: 19384 - DNA, 153 bp, Homo sapiens; identical to SEQ ID NO: 17703

SEQ ID NO: 19385 - DNA, 205 bp, Homo sapiens
cttgtctgtaaaggattttatttctccttcacttatgaagcttagtttggctggatataaaattctgggttgaaaattcttttctttaagaatgttgaatattggcccccactctcttctggcttgcagggtttcttatgagagatccactgttagtctgatgggcttccctttgtgggtaagctgacctttctctctggctgcc

SEQ ID NO: 19386 - DNA, 241 bp, Homo sapiens
  misc_feature 145: k=g or t
  misc_feature 173: w=a or t
cctcaatctcattatttgttactggtctattcaggattttgatttcttcatggttcaatctgggtaggttatggatgtctaggaatttatccatttcttcttggttttccagtttattagtatatagctattcatagtaatctckaataatcctttatatttccgtggtatcwgtagtcatgtctcctttttcatctctgattttatttatttgggtcttccctctttctttttttttttt

SEQ ID NO: 19387 - DNA, 124 bp, Homo sapiens
tgtaatcccagctactcggaaggctgagacaagagcatcgcttgaatccaggaggtggaggttgcaatgagctgagatcgcaccattgcactccagcctgggtgacagagcgagactctgtctc

SEQ ID NO: 19388 - DNA, 364 bp, Homo sapiens
  misc_feature 145: k=g or t
  misc_feature 146: w=a or t
tcctgagtgcttctttttcttgtctatgaatgcttcttttttgtagcatgcttttcttgttttatatatttgttttcttttgtctctgagggtattttcttttgcttcttgtaatatgtctgtcttctgagtttctttctccackwagtgttttagtttctgtcttttatgttaaagacttttctcaagtgtctggttaaccatggcttccttctcctatttgagagaggcattaaaatggtatgggaaaccctgtgaggacagagactagtttattgcaaggcccttcagttatcagtatctataggtcttttctccagttttccctgagaaattgttcaaacctttgcctttggaaatgggt

SEQ ID NO: 19389 - DNA, 178 bp, Homo sapiens
  misc_feature 165: n=a, g, c or t
tgccagtctgtgtcttttaattggggcatttggcccatttacatttaaggttagtattgttatatgagaatttgatcctgtcatcatgatgctatctggttattttgcacactagttgatggagtttttcatgatgtaattggtctttatattttggtgtgtttntgcagtggctgtt

SEQ ID NO: 19390 - DNA, 233 bp, Homo sapiens
  misc_feature 137: r=a or g
  misc_feature 141: d=a or g or t
gatcatgatgtattacctatcttgatcatggtgtattacctatttgatatgttgttagatttgattagcaagtattattttgaggatttttttgcatctgtgtttatcagagatattggtctgtagttttcttttartgtdatgtccttgccaggttttgttatcagggtgatgttggtttcatagaattagttatgatggagtccctcctccttggatattttgaatagttt

SEQ ID NO: 19391 - DNA, 216 bp, Homo sapiens
tggtttaattggaaaactgaccagcaatgatccgcctctttttatcaatctttttctgtcacaatgctaataatacctctcattcaaaggcaacaagcagaatgcttgttgatgaactgaactcaaacacgaagagctaggagtagctaactcattttgatttagggtcgtggcagaaaattatttgattttgctgtctctgcaaagccgccgtac

SEQ ID NO: 19392 - DNA, 148 bp, Homo sapiens
ctgagtagatgggactacaggtgtgcatcaccatgcctagctaattatttatttatttttaattttttatagagacggggtcttgctatgttgcccaggtggatctagagctcttggccttaagcgatcctcctaccttggcctcgac

SEQ ID NO: 19393 - DNA, 271 bp, Homo sapiens
ccaaatactgcatgttctcacttataagtgaaagctaaacattgagtgcacatgaacataaagaagggaacaacagacactgggaatgggaccgttagttgggggagggaggaagggggtcatagactggagaaccacctatggttactatgcttactaccggggtaatgggatcgtcgagaccccaagcctcaccatcatgctatttatccatgtaacaaacctgcatggatatcctttaatctacaataaaaatggaaaaaatttttaa

SEQ ID NO: 19394 - DNA, 103 bp, Homo sapiens
  misc_feature 24: s=g or c
atggcgtgaacccggaaggcggasttgcagtgagcggagatcgcgccacagcactcccacctgggcgacagaacgagactccgtctcaaaaaaaaaaaaaaaa

SEQ ID NO: 19395 - DNA, 120 bp, Homo sapiens
  misc_feature 10: k=g or t
  misc_feature 15: k=g or t
  misc_feature 45: w=a or t
taaatatttkaatckaattttaatattattgtgggttgttggttwattacttgggtgtcacaaaagtagaagattttactggcattttccatgtcagtagagtaatttttgcaggggccc

SEQ ID NO: 19396 - DNA, 237 bp, Homo sapiens
gcattctcaggacaagagttaaacatttatgtacagatggagcaaaaggccaggtgcggtggttcacgcctggaatcccagcactttgggaggccgaggcaggcggatcacgaggtcaggagatcgagaccatcctggctaacacagtgaaaccccgtctcaactaaagataccaaagtgctgggattgcaggcgtgagcaaccgcacctagcgatgcttaaatcttctagcccaca

SEQ ID NO: 19397 - DNA, 108 bp, Homo sapiens
atgtgcagtgtggtggaggttgatttgaaaaagttttaggaaaaagaatctttaggttgtggtgacctgtttgtacatgagaattagggaaggaagaaagtgcagaat

SEQ ID NO: 19398 - DNA, 343 bp, Homo sapiens
  misc_feature 342: h=a or c or t
  misc_feature 343: h=a or c or t
aggagaatcttgccccctgccttgtggtgccagtccgcctgcctatgggggtccaggcagacaaaaaattgccctgaattagaagtacaccaaagcttacttcccagttcagataattgaaagcatataacaaaaatgggagagctttttaagagaaatggcagtcatctgaagcattttatgtaagagggatttgtctatctactctaaagaggcaattccatgtttatcacgggaagaacataactgaacctcacccccaaatactatttcaaatattcctaaattttctatttagaagggaaaactggtaaataaaaaataaatatataaattacaathh

SEQ ID NO: 19399 - DNA, 88 bp, Homo sapiens
  misc_feature 15: s=g or c
gattacaggcgtgasatcacgcctggccctgacttttccatgcatactgtagtcgacattcccagagtccccatccttccctccaaca

SEQ ID NO: 19400 - DNA, 142 bp, Homo sapiens
  misc_feature 70: r=a or g
  misc_feature 71: k=g or t
ttgtagacagtgtggactggggcctcgagactgggcagagaggtgtcagctctttcctctgagcagaggrkggctataaaagtgacagaggaggccgggcatggtggctgacacctgcaatcccagcactttgggaggccaa

SEQ ID NO: 19401 - DNA, 97 bp, Homo sapiens
  misc_feature 2: n=a, g, c or t
  misc_feature 3: s=g or c
ansggtgggagctaggcgcgaggctcggagtgcggccagcgggcggaggcggtctcgcatcggcggcgacggagggctcaggcgtcgtcgtttgggt

SEQ ID NO: 19402 - DNA, 183 bp, Homo sapiens
  misc_feature 133: b=c or g or t
gcactttgggaggccaaggtgggtggatcacgaggtcatgagatggagaccagcctgaccaacctggtgaaaccctgtctctactaaaaatacaaaaaattagctgggcatggtggcgggcgcctgtagtccbagctactcgggaggctgaagcaggaggatggcttgagccctggagggtga

SEQ ID NO: 19403 - DNA, 52 bp, Homo sapiens
ggccaacatggcaaaaccccatctctattaaaaatacaaaaaaaaaaaaaaa

SEQ ID NO: 19404 - DNA, 143 bp, Homo sapiens
cttagaaaaccatcaacactttggtcaaaaggagttacccctcccttacaaacacacacccacacattcatcctagacgaaaaagttaaatgtttctcagccagggcagaatttatggatgtttacccacaacaggtcagcct

SEQ ID NO: 19405 - DNA, 81 bp, Homo sapiens
aactctaatactggtctacaaagaaatatcttccctaaatatcttgcctaaaaacccaaacctttgatttttttttttttt

SEQ ID NO: 19406 - DNA, 139 bp, Homo sapiens
tttagcattcaagccgtgattagtgctttctcttctccccagcctgcctttcagaacagatgcctctccctcccaatcagtcccctctactgctgcacctggtgtttcatcaaaggaccctgatttccctcccgccgcc

SEQ ID NO: 19407 - DNA, 376 bp, Homo sapiens
atcgccattctgaatggtgtgagatggtatctcatgccagttagaatggcaatcattaaaaagtcaggaaacaacaggtgctggagaggatgtggagaaataggaacacgtttacactgttggtgggactgtaaactagttcaaccattgtggaagacagtgtggtgattcctcagggatctagaactagaaataccatttgacccagccatcccattactgggtatatacccaaaggattataaatcatgttgctataaagacacatgcacacatatgtttattgcggcactattcacaatagcaaagacttggaaccaacccaaatgtccatcaatgatagactggattaagaaaatgtggcacatatacacca

SEQ ID NO: 19408 - DNA, 134 bp, Homo sapiens
ttttagggtacatgtgcacaatgtgcaggttagttacatatgtatacttgtgccatgctggtgtgctgcacccattaactcgtcatttaacattaggtatatctcctaatgctatccctcccccctccccccac

SEQ ID NO: 19409 - DNA, 233 bp, Homo sapiens
gatcatgatgtattacctatcttgatcatggtgtattacctatttgatatgttgttagatttgattagcaagtattattttgaggatttttttgcatctgtgtttatcagagatattggtctgtagttttctttttatgttatgtccttgccaggttttgttatcagggtgatgttggtttcatagaattagttatgatggagtccctcctccttggatattttgaatagttt

SEQ ID NO: 19410 - DNA, 322 bp, Homo sapiens
gcattgaatctgtagatcactttgtgcagcgtggacatttttacattttaagtattccaatccatgaactctgaatgtctttctatttatttttgtcttcaatttatttcagcaatgttttatagttttcagtatacaagtcttctgcctcctaagttttatttattcctaagtattttactctttttgatactattgtaagtggaattgttttcttggtttccttttagatcactcagtgttattgtatagcttatttacctgcaagttttaaagaaattgtcttaagtaggttagttcaacttcccacctcctaccccca

SEQ ID NO: 19411 - DNA, 118 bp, Homo sapiens
gttttgctcttgttgcccaggctggggtgctgtggcgctatctcagctaactgcaacctctgcctcccgggttcaagcgattctcctgtctcagcaccctctccccgcggtccccccc

SEQ ID NO: 19412 - DNA, 122 bp, Homo sapiens
  misc_feature 29: s=g or c
gtatttccgccggcgcgaaacgagcgtasttccttgtcgtgtggcctcagtccttcgccgtccctcgccgtccttcgccatcgcacgccaccgcaccccatctctcgaaatctgcagacatc

SEQ ID NO: 19413 - DNA, 185 bp, Homo sapiens
  misc_feature 143: k=g or t
ccctaatttttgtgtttttaatagagacggggtttcaccatgtttaccagcctggtcttgaactcctgacctcaggtgacctgccagcctcagcctcccaaggtgctgggattacaggtgagagccaccgcctctgtcttgckctgtcacccaggctgaggcaggagaatggcgtgaacccggga

SEQ ID NO: 19414 - DNA, 131 bp, Homo sapiens
  misc_feature 87: r=a or g
cattaactcgtcatttagcattaggtatatctcctaatgctatccatcccccctcccccccaccccacaacagtcccctgtgtgtgrtgttccctttcttttttctttttttttctttttttttttttttt

SEQ ID NO: 19415 - DNA, 237 bp, Homo sapiens
  misc_feature 141: r=a or g
  misc_feature 189: n=a, g, c or t
  misc_feature 190: n=a, g, c or t
atgaaaaattaggatatattttaccaccatttttaaaacattttttaaaattgaacatgtagggagtttcattgttcactttttactttgtattctctaatcctgaagacagttaattctgtagattttttcccctgcacrcagttttcactgtgtccataggctttggtacaaaatattccttttatnnctttgtttgatctaactaaacttagtgaaaatatacatgcatttcta

SEQ ID NO: 19416 - DNA, 96 bp, Homo sapiens
  misc_feature 86: n=a, g, c or t
tgtatacatgtgccatgttggtttgctgcacccatcaactcgtcatttacattaggtatttctcctaatgctatccctcccccctnccccacccca

SEQ ID NO: 19417 - DNA, 396 bp, Homo sapiens
  misc_feature 15: w=a or t
  misc_feature 16: k=g or t
  misc_feature 258: v=a or c or g
  misc_feature 259: k=g or t
  misc_feature 288: k=g or t
  misc_feature 311: s=g or c
  misc_feature 375: w=a or t
  misc_feature 376: n=a, g, c or t
cccacttgtaagtgwkaacatgcggtatttggttttctgttcctgtgttagtttgctaaggataatagcctcaagctcaatccatgtctctgcaaaggacatgatctcattccttttaatgactgcatagtattccacagtggatatgtaccatattttctttatccagtctataaatgatgttttgcccattttaataggattatttgtttcttgttagtgagtagtctgagtttcttatatattttcaatatgagvktcttatctgatgtatgactcgcaaatatktctcccaatccgtgcactgtttsttcactctgctgaattgtttcctttgtttgcacagaagttttgtaacttgatataattagaaawntctctatttttattcttact

SEQ ID NO: 19418 - DNA, 122 bp, Homo sapiens
gagaagggaaatcggaaagagaaaagggaggaaacggcagagccagagagaaagaggaagagactgagtgtgaaggagagaggacacaggggatgactgagagacagagagagagagagaga

SEQ ID NO: 19419 - DNA, 109 bp, Homo sapiens
ccattctacagacaaggaagctgaggctcaggaaaattcgcaaagtgacttgcctaaggccacaaatgctccaaaattccaccttttcttttctttttttttttttttt

SEQ ID NO: 19420 - DNA, 387 bp, Homo sapiens
  misc_feature 113: w=a or t
  misc_feature 120: n=a, g, c or t
  misc_feature 121: n=a, g, c or t
  misc_feature 344: w=a or t
  misc_feature 345: n=a, g, c or t
tcttttcttgattttcttattaatttcctactttgatttttttctgattttcagttttctctttcctttcctttatttttcacttcttgcttccgttattttcttcccatttwcttttcnnccttacttactttcctattctccttaccttctattgatcccattttaacctcctttctttttccttccttaaaaaatatcttgtattctaaagtgtctttcttcccctttattccttcacttttcttgcacctcttttttgttcctttttatacttttgttctccttctcccttttctcattttcctttctcaccacctttttctcacttccctcttccactwnccttgtcttgcttcccttttctcaagttcctttctcacaccc

SEQ ID NO: 19421 - DNA, 94 bp, Homo sapiens
acgccattctcctgcctcagcctcccaagtagctgagactacaggcgcccgccaccacacccggctaatttttttttttttttttttttttttt

SEQ ID NO: 19422 - DNA, 292 bp, Homo sapiens
  misc_feature 111: n=a, g, c or t
  misc_feature 126: d=a or g or t
  misc_feature 127: s=g or c
  misc_feature 174: s=g or c
  misc_feature 175: d=a or g or t
  misc_feature 220: s=g or c
tgtggcttgccaattatttgttaaaaagggtgttctttccccattttatgtttttgtatgccttgtcaaagatcagttggttgtaatatttagctttatttctggattctncattctgttacattdscctatgtgcctatttttataccagtacccaacttcaaaccatactasdaggctatagttaccaaaacaacatggtactggtataaaaataggsacataggccaatgtaacagaatggagaatccagaaataaagctaaatattacaaccaactgatctttgacaa

SEQ ID NO: 19423 - DNA, 149 bp, Homo sapiens
gtatttttagtagaaatggggtttctccatgttgcccaggctggtctcgaatgcctgtcctcaagtgatatgtacccctcagcctcccaaagtgctgggattacaggcatgagccaccatgcctggcctaatttttttttttttttttt

SEQ ID NO: 19424 - DNA, 99 bp, Homo sapiens
gtcggcctggagagccaaggcaggtggcctcgccctgggaggaccagggacaggaggagtccacctggggctcccctgacagccacctgcccactttgt

SEQ ID NO: 19425 - DNA, 289 bp, Homo sapiens
tttcttttgggggtgggggacagtcttgctctgtcaccaggctggagtacagtgacgtgatctcgcctcactgcaacctccgcctctcgggttaaagcgattctcctgcctcagcctcccaagcagctgagactacaggcgtgtgccaccatgcccagctagtttttgtatttttagtagagatggggtttcaccatgctgaccaggatggttttgatctcttgaccttgggatccgcccacctcagcctcccaaagtgctgggattacaggcgtgagtcattgcaccc

SEQ ID NO: 19426 - DNA, 168 bp, Homo sapiens
caacctctgccttctagcgattctcctgcctcagcctcttgagtacctgggattacaggcacgcgttaccacacttggttaattttttgtatttttagtagagatgggatttcactatgttggccaggctggtttggaacttctgacctcaagtgatccaccctccct

SEQ ID NO: 19427 - DNA, 121 bp, Homo sapiens; identical to SEQ ID NO: 18221

SEQ ID NO: 19428 - DNA, 211 bp, Homo sapiens
ttcgctcttgttgcccaggctggagtacagtggcatgatcttggctcatggaaacctccgcctcccgggttcaagtgattctcctgcctcagcctcccgagtagctgggatcacaggcgatgagccaccaagcctggctaattttgtattttagtagagacggagtttcaccatgttggtcatggtgacctcaggtgatctgtcccacctc

SEQ ID NO: 19429 - DNA, 175 bp, Homo sapiens
  misc_feature 159: s=g or c
  misc_feature 164: r=a or g
aattgtgggaccatagcaaagttaaattagaactcacattgaagacattatagttcaaatacccatttactgaaatttgcccaaagtcctgctattattaagtggctatgactagggcctgcaatcccagcactttggggaggccaaggcaggcagatsgtgargtcaggagttc

SEQ ID NO: 19430 - DNA, 316 bp, Homo sapiens
  misc_feature 228: d=a or g or t
  misc_feature 229: b=c or g or t
  misc_feature 253: w=a or t
  misc_feature 284: n=a, g, c or t
  misc_feature 285: n=a, g, c or t
  misc_feature 286: d=a or g or t
ttgtgaactcttctattattattaagtgttgtcaattgtcagcatccatattctattccgatgatgaatagaagcattatatttcagcatcaaaatgcagttggggtcgtaatgagcatcattagggaccttaatgggagtcagaactgtatgtcattttattcaggtttttctaagtttatttgtgtttttttggttagttggtttttcttttttcttttttttacdbttttctaccaagcaggtgagagtwgaacagcattgtgattttaaaagtacaccanndgtagagtcttccagtaccgttggccatgcc

SEQ ID NO: 19431 - DNA, 57 bp, Homo sapiens
  misc_feature 2: w=a or t
  misc_feature 11: r=a or g
  misc_feature 24: w=a or t
  misc_feature 25: w=a or t
  misc_feature 45: m=a or c
  misc_feature 46: w=a or t
cwtcagttaargctattttcactwwttttgtggatcttcagttgmwtcaggccatct

SEQ ID NO: 19432 - DNA, 110 bp, Homo sapiens
caaggcttataattttccttttttgcttttatctagttaattctttgattagcatcgagagggaactaatgggatacatacaagtacccctcactccctcgctcccccca

SEQ ID NO: 19433 - DNA, 343 bp, Homo sapiens
  misc_feature 142: n=a, g, c or t
  misc_feature 255: n=a, g, c or t
  misc_feature 256: n=a, g, c or t
  misc_feature 321: n=a, g, c or t
  misc_feature 331: k=g or t
  misc_feature 334: w=a or t
tatgtgattattctagtcccttgacctccaaattttcattcctatgcgaagacctggcatcgagatttgtggttggagaggcaggaggcaggcgtgtgtccccacagtagccagctgtgaaggatttggcccttttgcctcngagtatccagggaatggccagggctcctggggaactcagcgactggactttcgggcccagaacccaggagggcaggcgtagggacgggatggcatcagggaggtggcagtcgnnaggacccgagtgggcagaggaatgtgaatagccccaccccacgcacaagctcagcagctctgcgnggccactggkttwgcggcagat

SEQ ID NO: 19434 - DNA, 323 bp, Homo sapiens
  misc_feature 244: s=g or c
  misc_feature 245: n=a, g, c or t
  misc_feature 288: r=a or g
ccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgasntggaggagtagcttccccgaggacccccaggcttggcctgtgrttgcgcaaacccacatttcctaagcacactggacc

SEQ ID NO: 19435 - DNA, 106 bp, Homo sapiens; identical to SEQ ID NO: 17939

SEQ ID NO: 19436 - DNA, 110 bp, Homo sapiens
  misc_feature 83: s=g or c
  misc_feature 84: s=g or c
acttcgtcccgacccggaggaggacgcgagccccttgcgggcggtcatcacagcccagcctcggggctgccacagcgcgttgssctgtgcgccctcggtccccgcgtacc

SEQ ID NO: 19437 - DNA, 121 bp, Homo sapiens
  misc_feature 105: w=a or t
  misc_feature 120: y=c or t
cctatggtaaatctacttcagtgagttatagaataaaaattagactatgaaaaaacttaaactatgatctttatttttaaatagcattaaaacagcctgaattgwacaaaagccccccaya

SEQ ID NO: 19438 - DNA, 215 bp, Homo sapiens
  misc_feature 131: k=g or t
  misc_feature 150: k=g or t
  misc_feature 154: k=g or t
aagttagctttttattgcattccaccccctgccagggagcaaacttaaactcatgcaactcaaaatgaccatgctgggtctgttctaagtttgaatttggaccttgatccagccttcacatactttctctkatgaattcctcttaatgckagtkaataaaaatataatggctttcatgtcccttctcataataacattgccagctttgggggata

SEQ ID NO: 19439 - DNA, 175 bp, Homo sapiens
  misc_feature 133: s=g or c
caacacctggcaaattttttgtatttttagtagagaaggggtttcactgtgttagccaggatggtctcaatctcctgacctcgtgatctgtcccccttggcctcccaaagtgctgagattacaggcgtgagcsaccgcacctcgcaaagaaatacccttttttgttttttttttt

SEQ ID NO: 19440 - DNA, 280 bp, Homo sapiens
  misc_feature 15: k=g or t
  misc_feature 150: k=g or t
  misc_feature 269: y=c or t
ctgatatctgattckgagctataattccccaaagatgaaagtttccaggaatgagtatctggtgtagtttgtcccaaaggaatttatccaagttgatatttatgaggtgttcctatattttactataactgcttcctattactctcactkaaatttccaatataatcacattaaacagtaagaaccaactgacctaatccttagacagcttagacatctagcagtagaactaactactcgaagaggttgcaaatctaaacataacctcyccctccccact

SEQ ID NO: 19441 - DNA, 117 bp, Homo sapiens
attaacaagtgcatagttatttaattaggattttcagcagttaattaaaatatgttcttgatatttatctgttttccttttcttttctgaaaatgtaagtttagatctcccctattc

SEQ ID NO: 19442 - DNA, 200 bp, Homo sapiens
aatgctggcctcttagaatgagtttcaacgtgttcccttttcttcaatttttttggaagagtttgagaaggattgttattaattctttagatgtttgttgaaattgaccagtaaaaccatttggtcctgggattttctttgttgggagatttttcattactggtttaatctctacttattttttctgttttttttttttt

SEQ ID NO: 19443 - DNA, 112 bp, Homo sapiens
  misc_feature 77: k=g or t
  misc_feature 85: w=a or t
ttgaaggacatctgggctgtttctgttgtttggctattatgtataaagcttctgtaaatatgatgtgcacagatttktatatgawtgaaagtttacatttctgtgggatgaa

SEQ ID NO: 19444 - DNA, 348 bp, Homo sapiens
  misc_feature 306: m=a or c
aacagcctgggcacagaggagacatagacttctgggaaaagcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgaggcttcgctcaagaccctgcaccggatggcagagaaggttggggcaagacataaccgttcttcgagagcgagaagtggattatgmtagcgacatgccccggaagatcaccgaggtgctagtacgaaa

SEQ ID NO: 19445 - DNA, 136 bp, Homo sapiens
  misc_feature 87: s=g or c
  misc_feature 128: b=c or g or t
agtgactgggcgggcccggaggtgatcccaggctgcggaggctggggacccggtcgcggcggggcgggtccggagagaactcgagastgcagagatgagggccgggtccagcgaaaaatccgacggtbcagagggc

SEQ ID NO: 19446 - DNA, 291 bp, Homo sapiens
  misc_feature 100: r=a or g
  misc_feature 130: k=g or t
  misc_feature 131: w=a or t
  misc_feature 132: k=g or t
  misc_feature 161: k=g or t
  misc_feature 174: k=g or t
  misc_feature 230: k=g or t
  misc_feature 253: n=a, g, c or t
  misc_feature 254: n=a, g, c or t
  misc_feature 264: r=a or g
tttcttttgggggtgggggacagtcttgctctgtcaccaggctggagtacagtgacgtgatctcgcctcactgcaacctccgcctctcgggttaaagcgrttctcctgcctcagcctcccatagcagctkwkactacaggcgtgtgccaccatgcccagckagtttttgtattkttagtagagatggggtttcaccatgctgaccaggatggttttgatctcttgacctkgggatccgcccacctcagcctcnnaaagtgctgrgattacaggcgtgaagtcattgcaccc

SEQ ID NO: 19447 - DNA, 186 bp, Homo sapiens
  misc_feature 8: k=g or t
  misc_feature 16: k=g or t
  misc_feature 17: s=g or c
  misc_feature 24: k=g or t
  misc_feature 85: w=a or t
  misc_feature 93: k=g or t
  misc_feature 112: k=g or t
  misc_feature 121: w=a or t
  misc_feature 122: y=c or t
  misc_feature 139: k=g or t
  misc_feature 181: w=a or t
  misc_feature 182: k=g or t
  misc_feature 186: k=g or t
aaggggckttgcggcksaggattkagatactgtggtcagggagggcctccctgaggagatgacactttgaaaagcagtcgtattwgtgaagckgtggggggagctgccttckctgagggcwyaggccccgagtgcacckggcacactgaagaagagtggaggccagtgtggctggatcagwkcaak

SEQ ID NO: 19448 - DNA, 216 bp, Homo sapiens
  misc_feature 149: h=a or c or t
  misc_feature 150: n=a, g, c or t
aaaagctgggcaggtctagaaaagaacctacacagatttttatttattttatttattttttattcttttattttgagatggagtctcgctctgttgcccaggctggagtgcagtggtatggtcttggctcattgcaacctctgtcttchngattccaccaattctcctgcctcagcctcccgagtagctgggattacaggcgcctgccaccacacc

SEQ ID NO: 19449 - DNA, 76 bp, Homo sapiens
  misc_feature 28: k=g or t
  misc_feature 48: k=g or t
  misc_feature 51: k=g or t
  misc_feature 52: d=a or g or t
  misc_feature 54: k=g or t
  misc_feature 76: k=g or t
cagccttccatggacacctgttttagckgattcattctcataccttakctkdckgtattttgagtttgagacagtk

SEQ ID NO: 19450 - DNA, 207 bp, Homo sapiens
  misc_feature 54: k=g or t
  misc_feature 60: k=g or t
  misc_feature 69: k=g or t
  misc_feature 103: k=g or t
  misc_feature 105: k=g or t
  misc_feature 119: k=g or t
  misc_feature 134: k=g or t
  misc_feature 139: k=g or t
  misc_feature 151: k=g or t
  misc_feature 152: k=g or t
  misc_feature 160: k=g or t
  misc_feature 184: k=g or t
  misc_feature 186: k=g or t
  misc_feature 187: k=g or t
  misc_feature 197: k=g or t
  misc_feature 198: k=g or t
aaaaggtggaagttgttgggaaactcagaggtgtgtaacttccagcaaataatkacactkgattctatktagatttaggcccagttagccactggggatccakcktgaagtgatgctckgacaaagctactaakgcctkaatccactcatkktcaaacakacatgtcagcaaaatgaatcattkakkacatcaattkkatgtagaaa

SEQ ID NO: 19451 - DNA, 166 bp, Homo sapiens
  misc_feature 15: d=a or g or t
  misc_feature 42: k=g or t
  misc_feature 45: k=g or t
  misc_feature 52: k=g or t
  misc_feature 101: k=g or t
  misc_feature 119: m=a or c
  misc_feature 120: m=a or c
  misc_feature 124: k=g or t
  misc_feature 127: y=c or t
cagatgttatcttcdagaatttttatgagtcttagatatgaktckttaatckagcttgacttgatttttgtataacgtgagagtggaggatccagctcatkcttctacatgtggcttgmmaatkatyccaccacccattttttgaatagggtgtcctttccccact

SEQ ID NO: 19452 - DNA, 131 bp, Homo sapiens
  misc_feature 21: s=g or c
caatgagaacatctgcgacasgagaatcctgaccacaatgaggtccccaacaacgagaccactgataacaacgagagtgctgatgaccacgaaaccactgacaacaatgagagtgcagatgacaacaacgc

SEQ ID NO: 19453 - DNA, 313 bp, Homo sapiens
  misc_feature 232: y=c or t
  misc_feature 233: m=a or c
atcctcctgagtagctgggattataggcatctgccaccacacctgaataatttttgtatttttagtagaggttagtttttcattcagtctccagggtcataccatttccaacagacattgtcttctgaacaagactagcctgcctggctaattaaaaaatgcatttgccagccgggcttatgcctataatcccagcactctgggaggccaaggcaggtggatcagttgaggymggggtctgaaaccaggagattcatctgccttggcctcccagagtgctgggattacaggcgtgagtcaccatgcccagcct

SEQ ID NO: 19454 - DNA, 56 bp, Homo sapiens
gtcatatgtctctctctctgtgtataagaaacagagtttgaaagtttctcaaaact

SEQ ID NO: 19455 - DNA, 138 bp, Homo sapiens
tgtaaagcttccttgagtcagcatgacattttgagattgatccatttgtgtttatcagtaattgtatttttgtttttgttgctgagtagaatataccacaatttgtatatctgttcgcttgttgatggatagccaggc

SEQ ID NO: 19456 - DNA, 75 bp, Homo sapiens
ccaagtagctgggattataggcgtgcaccaccatgcccagttaatgtttgtatttttagtagagatgacccgcac

SEQ ID NO: 19457 - DNA, 257 bp, Homo sapiens
  misc_feature 97: n=a, g, c or t
  misc_feature 121: w=a or t
  misc_feature 125: w=a or t
  misc_feature 130: k=g or t
  misc_feature 142: w=a or t
  misc_feature 229: s=g or c
atttattgttcccgtggggcagtcgaggatgtccgtgaattacgcggcggggctgtcgccgtacgcggacaagggcaagtgcggcctcccggagggntccccacggagtctggaccatggwgggwgcgakgtctggcccccwagttcgacaccacctttgagagcgcgcggcccacgcagacccacatggcgctggtgcagctggagcgcgtgggcctcctccgcttcstggtcagccagaacgtggacgggctcca

SEQ ID NO: 19458 - DNA, 199 bp, Homo sapiens
ccccacctctgccggctcgtactcggctcccccacctcgccgcagagctagcccgggaagcccacactggcggccacggagcagagtccctcacccccaccagctgtagctgaacgtctggatggtggagaagagcagatgatctgtactggacacacgtggagatatggccatgccacgcatgtgcaaacagcggtgt

SEQ ID NO: 19459 - DNA, 242 bp, Homo sapiens
  misc_feature 62: w=a or t
  misc_feature 146: w=a or t
  misc_feature 169: k=g or t
  misc_feature 214: w=a or t
  misc_feature 222: k=g or t
  misc_feature 223: w=a or t
  misc_feature 225: w=a or t
  misc_feature 237: y=c or t
  misc_feature 238: s=g or c
agtgatgtgatcaaaggtcactgcagccttgaactcctaggctcaagggatccttctgtctwagcctccttaatagctgtgactacaaacatacaccaccacacctcactaattaaaatttttgtgtgtgtgtggagatggggtcwtgctgtgttgcccaggctggtckagaactctcgggctcaagcaattccaatgcctcagggtcccaagwgttgggakwcwaggcgtgagcaysaaca

SEQ ID NO: 19460 - DNA, 175 bp, Homo sapiens
cctgagtagctgggattacaggcatgtgccaccacatccagctaattttgtatttttagtagagagagggtttttccatgttggtaaggctggtctcgaactcccgacctcaggtgattcacccgcctcggcctcccaaagtgctgggaatacaggcatgagccactgcgcccaa

SEQ ID NO: 19461 - DNA, 169 bp, Homo sapiens
gccctttctttgacttttaaaaaatttttagttcagccactatttataatttctcagagcattttcttgttttctcattgttctttcaaactaatattccgtttttctattatggataaaatactttggatctctgttatgctatttatcagatttttttttttttttt

SEQ ID NO: 19462 - DNA, 418 bp, Homo sapiens
  misc_feature 147: k=g or t
  misc_feature 266: w=a or t
  misc_feature 307: n=a, g, c or t
  misc_feature 308: n=a, g, c or t
  misc_feature 401: r=a or g
cttaatttttatttcaattaaaataaaaaaatttagatgttattgactcccaaatttatatctttaccctgaacctctgttcagctttccaggttgatatgtccagttgaattttccacttggatttttttttttcttttttctttkttttcttttgaggtggagtctcgctctgtcgcccagttggagtgcagtggcgtgatctcggctcactgcaacctctgccccctgggttcaagcaattctccttcctcagcctctctcgwagctgggattacaggcatgtgctaccacgcccggctaattnntgtgtttttagtagagacagggttttgctatgttggccaggctggtctcgaacccctgacctcaggtggagtctcgctctgtcgcccagttgragtgcagtggcgtgatc

SEQ ID NO: 19463 - DNA, 73 bp, Homo sapiens
agtgctgggattacaggtgtgagccaccatgcccggctgtcaaaataggtgttttgttgtttttttttttttt

SEQ ID NO: 19464 - DNA, 412 bp, Homo sapiens
cactttgcagctgcagcgctttagccaaattatgggtccttgtggtgtgttggtctcttctatctgtaatgtcacttgaacaaatagtcaagccctcccagggttgtttgggagactcagtgaagtcatgagtgttaaaaatgcccaatactagtaaagggtttttatgaatcaacttttgtttttttcctttatttaaagtaaaagaggaatgtgtttgctttggtggtcaatctcattaataccattaatcgttttaaaatattacctaaatgttgaaatgataatactttggatatagtagattaaaaatatatatattgttaaaatcaatttcccctgtttcttttgactttatatataacagggctactggaaaatgtaacattttgtgtgtggctcatgttatatt

SEQ ID NO: 19465 - DNA, 256 bp, Homo sapiens
taacagtggataatagcagccctgggtttcctctttagattaactcttgagctgcatagtagcatctttctttcatgtacaacagttggcagaatttttttttattattatactctaagttttagggtacatgtgcacaacgtgcaggtttgttacatatgtatacatgtgccatgttggtgtgctgcacccgttaactcgtcatttacattaggtatatctcctaatgctatccctcccccctccccccaccact

SEQ ID NO: 19466 - DNA, 151 bp, Homo sapiens
  misc_feature 15: m=a or c
  misc_feature 16: r=a or g
agaatggaattgaamraactggaatggaatggaatggaatggaatggaatggaatggaatggaatggaatcgttccgagtggaataggagggaatgtattcgagtggaatggaaaggaatggaatcaaccagagtggaatggaagggaaat

SEQ ID NO: 19467 - DNA, 163 bp, Homo sapiens
tctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcat

SEQ ID NO: 19468 - DNA, 128 bp, Homo sapiens
  misc_feature 39: w=a or t
gaaaaaaacagtagggtgacattatatattccattctgwaatctgccttttcatccaataacacatatgtgtgtgtgtgtatatatatatgtgtgtgtgtgtgtgtgtgtatatatatgtgtgtgtgt

SEQ ID NO: 19469 - DNA, 196 bp, Homo sapiens; identical to SEQ ID NO: 18377

SEQ ID NO: 19470 - DNA, 82 bp, Homo sapiens
gacagagtctccctatgttgcttaggctggtttcaaactccagagctcaggcgatctgcccgccttggcctcccaaagtgct

SEQ ID NO: 19471 - DNA, 146 bp, Homo sapiens
  misc_feature 35: y=c or t
  misc_feature 48: y=c or t
  misc_feature 55: k=g or t
  misc_feature 58: y=c or t
  misc_feature 66: y=c or t
  misc_feature 69: k=g or t
  misc_feature 74: y=c or t
  misc_feature 82: y=c or t
  misc_feature 85: y=c or t
  misc_feature 88: k=g or t
  misc_feature 105: w=a or t
  misc_feature 126: s=g or c
ttgttttttgtttttttttttaaaaaagacagggycttgccacgttgyccaggckggycttgaacycckgggcycaagtgayccycckgccttggccttcccagwagctgggattacaagcgtcascacggcaccaggctcttaac

SEQ ID NO: 19472 - DNA, 209 bp, Homo sapiens
  misc_feature 26: w=a or t
  misc_feature 109: w=a or t
  misc_feature 121: r=a or g
tactaccatccaagttttagagctgwgcctttcattacagaagccactagtgggcaggcacgatggctcatgcctgtaatcctagcactttgggaggccgaggctgggwggaatcacttgraggccaggagtttggataccagcctggccaacatgacgaaacccagtctctactaaaaatacaaaaattagccgggtgtggtggcacc

SEQ ID NO: 19473 - DNA, 61 bp, Homo sapiens
tagtcactggctatcataatatacattttcttttttcttttcttttctttttttttttttt

SEQ ID NO: 19474 - DNA, 127 bp, Homo sapiens
  misc_feature 112: s=g or c
tatttttagtagagatggagtttcactatgttggccaggctggtcttgaactcctgacctcaggtaatcctcccacctcggcctcccaaaatgctgggattactggcgtgascaccttgcccggcct

SEQ ID NO: 19475 - DNA, 202 bp, Homo sapiens
  misc_feature 122: m=a or c
  misc_feature 138: r=a or g
  misc_feature 164: k=g or t
gtttgtggaatcactaagtctctaaagatgaaagtttgaaaaccattgaactaaagaagattcagtgagaaaactggatgagagaaggaggaaatttattgacaacaattaaactatagggmccaaaactcttaatargaggaaaaataaaaaactgaattctkgaaggaaagaagaaataacttcattttaatttttttta

SEQ ID NO: 19476 - DNA, 269 bp, Homo sapiens
ctgtatctgtcaaagtgtttcaatataaattgatcctcaaaaagagtttgtggttgataagaaagatggtccttccctgaaccattctttaaaaatgtcaacactccctaggaagctgttcactcgtcatttcccattttcccctgcactagtgctgatattatttcttaaatgctgacaatatttgagaagctaattttagactttccctctgctagaaactagaagtgtgaaacaatgagttggtgatccaaaccactgtctggccc

SEQ ID NO: 19477 - DNA, 107 bp, Homo sapiens
  misc_feature 42: b=c or g or t
tcttcctactcatgagcatggaatgttcttccatttgtttgbatcctcttttatttccttgagcagtggtttgtagttctccttgaagaggtccttcacatccctat

SEQ ID NO: 19478 - DNA, 252 bp, Homo sapiens
  misc_feature 144: r=a or g
  misc_feature 145: s=g or c
cacaacttggaatggatttgaggcaaattgtgccataagcacattttctttaagtggctaaacaaagtttaaaaagcaagtaacagtaaaagaaaatgtttctggtacaggaccagcagtacagaaaaaacagtgtgtgaggtrsctgggagtacctggataatacacccattctgcagtgatgcaacttttaagtacatattgttggctgtccgtagtccacacagagttacaactccatacttcaagacc

SEQ ID NO: 19479 - DNA, 157 bp, Homo sapiens
  misc_feature 9: y=c or t
  misc_feature 83: s=g or c
  misc_feature 88: y=c or t
gcaagggtyatctgggcgtggtggtgtgcacttgtggtcccagctgcttgggaggctgaggcaggagaattgcttgagcccgsgaggyggaggttgcagtgggccgagatcgcgccactgaactccagcctggtgacagagtgagactgtctcaaaa

SEQ ID NO: 19480 - DNA, 227 bp, Homo sapiens
  misc_feature 111: k=g or t
  misc_feature 118: k=g or t
  misc_feature 168: w=a or t
  misc_feature 199: k=g or t
  misc_feature 216: y=c or t
  misc_feature 221: w=a or t
  misc_feature 223: s=g or c
cctttctctagtacatgctttggacttaagccacaagtgacctttttcataaagcaaatttgttgatgtagttcacttgtaaaaaacaaaatctttaattttttttttttkggttttkgcagtcaggatagagttcaaagtcattttatggtacacaagttccctccwaaatcggcccctgtctgcaatcttatcccgkgctgggcaattctttcyctcawasgcta

SEQ ID NO: 19481 - DNA, 173 bp, Homo sapiens
  misc_feature 29: r=a or g
taaatcataaaaattgaaatggtcattgraaaagaataaagaatcccaaccagttttccacatatatgcaatttgtacaggttcataccaacacagatattgagaaaattagataattgttcattgtattatgtgttgagtttatttaaaaaattattggactcacagcagac

SEQ ID NO: 19482 - DNA, 334 bp, Homo sapiens
  misc_feature 118: r=a or g
  misc_feature 139: s=g or c
tctttacctaacttatggtcacaaagattttctcctatgattccttcttgaaatgttatagttttagattcacatttatgttgaagatttttttaatttttttttattttttttagaratggggtctcgctctgtcccscaggctagagtgttgtggctgcaagatcatgacctcctgagcccatttgatcctcccatctcagcctcccgagtagctgggactacaggcatgcatcaccatgcccagctaattttttagttttctgtagagacagggtctcactttgttgccagtgctggtctcaaccttctggactcaagtgatcctccccct

SEQ ID NO: 19483 - DNA, 224 bp, Homo sapiens
agtcctggaactatcccacactgctctggtaacagtgctgctaacattatcaaaggaagacattctctttactaatggtagtatcaatgcatttacaatattgtaataagccacttgtcaaccaatatttgaaaattagttgctcgttaagctatttgtcaatcaatatttaagaactacttgcacaattcacaggggccaggtttcaacttcttcccacacac

SEQ ID NO: 19484 - DNA, 155 bp, Homo sapiens
catcagtctgttcacattgcccatctgttcttgtatgctgtctacttcactaattagagcccttagaatattaactgtatttgttttagattccctgtctgatcatttcaacatccttgccatactcgagtgtggcaaggatgttgaaatgatca

SEQ ID NO: 19485 - DNA, 172 bp, Homo sapiens
gtagctggcactacatgtgcacaccaccatgcccagctaattgtttgtattttttagtagagacagaatttcaccgtgttagccaggatagtctcaatctcctgacttcgtgatctgcccgcctcagcctcccaaagtgctgggattacaggcttgagccaccgcacccgcc

SEQ ID NO: 19486 - DNA, 241 bp, Homo sapiens
ttatgaatctgggtgctcctgtattgggtgcatgtatatttaggatagttagctcttcttgttgcattgatccctttaccattatgtaatggccttctttgtctcttctgatctttgttgggtttaaagtctattttatcagagactaggattgcaatccctgcttttttcggctttccatttgcttggtagatcttcctccatccctttactttgagcctatgtgcatctttgaatgtga

SEQ ID NO: 19487 - DNA, 210 bp, Homo sapiens
  misc_feature 94: k=g or t
  misc_feature 95: r=a or g
  misc_feature 96: r=a or g
tccgtaatggaatggaaaggaatggaatggaatggaatggaatggaatggaatggaatggaatcaactcgattgcaatcgaatggaaacgaatkrratcatcatcgaatggaaatgaaaggagtcatcatctaatggaattgcatggaatcatcataaaatggaatcgaatggaatcaacatcaaatggaatcaaatggaatcattgaac

SEQ ID NO: 19488 - DNA, 128 bp, Homo sapiens
gtcttgtagttgtttcatagtttgaggtctcagatttaagccttcaatccacctgggtgtgatttttgtatatggtgagaaataggggtaagtttcattcatttacatgtggatatccagttttcccc

SEQ ID NO: 19489 - DNA, 219 bp, Homo sapiens; identical to SEQ ID NO: 17157

SEQ ID NO: 19490 - DNA, 140 bp, Homo sapiens
tatttttagtagaaacagggtttcactgtgttagccaggatggtgtcgatctcctgacctcgtgatccacccaccttggcctcccaaagtgctgggattacaggcgtgagcactgcacccggcctgaaactcttgaaaga

SEQ ID NO: 19491 - DNA, 111 bp, Homo sapiens
agttagctcatgctggtaccaagctctgataggagattcgtcaaaggtcaggggttcaccatgggggattctgagtggagatacccctgacctttgacgaatctcctatca

SEQ ID NO: 19492 - DNA, 193 bp, Homo sapiens
caggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccggc

SEQ ID NO: 19493 - DNA, 91 bp, Homo sapiens
  misc_feature 2: y=c or t
  misc_feature 4: y=c or t
  misc_feature 9: k=g or t
  misc_feature 19: w=a or t
  misc_feature 22: k=g or t
  misc_feature 49: h=a or c or t
  misc_feature 50: w=a or t
  misc_feature 65: w=a or t
  misc_feature 66: m=a or c
  misc_feature 77: w=a or t
  misc_feature 84: w=a or t
tytytgackgagcaacccwagkgacaggagccgaagcagcagcgcagghwgtccccgtttccccwmccccttccctwctccggwtgccttc

SEQ ID NO: 19494 - DNA, 172 bp, Homo sapiens
  misc_feature 108: d=a or g or t
  misc_feature 149: s=g or c
gtagctggcactacatgtgcacaccaccatgcccagctaattgtttgtattttttagtagagacagaatttcaccgtgttagccaggatagtctcaatctcctgactdcgtgatctgcccgcctcagcctcccaaagtgctgggattasaggcttgagccaccgcacccgcc

SEQ ID NO: 19495 - DNA, 224 bp, Homo sapiens
gtctcgaactcttgaccttagatgatccgcccaccttgacctctcaaagtgttggtattacaggcgtgagccatggcgcccggtctttcctatctttctgactgtatcttcagatcactcctgaacccgagacctgaatttttcatttacctacttggttctttggattttcacagataccttgtatccaacatgtctcaaactgatttttcccccctccctca

SEQ ID NO: 19496 - DNA, 134 bp, Homo sapiens
ttagctgtatcagcactgtcatcatgattattatcatcatcactaccatcaccttttatttagctttggcagtctctgtgtctgccttctgttccatccacttcctctctgagtgatcacttctcacccaacca

SEQ ID NO: 19497 - DNA, 90 bp, Homo sapiens
cattctgtcgtctaggctgaaatggagtggtacggtcttggctgactgcggcctctgccttccgggttcaggcggttctcccgcctccaa

SEQ ID NO: 19498 - DNA, 210 bp, Homo sapiens
  misc_feature 203: w=a or t
cttgtgttaaaggtcttcaaaatggtttgtatatctcatgttaatctcttagggtaagctttgccaataaataaatattggaatttaattggagcttgtaagacccagtaaactaggtaagaaccttcatgtagtcttcatgttttgttagctgtttctcatctctgacaattcttagtttttttcttgattttttttttttwaccttta

SEQ ID NO: 19499 - DNA, 208 bp, Homo sapiens
  misc_feature 92: k=g or t
gcctccctaagtgggaattcatctaattcaacaaccctcctccttattcttcttccccatcttcttcccctgcctgctcctgtttatctggkctttctttggggcatataaaagcacagccacctcacttagcaggcaagggctgaaaggaagcacaaagaccaagtctaactccttcatctaacaagggaggaaaccaaggcccaga

SEQ ID NO: 19500 - DNA, 367 bp, Homo sapiens
  misc_feature 196: s=g or c
  misc_feature 335: d=a or g or t
tatgattgttttgcttcatgaagttttggagtaatttgtagtacagccgaagtaactggaacactgctgggtttttttgtatcttcatatgaattttagaaccagtttgtcaattacataaaaacctacttttttgccgggcgtggtggctcgctcctgtaatcccagcactttgggaggctgaggcaggcggatsacctgaggtcgggagtttgagatcagcctgaccagcgtggagaaaccccgtctctgctaagaatacaaaaaattagccgggcgtggtggtgcatgcctgtaatcccagctacttgggaggctgaggcaggagaatcacdtgagcctgggaggaggaggttgtggtgggcct

SEQ ID NO: 19501 - DNA, 95 bp, Homo sapiens
  misc_feature 52: k=g or t
  misc_feature 53: r=a or g
ctcattgtcttcataaatgcaaaatctgttgtgtgccctcaaatttatatckrcatttttagattctgggtcacaattatcactagctctttttt

SEQ ID NO: 19502 - DNA, 163 bp, Homo sapiens
  misc_feature 45: k=g or t
  misc_feature 113: w=a or t
  misc_feature 126: n=a, g, c or t
  misc_feature 127: r=a or g
tgttttctgcttcatttttgataaacacaaccagctctggactgkgtgaaaccatggagcaccgcacagttaacagaggtggtttggagttttttagctttgcataagaggawgttctgatgcagnrtctacagtgacaggaaaccattctggacaagttacc

SEQ ID NO: 19503 - DNA, 130 bp, Homo sapiens
aaaacaacccgagtacaggggaatggaatggaatggaatacaatggaatggaatcatccgtaatggaatggaaaggaatggaatggaatggaatggaatggaatggaatggaatggaattaacccgaaat

SEQ ID NO: 19504 - DNA, 185 bp, Homo sapiens
  misc_feature 41: k=g or t
  misc_feature 173: w=a or t
ctcatcaaattttttctttttttttattttttatttttatkttttttattatactctaagttttagggtacatgtgcacattgtgcaggttagttacatatgtatacatgtgccatgctggtgcgctgcacccactaacgtgtcatctagcattaggtatatctcccaatgcwatccctccccca

SEQ ID NO: 19505 - DNA, 191 bp, Homo sapiens
tgtcacataaagataggcacttgaagtaagcaacatactgtatcatagttgtggcagtcatgttcaaacaaaggaaaccaatggcgcgatctgggctcactgcaagctccgcctcctgggttcatgccattctcctgcctcagcctcctgattagctgggactacaggtgtgtgccaccatgcccggctaa

SEQ ID NO: 19506 - DNA, 214 bp, Homo sapiens
tttgtttttagtagagccggggtttcaccgtgttagccaggatcgtctcgatctcctgagctcgtgatctgcccgcctcggcctcccgaagtgctgagattacaggtgtgagccaccatgcctggctctatttttatttttttgagacagagtcatgctctgtcacccaggctggagtgcagtggtgaaatcttggctcactgtagcccccgcc

SEQ ID NO: 19507 - DNA, 88 bp, Homo sapiens
  misc_feature 16: k=g or t
  misc_feature 45: h=a or c or t
  misc_feature 59: m=a or c
  misc_feature 60: m=a or c
  misc_feature 64: k=g or t
cacttattgaggccakatttccggatcagaccgtgctggtttgahtagacacgacaagmmcgakaaccctggccgattttttttgggt

SEQ ID NO: 19508 - DNA, 182 bp, Homo sapiens
  misc_feature 101: m=a or c
  misc_feature 182: r=a or g
tttcttttctttcttccttttttaataatagtggtggggtctccctatgttgcccaggatggtcttgatctcccaggctcatgtgatctcccaccttggcmacacaggcttggtatggtggctcacacctctaatcccagcattttgggaggccaaggtgggagatcacatgagcctggcar

SEQ ID NO: 19509 - DNA, 217 bp, Homo sapiens
  misc_feature 96: w=a or t
  misc_feature 146: k=g or t
  misc_feature 158: k=g or t
  misc_feature 159: n=a, g, c or t
gccatttgtatatatttgaaaaatatctattcaaatacattgcctgctttaaaatactgttattggtctttttatcattggattgtatgagttctwtatatattttggatattagtctcttatcagatatattatttgcaaatatkttctcccattcknagggacgtctttccactttcttttcttttcttttcttttttttttttttttttttttt

SEQ ID NO: 19510 - DNA, 272 bp, Homo sapiens
  misc_feature 97: w=a or t
  misc_feature 98: r=a or g
  misc_feature 199: b=c or g or t
aaggtaagccgggtgtggttgcgggcgcctgtggtcccagctacttgggaggctgagacaggagaatcgcttgaacccgggaggtggaggttgcggwragccgagattgcgccactgcactccaatctgggtgacaaagcaagactctgtctcccaggctggactgcagtggcgttatgttggctcactgcaacctccbcctcccgggttcaagcgattctcctgcctcagcgtcctgagtagctgggattacagacacgcaccaccatgcc

SEQ ID NO: 19511 - DNA, 272 bp, Homo sapiens
  misc_feature 17: s=g or c
  misc_feature 18: r=a or g
atgcctgtaatcccagsrctttgggaggcagaggcaggcggattgcctgaggtcaggagtttgagactagcctggccaacatggtgaaacccgtctctactgaaaatacaaaaattagctaggcgtgatggcacacacctgtagtcccacctacttgggaggctgaggcaggagaatcgcttgaaccagggaggcagaggttgcagtgagccaagatcgcaccactgcactccagcctgggcaacagagcgagactccatctcaaaaaaaaa

SEQ ID NO: 19512 - DNA, 289 bp, Homo sapiens
ttcaaagagcaaagatttgacaatgcatagaattaacattggtttgtgggccaccttctgggccagcaccaaagactgaaaaaatattttgccccgaaaaagttgttattgagtcttgtcaaatcacattgctctgtcagaaggtaagacaaatcagtgtggactgagagcaaggtcagcaccgtgaacagccattgcggttcctttaacccactgggaattcatgcagtgaagaagcaacacaccatgaggcaaatggctcaaacccaaagaccagaggttcaggaga

SEQ ID NO: 19513 - DNA, 179 bp, Homo sapiens
  misc_feature 104: k=g or t
aggattagaatccaggcattttgaccacagaatccctcctatttatattctactgccttctctatttccttctggtgatgtgtgccactctgaattaggtgtckgccttctgttactgaaccacaacctccctgaggacagggacctagtatcattcacccctaactccacaggccaat

SEQ ID NO: 19514 - DNA, 117 bp, Homo sapiens
cattattctttatcacattttattttatatttataacattttatgtttagatatgtttaatatgtattgtttaacttcagctgtgaatatcagttgtttccagtttttcaggggcat

SEQ ID NO: 19515 - DNA, 168 bp, Homo sapiens
  misc_feature 138: k=g or t
  misc_feature 166: k=g or t
ctttcctttatcactctcttctttcctttctttcttgtctcgttgtgctacccaggctggagtgtagtggtgcaattatggcccactgcagctcaccctcttgggctcaagtgaccctcccgtcttggcctcctgagkagttgggactacaggtgcacaccaccakgc

SEQ ID NO: 19516 - DNA, 99 bp, Homo sapiens
  misc_feature 65: s=g or c
  misc_feature 66: r=a or g
  misc_feature 67: w=a or t
ggatgtgagggcgatctggctgcgacatctgtcaccccattgatcgccagggttgattcggctgsrwctggctggctaggcgggtgtcccctccctccc

SEQ ID NO: 19517 - DNA, 97 bp, Homo sapiens
  misc_feature 15: m=a or c
ttcattttgcagtgmgagacaatctgggtactagagaggtgaagtgacatgtccagggacacgctggttaacgaagctggatggccagttttttttt

SEQ ID NO: 19518 - DNA, 63 bp, Homo sapiens
tactcactgtttgtcttttgattgggggaatttaatcaatttacatttaaagtaatattgtta

SEQ ID NO: 19519 - DNA, 258 bp, Homo sapiens
  misc_feature 144: y=c or t
  misc_feature 196: m=a or c
atttgctgtttatatagattccactttcggttttttatcccattctctgttttaatttatgtggtagtaatgttcaatattttttgatcgaataggttcaaggtgagacttaagacttcaaatgatgtttcaaagaactctcayagaactctcaaagagttaacagttaagtcatacttcataagtagtaaagaamgtcttaaaatttggaaaatttcattgggcatagtagtaattgggtaagaataaattatttaa

SEQ ID NO: 19520 - DNA, 105 bp, Homo sapiens
  misc_feature 81: w=a or t
  misc_feature 92: w=a or t
ataaaggtggcttgctccattgatttttgtctgctcattgggaaagtctgctaatcaccatgattaagttccttaacagawatgtcacttawtttattcatctat

SEQ ID NO: 19521 - DNA, 127 bp, Homo sapiens
  misc_feature 16: s=g or c
  misc_feature 17: y=c or t
tacattcaaggttagsyattgatatgcatgtatttgatcctgtcattgtgttgttagctgtttattatgctgacttgtttgtgtggttgctttatagtgttacttgtctgtgtacttaaatgtgttt

SEQ ID NO: 19522 - DNA, 74 bp, Homo sapiens
  misc_feature 9: w=a or t
  misc_feature 10: k=g or t
  misc_feature 15: n=a, g, c or t
  misc_feature 16: s=g or c
  misc_feature 22: k=g or t
  misc_feature 31: k=g or t
  misc_feature 39: y=c or t
  misc_feature 45: k=g or t
  misc_feature 54: k=g or t
  misc_feature 55: w=a or t
ctttcttawkttttnscttttktcttttttktaagttcytttttktttaattakwattatactttaagtacaac

SEQ ID NO: 19523 - DNA, 111 bp, Homo sapiens
cgtttcaacatgacatttggaggagacagacatccaaaccatatcactagttgataggtacataggtacttatattattcttcatttccttttctatgtctcaaatattgc

SEQ ID NO: 19524 - DNA, 84 bp, Homo sapiens
cagatattgcaagtatctgttaggaattacacttgtctccacaaaacaaaaacctgactctagtggctttagcaaataggggtt

SEQ ID NO: 19525 - DNA, 112 bp, Homo sapiens
  misc_feature 16: k=g or t
  misc_feature 51: m=a or c
  misc_feature 86: m=a or c
ctgtgtttctttaatkaatcagtggcttagcatggaaggagaagtggggtmtatttttcaccttgctccagaattttagtgctcamagccaccctggacccaatctccttga

SEQ ID NO: 19526 - DNA, 52 bp, Homo sapiens
  misc_feature 10: w=a or t
  misc_feature 11: h=a or c or t
  misc_feature 16: k=g or t
ggatttcttwhgtggkctcttttattcttatttcaattttgtttatacattt

SEQ ID NO: 19527 - DNA, 378 bp, Homo sapiens
  misc_feature 148: w=a or t
  misc_feature 160: r=a or g
tagtttaggtagatagctatctttgtgatccagaattgaggtaatggacacttctactgatgatatggattatacagatgaagaaagtagatgggagctaaaaactcactgcattttaattaggattggaactaggatggtgggagawaagaggtgacargatgattcttggagttctgcattgcataactaactggatgctggtgccatttgtagaaatattgggactaagtttgttgggaggaagactacaggtttgttatgggacatagtaagtctcagctgtctttgagacatctattgaaagaatggccaagtgggctgggtgcaagtggctcatgcctgtcatcccagcactttgggaggccgaggcagggg

SEQ ID NO: 19528 - DNA, 51 bp, Homo sapiens
aagaagcctgcgtctgggcctgggtgggacggattcaggcgcgcaggtgct

SEQ ID NO: 19529 - DNA, 105 bp, Homo sapiens
  misc_feature 90: k=g or t
gcctggcagactggccaccatgcccaccacatcctgaacccatgcacaccaaaagcgggcctgaagacaggcacacacagtcaggcatckccccctagtgcccaa

SEQ ID NO: 19530 - DNA, 101 bp, Homo sapiens
  misc_feature 9: r=a or g
  misc_feature 14: k=g or t
  misc_feature 15: k=g or t
  misc_feature 27: y=c or t
  misc_feature 80: k=g or t
ttatttcaraagakkgtatttttaggycaggcacagtggctcattgcctgtaatcttagcactttgggagggtgagacakgaggatcgcttgatcctggga

SEQ ID NO: 19531 - DNA, 89 bp, Homo sapiens
aacctgaagatacctttcatacatcataaattattattgctttcttcttttcaatattttgaaagtgttgtttgcataggcgcataggc

SEQ ID NO: 19532 - DNA, 115 bp, Homo sapiens
  misc_feature 14: k=g or t
tagttgggagagakatcatgtaacttacaaagctcaaaatatttacagcttgactttatacagaaaaattttgcagacccctgatttaaacttaagacagaatgtatacttcttc

SEQ ID NO: 19533 - DNA, 123 bp, Homo sapiens
tttgatacacaatatttgtacatatttatggatataggtgatattttgttacatgcatagaaattgtaatgatcaagtcagggtatttagggcatccatcaccttgagcacttataatttcta

SEQ ID NO: 19534 - DNA, 239 bp, Homo sapiens
caagttaaacagattttggcaagaaagtttcgtggatgatgtttcattcatcatgttgcattgcatcaagagctcataatgtcagatgtttcactattagtgatgctaagtttgaagggtgacggctaaatgtttgcattgaaaaggtacagttttccctttccaaataagtaagtgatctgtagagagaaattgacttttttaaagcaaataatggtgaacttaaaggagctgcccct

SEQ ID NO: 19535 - DNA, 281 bp, Homo sapiens
ttttctttttttggagacagtatctcactctgttacctaagctagagtgcaatcatagctcattgcagccttgattcctgaggctcctgtgattcctgcccccacctcagcctccaaagttgctggggctacaggcatgcaccaccacacctggctaacttttatgtagagatgtagtctcactgtgttacccatactgatttcaaatcctggcctcaagcaatcctccagcctcgacctcccaaactgctgggattacaggcatgagccaccacggggcc

SEQ ID NO: 19536 - DNA, 174 bp, Homo sapiens
caaaaaattagccgggtgtggtggcacatgcctataatcccagctatttgggaggctgagtcagggagaatctcttgaacccgggaggcggaggttgcagtgagccgagaccacgccattgcactccagcctgggcaacaagagcgaaactccatctcaaaaaaaaaaaaaaaa

SEQ ID NO: 19537 - DNA, 216 bp, Homo sapiens
caagctagagttggagtgcagtggcgctatctcggctcattgcaacctccgcctccccggttcaagcgattctcctgcctcagccttccgagtagctgagattacagacgtgcgccaccatgcccagctaatttttgtatttttagtagagacggggtttcaccatgttggccaggctggtctcgaactcccgacctcaggcgatccacccgccct

SEQ ID NO: 19538 - DNA, 132 bp, Homo sapiens
  misc_feature 8: n=a, g, c or t
  misc_feature 9: n=a, g, c or t
gatccccnntccgcgtccccgccgccgggaggaggtgcccactcgctcgcggcgcgcgccggccgccagactcggcctgtgggcgatttcctccggacccaggctccccgcccgaggttatttttttttttt

SEQ ID NO: 19539 - DNA, 158 bp, Homo sapiens
aaagaaaagctaagagaaccctcggcggcaagatggcagcggcgggcgagggcaccccgagctcccgcgggccgcgtcgggacccgcctaggcggccgccccggaacggtcacgggaagttgttatttaaagatggcagttattacgaaggggcgctt

SEQ ID NO: 19540 - DNA, 62 bp, Homo sapiens
gatcgtgccactgcactccagacagagcgagactccgtctcaaaaaaaaaaaaaaaaaaaaa

SEQ ID NO: 19541 - DNA, 289 bp, Homo sapiens
ggagtcttttcctggacggggtccctgcggtgggtgtgtttcggcctggcctgggcaggcgcttgtgctgccagggcgccgggcccggggaggccggggtctcgggtggccgccggccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcct

SEQ ID NO: 19542 - DNA, 124 bp, Homo sapiens
ccttctacttttaaacttaacttcctcataaagcaaccattttcgattacctgctccaccctgactcattccgattaactgctctgtcataaccatttttcctgccaaaccactcaccccgtct

SEQ ID NO: 19543 - DNA, 186 bp, Homo sapiens
  misc_feature 132: m=a or c
  misc_feature 160: m=a or c
  misc_feature 162: r=a or g
  misc_feature 176: k=g or t
gcctcctgagtagctgagactataggtgtgtgccactatggccggctaagttttgtatgtttatgagagataggatttcaccatgttggtcaggctggtctcaaactcctgaccctcaagtgatccgcccamctcagcctcccaaagtgctgggattacmgrcttgagccactgtkcctggctggt

SEQ ID NO: 19544 - DNA, 117 bp, Homo sapiens
cctccataaacctacttcgtgtgtgcctgtgtgtatgtgagaaagaaacagactgtctctctctcttataattcttatttcttcatctttctttggaaaatttattcttctacccac

SEQ ID NO: 19545 - DNA, 283 bp, Homo sapiens
  misc_feature 266: b=c or g or t
tagagatgggctttcaccatattggccaggctggtcttgaactcttagactcaggtgatcctcctaccttggcctgccagagtgctgtaatctcagcactctggcaggcatgagccactgtgctcagcctgtaacattttataaatctaaaattattccaaaataaaaatattatttttaggctgggtgtggtgactcttgcatgtaatcccagcagtttgggaggccaacgcaggcaggtcacttgaggtcaggagttcgagacbagcctggccaatatggt

SEQ ID NO: 19546 - DNA, 169 bp, Homo sapiens
aaatctgtcgggtgtcggggcaggtgcctgtagtcccagctacttgggaggcttcagcagaattgcttgaacctaggaggcagaggttgcagtgagcagagattgtgccattgcactccagcctgagcaacaaagtgagaccctgtctctcaaaaaaaaaaaaaaaaaa

SEQ ID NO: 19547 - DNA, 142 bp, Homo sapiens
tttgggatgtataactgtaacctatcatggtaaagaaatttaatatgtaattatgggaactagttgttaatagacaacttgaaagttattttgagaagggaggcattaactccccacagccccgagtcttccactccacctc

SEQ ID NO: 19548 - DNA, 134 bp, Homo sapiens
  misc_feature 8: w=a or t
  misc_feature 34: y=c or t
  misc_feature 60: w=a or t
  misc_feature 94: y=c or t
  misc_feature 96: y=c or t
  misc_feature 97: y=c or t
ctttaccwttatgtaatggccttctttgtctctyttgatctttgttggtttaaagtctcwtttatcagagactaggattcaacccctgcttttytyytgctttccatttgcttggtagagtcaagacccatcat

SEQ ID NO: 19549 - DNA, 187 bp, Homo sapiens
tctcctgaccttgtgatctgcccacctccacctcccgaagtgctgggattacaggcgtgagcaccgcgctcggctggtaggtaggattctgaggcagagagatgtgaagtaagctatgcaaggtcactgatgaaagtaacagagccagacaccaacccaacgttgctggataccagtgcccccacaa

SEQ ID NO: 19550 - DNA, 194 bp, Homo sapiens
caatttttttttatttttaattttttttgactatgtggtctccctcagttgcctaggctggagtgcagtgatgatgtaatcacggctcagtgcagcctcaccttctgggctcaaatgatcctccttcataagcctcccgagtagttaggaccacagtcatgtgccaccacacccagctgttttttttttttttt

SEQ ID NO: 19551 - DNA, 214 bp, Homo sapiens
acacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccccgccc

SEQ ID NO: 19552 - DNA, 93 bp, Homo sapiens
  misc_feature 17: s=g or c
gaacccgggaagcggasttcaagtgagccgagatcgtgccactgcactccagcctgggtgacagagcgagacttcatctcaaaaaaaaaaaaa

SEQ ID NO: 19553 - DNA, 96 bp, Homo sapiens
aaggctgagcaacccaggctaccaacagcacggacttgaaccgggtcgcatgccggagcggacgggatgaggtgcaccgcagaactgaggactcct

SEQ ID NO: 19554 - DNA, 128 bp, Homo sapiens
ttattaggaagtcatttttaggctgagcacggtcgcttacgcctgcgattccagcactttgggaggctgaggcgggcggatcacttcgggtcaggagtttgagatcggcctggccggcgtgggagggt

SEQ ID NO: 19555 - DNA, 156 bp, Homo sapiens
  misc_feature 67: r=a or g
  misc_feature 85: r=a or g
  misc_feature 87: v=a or c or g
  misc_feature 92: w=a or t
  misc_feature 97: r=a or g
  misc_feature 105: m=a or c
  misc_feature 118: y=c or t
  misc_feature 123: y=c or t
  misc_feature 128: r=a or g
gctcaagaatgaagattatcaatatatggtcaaataaatataacgcaaatttttccctaaaaaaaaraaaaaatccctcagaaargvgtgtwtttgrgtcctatmatgttggccaggytggtyttgarctcctgacctccagtgatctgcccacct

SEQ ID NO: 19556 - DNA, 293 bp, Homo sapiens
tggaggtgggggctgagtgagaagagttgggatgctgctgagctgaggtcctggatcaactcccagttactgagctgccagaaaagctgctgctggctcagcccagggaggggagtcaggctggcaggactgcttgcctgctgagggcaagactcccatggtgttgtcctctgtcagaggggcacgctggtagagcagaaaggacatgttcttagaggcaggcaactgtaagttcaaattgaggctctgccacttggtagctatgtgactcagaacaaatttttctttctttc

SEQ ID NO: 19557 - DNA, 127 bp, Homo sapiens
aaatttttattttttgtatatatagggtcttgctctgttgccaaggctggtctcaaacctctaggcaagctatcctttcacctcagcctcccaaagtgctgggattacaggcccttttttttttttt

SEQ ID NO: 19558 - DNA, 94 bp, Homo sapiens
  misc_feature 28: b=c or g or t
  misc_feature 87: k=g or t
aaaaccttatttttaacatttttgtgtbaaaatactaatgtatgtatgtattagtaattaattattgtaaatttttatctttgcttkttttttt

SEQ ID NO: 19559 - DNA, 211 bp, Homo sapiens
  misc_feature 77: y=c or t
  misc_feature 113: m=a or c
  misc_feature 127: w=a or t
  misc_feature 186: y=c or t
  misc_feature 190: y=c or t
ctgctgtgttgcagtgctcttccttccacactctagtcaaatcttagctttttatttattgccttgttttttttttycttttggaggggctcaagtgccaggtgtctctagtmagccgtcttgcttwatcacttagtctagttgtcagtttctccaggtacagtatgcttgattggcatttttttycttyccctgaatatatcactgcctt

SEQ ID NO: 19560 - DNA, 224 bp, Homo sapiens
  misc_feature 25: y=c or t
  misc_feature 26: s=g or c
  misc_feature 28: v=a or c or g
  misc_feature 76: h=a or c or t
  misc_feature 89: m=a or c
  misc_feature 218: s=g or c
gataagtgaccaatgggagggtggysavgaaagccaacggcaactttgatgatgaatctcatttttaacagcagthtttgcgaactgamatgacctttgacagcagaaggttaccaggcaatttacagactgaggatgtatggatcatcttactgaaaagaagtttttaagtcttcagaaggcattttctccttgagtacggggaagcaacgacacasagcacc

SEQ ID NO: 19561 - DNA, 265 bp, Homo sapiens
  misc_feature 254: n=a, g, c or t
ctctgtcacccaggctggagtgcagtggcgcaatctccacatactgcaagctctgcctcccgggttcacgccgttctcctgcctcagcctcctgactagctgggactagaggcgcccgccaccatgcccggctaattttttgtatttttagtagagatgggatttcaccatgttagccaggatggtctcgatctcctgaccttgtgatccacccgcctaggcctcccaaagtgctgggattacaggcgtgagcnaccgcgccccc

SEQ ID NO: 19562 - DNA, 142 bp, Homo sapiens
gggattacaggtgtgcaccaccatacctggctaattttcttttgtttttagtggagacagggtttcagcatgttggtcagggtggtctcaaagtcctgactctcatgatccacccgcctcagcctccactgggccaggtgcg

SEQ ID NO: 19563 - DNA, 106 bp, Homo sapiens
catactcatctctgaattggcctcatggccagtggctttgaagagtctgtcctgagtcatggtctgcattcttcttcttactattttttttagacctttttttttt

SEQ ID NO: 19564 - DNA, 188 bp, Homo sapiens
attttcacgacatcaccgtaagagggacaatagtatggtaagtaagaaaaggaagttaatttcaggagacttgggttcaaataatgatccttccatttatttattttgaccttgtgaaagttacctaacttctaagcaagcctgcatttttctttctttcttttttcttttttttttttttttttttt

SEQ ID NO: 19565 - DNA, 109 bp, Homo sapiens
cactcaagggaaagataattcaaggcaagggaaaataatacaagaggagatgtgttttaggatatggtctcataggggcagaagaataattttttcttcaagccctata

SEQ ID NO: 19566 - DNA, 249 bp, Homo sapiens
  misc_feature 151: n=a, g, c or t
  misc_feature 241: s=g or c
ataatggaacggaatgcaatggaatggaatcatccggaatggaatggaatggaatggaatcagcccgagtgcaatggaatggattggaatggaatggaatggaatggaacaacccgaaatggaatggaatgtaatggagagtaagggagtngaatagaatcaatccgagtgtaatggaatggaatgcaacggaatggaatggaatcgttcccagtggaataggagggaatgtattcgagtsgaatggat

SEQ ID NO: 19567 - DNA, 252 bp, Homo sapiens
  misc_feature 133: m=a or c
tgccttctgaataaatgactctgtaactttacttcattcttggttacagccaagtaaccaatgggaagcctctaaagtgttgaaactccaacaagttctgtaaccgggggtcttgagcccctatacttgggcmactcccactcagtggaatgtactttcgttctcaataaatccttgtgcattttgtccaattctttgttagagatgccgagtacctggacaccttctgccggttacaacttcaacctccgc

SEQ ID NO: 19568 - DNA, 199 bp, Homo sapiens
  misc_feature 34: s=g or c
cactaaagacaagtttttgggctggatgcggcasttacacctgtaatcccagcactttgggaggctgaggtgagagggtcgcttgagcccaggagttctagacaagcctgggaaacatggcaagatctcatccttacaaaaaataataatggtgtgtgcctgcagtcctagctacttgggtggttgaggcaggaggcta

SEQ ID NO: 19569 - DNA, 104 bp, Homo sapiens
atgcacccaatacaggagcacacagattcataaagcaagtcctgagtaacctacaaagagacttagactcccacacaataataatgggagactttaacacccca

SEQ ID NO: 19570 - DNA, 77 bp, Homo sapiens
cttttttgtaaagacagagttttgccatgttgcccaggctggtcttgaactcctgacttcacgcgatccacccaact

SEQ ID NO: 19571 - DNA, 63 bp, Homo sapiens
accactgcactccagcctgggcaatagagtgagactctgtctcaaaaaaaaaaaaaaaaaaaa

SEQ ID NO: 19572 - DNA, 249 bp, Homo sapiens
  misc_feature 129: r=a or g
tagtcgtgtttgaaaagttcagctgtaggccaatgtcatccactactttcagcaatctgtaaagaaaggttggcagtttattatttatttatttatttattttgagacggagtctcgctctgttggcarggctgggggtgcagtggcgtgatctcggctcactgcaacctctgcctcctgggttcaagcaattctactgcctcagcctctcaagtggctgggactacagatgcacaccaccacacccaa

SEQ ID NO: 19573 - DNA, 125 bp, Homo sapiens
gcattctcaggacaagagttaaacatttatgtacagatggagcaaaaggccaggtgcggtggttcacgcctggaatcccagcactttgggaggccgaggcaggcggatcacgaggtcaggagatc

SEQ ID NO: 19574 - DNA, 82 bp, Homo sapiens
  misc_feature 7: y=c or t
  misc_feature 27: y=c or t
  misc_feature 28: h=a or c or t
  misc_feature 61: k=g or t
tagtcgygtttgaaaagttcagctgcyhggccaatgtcatccactactttcagcaatctgkaaagaaaggttggcagtttat

SEQ ID NO: 19575 - DNA, 194 bp, Homo sapiens
  misc_feature 16: b=c or g or t
ctaacagggtgaaacbctttctctactaaaaacacaaaaattagctgggcgtagtggcaggtgcctgtaatcccagctacttgggaggctgaggcaggagaatcgtttgaacctgggaggcagaggttgcagtgagccgggattgcaccaatgcactccagcctgggtaacagagcgagactccatctgaaaaa

SEQ ID NO: 19576 - DNA, 150 bp, Homo sapiens
acaaatccccaaaaggagaatactgcggacttcctacctggaagtagtttatgtagactactaccacctggcataaagataaatacaattatataattatttttcaaaagaattatgtcaaacagccaattttactttatccgtccgcct

SEQ ID NO: 19577 - DNA, 113 bp, Homo sapiens
  misc_feature 16: r=a or g
cactaatattcatggraatgtcagttaaaaccactatgaaatatcacatctcacacctgttaggatgacttatcaaaaatgaaagataagactgggcatggtggctcaggctt

SEQ ID NO: 19578 - DNA, 109 bp, Homo sapiens
tatttttagtggagatggggtttcgccatgttggccaagctggtctcaaactcctgacctcaggtgatccacctgccttggcctcccaaagtgccgggattacaggcgt

SEQ ID NO: 19579 - DNA, 119 bp, Homo sapiens
  misc_feature 107: s=g or c
cagactgcagtggcgcaatctcggctcactgcaagctccgcttcccgggttcacgccattctcctgcctcagcctcccgagtagctgggactacaggcgcccgccascgcgcccggcta

SEQ ID NO: 19580 - DNA, 111 bp, Homo sapiens
  misc_feature 14: k=g or t
cagtagtttcctgkggatggattttaagtcatataaaaggagggagaataaagctgggagagtggcatgggggcaggccgtgcactcagaggagatggagcctggccctaa

SEQ ID NO: 19581 - DNA, 78 bp, Homo sapiens
  misc_feature 16: y=c or t
tggaggtggaggttgyggtaagccgagatcgcaccactgtactccagccagggtgacagagctagactccatcaaaaa

SEQ ID NO: 19582 - DNA, 161 bp, Homo sapiens
  misc_feature 44: w=a or t
  misc_feature 68: r=a or g
  misc_feature 70: s=g or c
  misc_feature 116: r=a or g
  misc_feature 135: s=g or c
  misc_feature 137: n=a, g, c or t
  misc_feature 149: r=a or g
  misc_feature 150: s=g or c
  misc_feature 151: r=a or g
tgataagaagatgaagatgctgagggacgaactcgacttgcggwgaaagactgagctccacgaagtgrgsagaggaagaatggccagatccacacgctgatgcagcgccacgaggrggccttcaccgacattaasanctactacaacgrsrtcaccctcat

SEQ ID NO: 19583 - DNA, 63 bp, Homo sapiens
  misc_feature 15: k=g or t
  misc_feature 32: m=a or c
  misc_feature 44: v=a or c or g
tggaacctggagaakttgagatctccagaggmggtagacaaggvaagtcaaaggaatctggaa

SEQ ID NO: 19584 - DNA, 93 bp, Homo sapiens
  misc_feature 15: s=g or c
  misc_feature 90: m=a or c
cctggcccttagccsactttttgatggaattgtttttttcttgctgatttgtttgagtttgttgtagattctggatattagtcctttgtmaga

SEQ ID NO: 19585 - DNA, 94 bp, Homo sapiens; identical to SEQ ID NO: 18177

SEQ ID NO: 19586 - DNA, 216 bp, Homo sapiens
ggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtccgccct

SEQ ID NO: 19587 - DNA, 79 bp, Homo sapiens
  misc_feature 16: h=a or c or t
  misc_feature 50: k=g or t
cttggataacttaaahattcttttggtagcaacagcgtttcttctatgtkgcccaggctggtctcaaaatcctgacctc

SEQ ID NO: 19588 - DNA, 299 bp, Homo sapiens
  misc_feature 16: b=c or g or t
  misc_feature 145: w=a or t
  misc_feature 146: y=c or t
  misc_feature 162: d=a or g or t
ttagtataacaatcabattcacattctttctttagatctgagaaaattcctttagtagttcttgtattacatgtctgaaagcaacaaattatcttagcttttctttgtctgggaaggtctttttatatcctttatttctgaaggwyagctatgctgggtacdatattcttgatgtccaacactttttcttcagtgctctgattatattgtctcactccatcctagcctgcaagatttctactgagaagttgccttgtatgttatctgatccttttctcttggcagctttcagagttctt

SEQ ID NO: 19589 - DNA, 93 bp, Homo sapiens
  misc_feature 16: k=g or t
atgagagtcaactggkacactggtgcgggaggcagacacagctaagggttatgtgttccagctcttccaaccagacagacacattcctttttt

SEQ ID NO: 19590 - DNA, 106 bp, Homo sapiens
caaaaattaactgggcgtggtggcacgcgcctgtaatcctagctactcgggaggctgaagcaggagaatcgcttgaaccagggaggtggaggttgcggtgagccaa

SEQ ID NO: 19591 - DNA, 65 bp, Homo sapiens
  misc_feature 15: k=g or t
  misc_feature 16: y=c or t
accactgcactccakyctgggcaatagagtgagactctgtctcaaaaaaaaaaaaaaaaaaaaaa

SEQ ID NO: 19592 - DNA, 218 bp, Homo sapiens
  misc_feature 109: m=a or c
  misc_feature 121: s=g or c
  misc_feature 125: w=a or t
  misc_feature 127: r=a or g
  misc_feature 132: v=a or c or g
  misc_feature 134: y=c or t
  misc_feature 145: h=a or c or t
  misc_feature 147: v=a or c or g
  misc_feature 148: s=g or c
  misc_feature 163: r=a or g
  misc_feature 168: s=g or c
  misc_feature 193: m=a or c
ggatgtgagggcgatctggctgcgacatctgtcaccccattgatcgccagggttgattcggctgatctggctggctaggcgggtgtccccttcctccctcagcgctccmtgtgcgtccctsccgwargctgvgygctcggtcgahgvsgacgaccatccccgrtagasgaggaccggtcttcggtcaagggtmtacgagtagctgcgctcccctgcat

SEQ ID NO: 19593 - DNA, 117 bp, Homo sapiens
aggtcctcactgggtgtggaggctcatgtctataatatcagtactttgggaagccaaggtgaaaggatcacttgaggccaggagtttgagactagcctgggcaacatagtaagactc

SEQ ID NO: 19594 - DNA, 95 bp, Homo sapiens
tccttttgccttcagatgttgaactcccttatttcttgtatatccagtctggcaatgatgactatgtattcttgcttaaataaatcatctattaa

SEQ ID NO: 19595 - DNA, 206 bp, Homo sapiens
agtgtgtttcagagaggctgtaccagaattaactctgctcagagttagatttgctggtcttaaagtacttttcctctttaagataaaactggacccttggtgctacctggagatccctctacttgttgatgggcagcttcccgggccactcctctcaggtactctactgaaggtttttcattctcctcaagctccagttctgccac

SEQ ID NO: 19596 - DNA, 94 bp, Homo sapiens
ctgtctctctctggttgtggtatgacggtaatacaagattcataaaatgagtgatggagtgttcctttttctttctttctttcttttttttttt

SEQ ID NO: 19597 - DNA, 291 bp, Homo sapiens
  misc_feature 15: w=a or t
  misc_feature 161: h=a or c or t
  misc_feature 162: s=g or c
  misc_feature 167: w=a or t
  misc_feature 179: k=g or t
  misc_feature 180: w=a or t
  misc_feature 186: n=a, g, c or t
  misc_feature 270: n=a, g, c or t
  misc_feature 271: n=a, g, c or t
  misc_feature 272: b=c or g or t
tgcttgaacccaggwgatggaggttgcagtgagctgagactggggcacaaaaactccagcctgagccaaagcaagactgtcaaaaaaagaaagagagagagagggagagagggagggcggcagggagggcagaaagcaagggaagcaagggaaggaaggahsaaagwaaggaagaaagkwaagatnattgtaatgtacactctttgcatgtggcaaagtatactctttgcatgagaaagttttctggcaatagctaccagtgttcctgtnnbatagaggactccagcccca

SEQ ID NO: 19598 - DNA, 159 bp, Homo sapiens
ggctcacgcctgtaatcccagcactttgggcgaccgaggtaggtggatcacctggggtcaggagttcgagaccagccttaccaacatggggaaaccctgtctctactaaaaatacaaaaattagccggacgtggtggcgggctaatttttttttttttt

SEQ ID NO: 19599 - DNA, 106 bp, Homo sapiens
cgacagagtcttgctctatcacccaggctggagtgcagtagtgcaatcacagctcactgcagccttgacctcctgggctcaaacaatcctcccatctctgcctcca

SEQ ID NO: 19600 - DNA, 80 bp, Homo sapiens
tatttaaaagttgtttaataaaatatatagaatttttaatatatatatttataaatctcgtctttttttttttttttttt

SEQ ID NO: 19601 - DNA, 222 bp, Homo sapiens
  misc_feature 187: n=a, g, c or t
tctcgctcagtcgtccaggctggagtgcagtggtgtgatctcggctcactgcgagctccacctcccggtttcacgccattcttctgcctcagcctcccgagtagctgggactacatgcgcccgccaccacgcccggctaattttttttgtatttttagtagagacagagtttcaccgtgttagccangatggtctcaatctcctgacctcgtgatccgcccc

SEQ ID NO: 19602 - DNA, 99 bp, Homo sapiens
  misc_feature 16: d=a or g or t
  misc_feature 17: k=g or t
ggaaggaaggaaagadkgaaggaaggaaggaaggaagggaaaagtaatgcactcaacttgaatcaccaaagcagtcagacgaggtattttttttccctt

SEQ ID NO: 19603 - DNA, 194 bp, Homo sapiens
  misc_feature 118: r=a or g
  misc_feature 130: y=c or t
tctcggctactgcaatctctgcctcccaggttcaagtgattatcttgcttcagcctcctgagtatttgagtctacaggcatgcccactatgctgaactaatttttgtatttttagtargagagggggttycaccatgttggccaggctggtctggaactcctgacctcagatcatctgcctgtctcggcccccc

SEQ ID NO: 19604 - DNA, 169 bp, Homo sapiens
  misc_feature 156: m=a or c
  misc_feature 160: m=a or c
agtagctgggactacaggcacccgccaccacgcctggctaattttttgtatttttagtagagatggagtttcaccgtgttagccaggatggtgtcaatctcccgacctcgtgatccacccacctcggcctcccaaagtgctgggattacaagtgtmagcmaccaggcct

SEQ ID NO: 19605 - DNA, 61 bp, Homo sapiens
aacagtgagggaaagaactgcatgtgctcctctccctctgtcttttttttttttttttttt

SEQ ID NO: 19606 - DNA, 157 bp, Homo sapiens
ataaacacactaaaaagttcagaggttaatttcagttgctagagaaaaatcaaatgtttagtaaaattttaaaaaataactatgagccagccttgagagtacactgtgaattataagatgtttgaccctggtacattgaaattaaagcagggggaaa

SEQ ID NO: 19607 - DNA, 247 bp, Homo sapiens
  misc_feature 145: n=a, g, c or t
cttggccaggcgtggtggctcacgcctgtaatcccagtactttgggaggccgaagcaggtgaatcatgaggtcaggagttcgagaccagtctggccaacatagtgaaaccacgtctctactaaaaatacaaaaaaattaactggntgtggtggtgtgtgcctgtcatcccagctactcaggaggctgaggcaggagacagaggttgcagtgagccaagatcgcgccattgcactccagcccgagctt

SEQ ID NO: 19608 - DNA, 84 bp, Homo sapiens
agcttgcagtgagccgagatcgcgccacttcactccagcctgccgacagagcaagactccatctcaaaaaaaaaaaaaaaaaaa

SEQ ID NO: 19609 - DNA, 137 bp, Homo sapiens; identical to SEQ ID NO: 18494

SEQ ID NO: 19610 - DNA, 195 bp, Homo sapiens
ctcccagactctggctgttgcaacaggtctcagtgcaagcactatctgtggctcaagcagggctatgaataaaaaagatgtcctccttctccttaggaaatagcacgcagatgatgaggtaattgctaaggccaggaaaggagagaggaagtcctctgtagcactgagaacaggaaataacaaactccatgccct

SEQ ID NO: 19611 - DNA, 90 bp, Homo sapiens
  misc_feature 3: m=a or c
  misc_feature 21: m=a or c
tgmttgaacccaggagatggmggttgcagtgagctgagactggggcacaaaaactccagcctgagccaaagcaagactgtcaaaaaaaga

SEQ ID NO: 19612 - DNA, 160 bp, Homo sapiens
ggctcacgcctgtaatcccagcactttgggcgaccgaggtaggtggatcacctggggtcaggagttcgagaccagccttaccaacatggggaaaccctgtctctactaaaaatacaaaaattagcccggacgtggtggcgggctaatttttttttttttt

SEQ ID NO: 19613 - DNA, 222 bp, Homo sapiens
  misc_feature 189: m=a or c
tctcgctcagtcgtccaggctggagtgcagtggtgtgatctcggctcactgcgagctccacctcccggtttcacgccattcttctgcctcagcctcccgagtagctgggactacatgcgcccgccaccacgcccggctaattttttttgtatttttagtagagacagagtttcaccgtgttagccaggmtggtctcaatctcctgacctcgtgatccgcccc

SEQ ID NO: 19614 - DNA, 230 bp, Homo sapiens
atgccactatgcctggctaatttttgtatttttagtagagacggggtctcaccatgttggccctagcctcaagtggtcttgaacccctagcctcaagtgatcctcctgcctggcctcccaaattgctgggattacaggtgtgagccactgtgcctggccgggatactgtttttttgagtattaaaattatataaagcttttcttttctttttcttttttttttttttttt

SEQ ID NO: 19615 - DNA, 111 bp, Homo sapiens
tcagagaacatctttgtttctgcctttatttcattatttacccagtagtcattcaggagcaggttgctcagtatccatgtaattgtgcagttttgagtgaatttcttaatc

SEQ ID NO: 19616 - DNA, 94 bp, Homo sapiens
  misc_feature 11: m=a or c
  misc_feature 15: d=a or g or t
  misc_feature 27: m=a or c
  misc_feature 31: m=a or c
ggaaggaaggmaagdaggaaggaaggmaggmaggaagggaaaagtaatgcactcaacttgaatcaccaaagcagtcagacgaggtatttttttt

SEQ ID NO: 19617 - DNA, 193 bp, Homo sapiens
  misc_feature 128: w=a or t
  misc_feature 135: w=a or t
  misc_feature 189: m=a or c
tctcggctactgcaatctctgcctcccaggttcaagtgattatcttgcttcagcctcctgagtatttgagtctacaggcatgcccactatgctgaactaatttttgtatttttagtagagagggggtwtcaccawgttggccaggctggtctggaactcctgacctcagatcatctgcctgtctcggcmcccc

SEQ ID NO: 19618 - DNA, 51 bp, Homo sapiens
  misc_feature 17: y=c or t
  misc_feature 20: m=a or c
attagacaatgttggcyggmtgctgtggctcacgcctgtaatcctagcact

SEQ ID NO: 19619 - DNA, 169 bp, Homo sapiens
  misc_feature 60: s=g or c
  misc_feature 61: m=a or c
  misc_feature 62: s=g or c
  misc_feature 63: m=a or c
agtagctgggactacaggcacccgccaccacgcctggctaattttttgtatttttagtasmsmtggagtttcaccgtgttagccaggatggtgtcaatctcccgacctcgtgatccacccacctcggcctcccaaagtgctgggattacaagtgtgagccaccaggcct

SEQ ID NO: 19620 - DNA, 63 bp, Homo sapiens
  misc_feature 12: r=a or g
aacagtgcaggraaagaactgcatgtgctcctctccctctgtctttttttttttttttttttt

SEQ ID NO: 19621 - DNA, 101 bp, Homo sapiens
gaggaggaggaggaggtggcggcgagaagatggcgacttcgaacaatccgcggaaattcagcgagaagatcgcgctgcacaatcagaagcaggcggaggaa

SEQ ID NO: 19622 - DNA, 121 bp, Homo sapiens
cttccttaagaagcggtttctctcccctcttttctctctctcacctgggtttgtttgtccatgagaggggcttggataagtatatttctttcttctctatctctctctctctctctttttt

SEQ ID NO: 19623 - DNA, 170 bp, Homo sapiens
  misc_feature 143: k=g or t
  misc_feature 144: k=g or t
cttggccaggcgtggtggctcacgcctgtaatcccagtactttgggaggccgaagcaggtgaatcatgaggtcaggagttcgagaccagtctggccaacatagtgaaaccacgtctctactaaaaatacaaaaaattaactgkktgtggtggtgtgtgcctgtcatccca

SEQ ID NO: 19624 - DNA, 133 bp, Homo sapiens
aagaaaagggaaagaaagaggaagagagagagagagtgagaggagccgctgagcccaccccgatggccgcggacgaagttgccggaggggcgcgcaaagccacgaaaagcaaactttttgagtttctggtcct

SEQ ID NO: 19625 - DNA, 348 bp, Homo sapiens
  misc_feature 219: k=g or t
  misc_feature 227: k=g or t
  misc_feature 290: s=g or c
  misc_feature 291: s=g or c
  misc_feature 292: k=g or t
  misc_feature 337: r=a or g
ataatcccagcactttgggaggccaagatgggcggaaaacgaggccagattggagaccagcctggccaacctggtgaaaccctgtctctacaaaaatgagctgggcatggtagcatgtgcctgtagtcccagctactcaggaggctgaggtgggaggatcacttgagccccagagtagctgggactacaggcaagcaccaccacatccagcaaattttkgtattttkttgtagagacagggtttcaccatgttgcccaggctggtctcgaactcaggctcatacgatccsskggcctcagcctcacaaagtgctgggattacaggtttgagtcatgrcacctacccct

SEQ ID NO: 19626 - DNA, 238 bp, Homo sapiens
  misc_feature 207: n=a, g, c or t
ccctgctttcatttcttttgggaatatgcctagaggtggaactgctggatgatctggcagttctacttttaatttttttgtttttgttttgagttggagtcttgctctgtcactccggctggagtgcagtggcgcagtctcggctcgctgcaacctctgccgcccgagttgaagcaattctcttgtctcagcctcccgagtagctgngactacaggcgcgcaccaccacacctggcaa

SEQ ID NO: 19627 - DNA, 108 bp, Homo sapiens
tgtatcatctcatctgctaaaaaaaatcagatgaaattgttctgagggagtgaattcccaggattctctacgctttgtatgcctcacctctgccaggtgccaccaatc

SEQ ID NO: 19628 - DNA, 320 bp, Homo sapiens
  misc_feature 132: d=a or g or t
  misc_feature 275: n=a, g, c or t
  misc_feature 276: n=a, g, c or t
  misc_feature 301: v=a or c or g
  misc_feature 303: n=a, g, c or t
aagcttttgcccctgagcttttagattttataatgttgaagttatcagacttttcttttatggcatccttatttcgacacttaattagaagggaggacttcatattctagagtggtaaagtaattcttcatdgttttctcttagcactaccatgttttgctttatattattcattttcataatttttaatgtattcctgtagaggacgtgaggtattgatacaaatttaatatttttttttcaggtggctacccaattatttcaataactatgtnnctataagtcatcatttcccatttavgnctctgttatgatatttt

SEQ ID NO: 19629 - DNA, 263 bp, Homo sapiens
aaatatagttaatgtgaaaacaagatgcagaaaagtatgtagagaataattttattcgtggtataaaaagtactgacatttgcagagaaaaccttcagagggattcagaagttgtgactcctgtgacatgagacttggatgaccaagagacaaaaaggactttcacttcatattcttgtgtaatgtcaaatgttagcataagaagtgttacttttaaaacataaaagatagttaaagaaaaagtaaaatactcagtggctcct

SEQ ID NO: 19630 - DNA, 251 bp, Homo sapiens
  misc_feature 154: d=a or g or t
gctggagtgcagtggcgcgatctcggctcactgcaagctccgcctcccgggttcacgccattctcctgcctcagcctcccgagtagctgggactacaggcgcccgccacctcgcccggctaattttttgtatctttagtagagacagggtttcdccctgttagccaggatcgtctcaatctcctgacttcgtgatccgctcacctcggcctcccaaagtgttgggattgcaggcaccccacctcgccctaa

SEQ ID NO: 19631 - DNA, 250 bp, Homo sapiens
  misc_feature 142: k=g or t
  misc_feature 143: h=a or c or t
  misc_feature 153: y=c or t
  misc_feature 154: n=a, g, c or t
tctagcgttaggtatatctccaaatgctatccctcccccctctccccaccccacaacagtccccagagtgtgatgttccccttcctgtgtccatgtgttctcattgttcagttcccacctatgagtgagaatatgcggtgtkhagtttttctyntgatagtttactgagaatgatgatttccaatttcatccatgtccctacaaaggacatgaactcctcattttttatggctgcatagtattccatggt

SEQ ID NO: 19632 - DNA, 101 bp, Homo sapiens; identical to SEQ ID NO: 17473

SEQ ID NO: 19633 - DNA, 140 bp, Homo sapiens
agccttggggactgggaatttgggaagagagattctctgggtgcttatgccagccaagatgccaacgagcagggccaagatttggggaagagggaccaccatggtaggtacaagcagccaggatgccgatgaacaggacc

SEQ ID NO: 19634 - DNA, 123 bp, Homo sapiens
  misc_feature 100: y=c or t
  misc_feature 108: y=c or t
taccactgcacttcacattcatttgtcttttgatgtagtttatggtattgttttgattacaatatgttattgcaaattttttttttttgagatggagtcyccctctgycacccaggctggagt

SEQ ID NO: 19635 - DNA, 264 bp, Homo sapiens
  misc_feature 134: w=a or t
tgtttctgggctgtctagcctgttcgtttggtctagtttttattcttttacccataatacagtctcttaattactacagtttttaaataagccttgctatctggtaatgtgaacctttcagctttagtattctwtttttttattattattatactttaagttctggggtacaagaataagaacagagagtcatatgaagtatctttaacacaaaagactgacccctcagtcaggcctatgcatgaaagagtgccaaaaaaagaa

SEQ ID NO: 19636 - DNA, 111 bp, Homo sapiens
ctggagggcagtggcgcaatctcagctcacgcaagctccacctcccgggttcatgccgttctcctcaatcagcctcccagatagctgggactacaggtgcccaccaccaca

SEQ ID NO: 19637 - DNA, 256 bp, Homo sapiens
  misc_feature 227: y=c or t
ctcagctgttaataacctagccgagacccggccctggcagctggttctccagcttccactcgcctctgcaagcaaaggagggtagccacattttctcccggtagaaacagtagacagaacacgaggactggtcttcttttttttttttaatattaattaatttattttttgagacggagcctcgctcctcgcccaggctggagctcagtggcacagtcttggctcaytgcactccagcctgggcgacaaagcaaga

SEQ ID NO: 19638 - DNA, 155 bp, Homo sapiens
tagtgttattcatagtagtatctgaagaccttttgtattcttgtgggatcagttgtaatgtcacctttgtttattctgattgtgcttatttggatcttctctttctttttctttattactctagttagggggtctatcaatcttttttttttttt

SEQ ID NO: 19639 - DNA, 272 bp, Homo sapiens
  misc_feature 146: w=a or t
  misc_feature 177: b=c or g or t
ctctgtcgtccaggctggagtgcagtggtgcaatctcggctcactgcaacctccgcctccagggttcaagcaattctcccaccttagcctcctgagtagctgggactacaggcacgtatcaccacacccagataattttttttttwattcttagtagagacggggtttcaccatgtbggccaggctggtcttgaactcctgacctcaggtgatccgcccgcctcagcctcccaaagtgctgggattacaggtgtgagtcactgcacccggcc

SEQ ID NO: 19640 - DNA, 54 bp, Homo sapiens
gtcttagttctcttaagtactcccttctctcttttttttttttttttttttttt

SEQ ID NO: 19641 - DNA, 236 bp, Homo sapiens
agttaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgcggctgtctacccgcgaccggggccatgccctctcgggctcggttgaggagctgctcttcctccagaatgcgctcggacggaacat

SEQ ID NO: 19642 - DNA, 227 bp, Homo sapiens
  misc_feature 14: d=a or g or t
  misc_feature 15: d=a or g or t
  misc_feature 136: d=a or g or t
  misc_feature 190: k=g or t
tatgcatgagccaddctgttgcatcataatttagcactgatgtctgcttttattttgatcatctttgtccacccttattagttcttggctgttaaccgtagatagatcttgtaaatccagcaaacctttggttgcdgcattccccttggttcgattccacgcaaggagccacaagtgagaactccactgkccttagaagaaagggcatttttacttttgaaccaaat

SEQ ID NO: 19643 - DNA, 119 bp, Homo sapiens
  misc_feature 15: r=a or g
agggcaaggactgtrtcctcttcagttctgttttctgatggcctagtacagacctggcacatgattgttcctaaatatttgctaaatgaaagttgagaaatgcttatttgaagtcactt

SEQ ID NO: 19644 - DNA, 295 bp, Homo sapiens
  misc_feature 2: d=a or g or t
  misc_feature 3: w=a or t
  misc_feature 122: w=a or t
  misc_feature 123: d=a or g or t
tdwagaattatgatggtattttgatgggaattgcattgaatttgtagattgcttttggcaatatggtcattttcactatattgaatccacccatccataagcatgagatgtgttttcatttwdttatttagatttttttaaattatactttaagttttaggttacatgtgcacaacgggcaggtttgttacatatgtatacatgtgccatgttgctgtgctgcacccattaactcgccatttaacattaggtctatctcctaatgctatctctccccactccccccaccccacca

SEQ ID NO: 19645 - DNA, 143 bp, Homo sapiens
  misc_feature 119: r=a or g
agcaatcgaatggaatggaatggaattaaaccgaatagaatggaatggaatggaatggaacggaacggaacggaacggaatggaatggaatggaatggaatggaaaggaagggaatggraatgaaatagaaatggaaaggaat

SEQ ID NO: 19646 - DNA, 429 bp, Homo sapiens
  misc_feature 14: s=g or c
  misc_feature 15: k=g or t
  misc_feature 218: k=g or t
  misc_feature 310: m=a or c
  misc_feature 333: k=g or t
  misc_feature 367: w=a or t
  misc_feature 383: v=a or c or g
  misc_feature 384: d=a or g or t
  misc_feature 393: k=g or t
  misc_feature 407: h=a or c or t
  misc_feature 408: r=a or g
caatgatattttaskatctaaagtagtcttttactgtaaaaataatgattgcttaaggcatataattaaaacaattccaaagggaatcaaatattttcctctcttttcttcatatagtagctggatatccaattttttgtgtatccttaatgaaaataatagtttttaaaaacaaataaataatatgtgcacaaataatgcagagaaagttgaaggtkctccccaactcacttttttttaagacggggtcttgctctgttgcccaggctggagtgcagtggcgcgatctcggccccctatagcttctgcmtcctgggttcaagcggttcttgkgcctcagccccccgagtagctgggactacaggtwcgtgcaaccacacctvdctaattttkgtatttttagcaghratgggatttgccatgttggcc

SEQ ID NO: 19647 - DNA, 268 bp, Homo sapiens
  misc_feature 16: k=g or t
  misc_feature 110: d=a or g or t
aaggtttgttatacakgtaaattgcatgtcacagggtttggggtccagtttatttcatcacctaggtaatgagcatagtacccaatatgtagtttttcaatcctcacccdtctcccaccttccaaatctcaaataggccctggtgtctgttgttcctttctttgtgttcatatgtaatcaatatttacctcccattcataagtgaaaatatgcagtatttggttttccatccctgtgttagttcgcttaggataatggcccccgctgt

SEQ ID NO: 19648 - DNA, 167 bp, Homo sapiens
tgctgtactttgaatgccagtcctgtgctctgcaaaccatggttccctgggaaaggagcatgttgattaatgttgtgttacttagtcagcatttttaacatttataattattttatttttaaatttttttttatgttacccaagctggtctcaaactcccgggctca

SEQ ID NO: 19649 - DNA, 306 bp, Homo sapiens
  misc_feature 305: w=a or t
  misc_feature 306: w=a or t
cactaatattcatggaaatgtcagttaaaaccactatgaaatatcacatctcacacctgttaggatgacttatcaaaaatgaaagataagactgggcatggtggctcaggcttgtaatcccagcactttgggaggctgaggcgggtggatcatgaggtcaggagttttgagaccggcctggccaagatggtgaaaccccatctctactaaaaatacaaaaattagctgggtgcagtggtggacacctgtagtcccagcaactcgggaggctgaggcaggagaattgcttgaacccgggaggcggww

SEQ ID NO: 19650 - DNA, 114 bp, Homo sapiens
gtctagagtaaatggccttgtccaagttcacaaccggctgggagcaaagcagaggttctcatgttcagcctgtctactgctcttttgaggacattttttttttttttttttttt

SEQ ID NO: 19651 - DNA, 97 bp, Homo sapiens
  misc_feature 15: y=c or t
  misc_feature 62: r=a or g
  misc_feature 73: v=a or c or g
  misc_feature 74: d=a or g or t
  misc_feature 87: m=a or c
gcggcgcgcctgggygctaagatggcggcggcgtgagttgcatgttgtgtgaggatcccggrgccgccgcgtvdctcgggccccgcmatggccgtca

SEQ ID NO: 19652 - DNA, 99 bp, Homo sapiens
aacctcggctcactgcaacttccgcctcccaggttcaagcaattctcctgcctcagcctcccaagtggctgggactacaggcgcacaccaccacgccca

SEQ ID NO: 19653 - DNA, 315 bp, Homo sapiens
  misc_feature 121: r=a or g
  misc_feature 123: w=a or t
  misc_feature 256: n=a, g, c or t
aatggaatggaatggaatggaatggaatggtatggaatggaatggaatggaatggaatcaatgcgagtggaggggaatgtaatggaacggaatgcaatggaatggaatcatccggaatggrawtggaatggaatggaatggaatcgaatcaacccgagtgcaatggaatggagtggaatggaatggaatggaatggaacaacccgaatggaatggaatggaatggagtgtaagggagttgaatagaatcaatgcgnatgtaatggaacggaatggaatggaatcaatgcgagtggaggggaatgtaatggaacct

SEQ ID NO: 19654 - DNA, 174 bp, Homo sapiens
  misc_feature 118: k=g or t
  misc_feature 174: n=a, g, c or t
tttgtgaaaattatatatgaaatatcttggccgggcgcggtggctcacgcttgtaatctcagcactttgggaggctgaggcgggcggatcacgaggtcaggagatcgagaccatcctkggctaacacggtgaaaccccgtctctactaaaaatacaaaaaaaattaaccgggcn

SEQ ID NO: 19655 - DNA, 271 bp, Homo sapiens
  misc_feature 14: r=a or g
  misc_feature 221: w=a or t
  misc_feature 224: n=a, g, c or t
  misc_feature 255: k=g or t
  misc_feature 256: d=a or g or t
  misc_feature 261: b=c or g or t
ggttagcagagaartggcaactgagcccggagctggaactagaaactttctgtcagtgtaacatctgcacccaatggtggttgggcttcgggtcacgtgacaccttctttgtggctccggaagaggattgtgaagtttaggtttcgtggaagaaaccgataattgaggaaaaaaaaaatcaagatttggggggaattacctacaaagatgtaaggtgtgtwaanttgggcgcttcttggattctaccctgaggakdaggcbcgtggtgaga

SEQ ID NO: 19656 - DNA, 100 bp, Homo sapiens
  misc_feature 14: k=g or t
  misc_feature 15: r=a or g
tgtttgaaatgttkrcattttttttagacggagtttcgctcttgttgcccaggctggagtgcaatggtgcgatctcagctcactgcaacctctgcctccc

SEQ ID NO: 19657 - DNA, 208 bp, Homo sapiens
ggtggatcaacagaggctgggagttcaagaccagcctgaccaacatggagaaaccccatctctactaaaaatacaaaattggctgggcatggtgacgtatgcctgtaatcccagctactcaggaggctgaggcaggagaatcacttgaacccgggaggtcgaggttgcggtgagccgagatggcatcattgcactctagcctgggcaa

SEQ ID NO: 19658 - DNA, 313 bp, Homo sapiens
  misc_feature 298: n=a, g, c or t
gagacaaggtctcactatgttgcccaagctggtctcaaactcctagactgctgccatcctctcctcggcctcccaaagtgctgggattacaggtgtgagccacggcacttggcactcaactaagaattttttttttttcagttataatggttacttttttaaattttattattattatactttaagttttagggtacatgggcacaatgtgcaggttagttacatatgtatacatgtgccatgctggtgtgctgcacccattaactcgtcatttagcattaggtatatctcctaaagntatcccacccccctc

SEQ ID NO: 19659 - DNA, 111 bp, Homo sapiens
ctgagttaaaaccctccctcttctttcctgggacacactgtagctcctttgtgctttcttctgcttagtagtgttctacttaatcagttttatttattttataaatccccc

SEQ ID NO: 19660 - DNA, 118 bp, Homo sapiens
cccagctacttgggaggctgaggcaggggaatcatttgaaaccaggaggtggaggttgcagtgagctgagatcacgccagtgcactccaacctggggacagagcaagactctgtctaa

SEQ ID NO: 19661 - DNA, 52 bp, Homo sapiens
tgatttgcaattagcctaaaaaacatttaccttttccttttttttttttttt

SEQ ID NO: 19662 - DNA, 206 bp, Homo sapiens
  misc_feature 75: r=a or g
  misc_feature 76: r=a or g
  misc_feature 196: n=a, g, c or t
aaaagccagagcctctgtcgcccaggctgcagtacagtggcgtaatctcagctcactgcaacctctgcctcccgrrgatcaagcgattctccttcctcagcctcccgagtagctgggattacaggtgcccgtcggctaatttttggttttttgttttgttttgttttgtttttttttgtttttgtttttgttttgnaacggagtct

SEQ ID NO: 19663 - DNA, 54 bp, Homo sapiens
ccccagtctgggcgacaagagcgaaactgtctcaaaaaaaaaaaaaccccaaaa

SEQ ID NO: 19664 - DNA, 241 bp, Homo sapiens
ttgcactccagcctgggcaacaagagtgaaactccatctcaaaaaaacaaaaaaaagtgagatgggtgaattttaaaatttaggaagtaaaatcatagcagattaaaaacttaattagaaaggaccagagtatctactaaagaaagctgagccaattctgtgaaggaaaatttgagataagttttgctgataaaattgacatgatagattggaacactgaatttaaatccaacagaggcta

SEQ ID NO: 19665 - DNA, 301 bp, Homo sapiens
  misc_feature 118: r=a or g
  misc_feature 120: w=a or t
atcatgtgtttgcttccttaacacttttatagctcaccctttcatgtttctctacatctaaaataaacatataaattaaaggaatactttacaaaagtctcattaccataaagttctrtwgtaaaagcaaattcttctggattgagtcatcattacaatgatcagtaacacacagttgatctgaacaacatagatatactcagggcggataaataatagttaagcataataactgaaatttcatttgaaatgcatctctttgagaagaaaacgtcttttattttttctagttagttaatta

SEQ ID NO: 19666 - DNA, 240 bp, Homo sapiens
aacagttttaaaaaaataaggtggttaaatgggttaagtgcaattgtggttgaataaaaaacattttggttaaaaaaagggactggctgggcatggtggctcacgcctgtaatcccaacactttgggacgcccaggtgggtggatcatgaggtcaagagatcaagaccatcctggcccacatggtgaaaccccatctctactaaaaatacaaacattagtttggcatggtggtacttgcc

SEQ ID NO: 19667 - DNA, 154 bp, Homo sapiens
atcagatacgatattttggaaagttggacattaagaagagtgtgattggggaggttgttgtgactttctgcctgaagattcagagtcaggatcatgtgctaacaggtgacttgaagtttagaatagccatttggggagagtagacacaaaaggc

SEQ ID NO: 19668 - DNA, 157 bp, Homo sapiens
ccttgtgaagtattcttaattataacttgcctttcagcgatggtacatgacttgattcaacgtttggttctgaacttacacactgatgcgtcctcaggtgttttcacctcctctggatttggcaggcccaactcctggacatcaggaccatctccgc

SEQ ID NO: 19669 - DNA, 367 bp, Homo sapiens
  misc_feature 13: s=g or c
  misc_feature 349: n=a, g, c or t
  misc_feature 350: n=a, g, c or t
ttacaggcgtgasactgtgcccggcaactgaacagatcttaagtgtacagtttgatgagttttgacaaatgaatacatttgtgtaatctatatcccaatcaaaaacaatgcattgccatcaccctagaaagttcccttgtgtctttttttattctatctccttcctcccctgcccctggaggaaatcgctttttgatttctatacctatggattaattttgctattcttaaagcattaaaatggcagcatggaaaatgtacttttttgtgtttgacttctttcaccaagcataatgtttttgaaattcatcatctatgatgatgtgtgcctattgagttaaccttttcnngcacatgccgcctgcca

SEQ ID NO: 19670 - DNA, 138 bp, Homo sapiens
  misc_feature 16: k=g or t
  misc_feature 107: m=a or c
  misc_feature 114: k=g or t
  misc_feature 115: d=a or g or t
tgtaattaatctatgkggctacgccatgccatgcctgtgactggtggtggggggtcaggagtctgaacaaactgtgtgctaaaaatggggagagagagaaggaaggmaagagakdaagagagagagaggtgggtactt

SEQ ID NO: 19671 - DNA, 192 bp, Homo sapiens
cttttctttgttttttgtctaacttttattttaggttcagtggtacatgtacaggtttattatataggtttattatataggtgtattatctgtacacttgcaccacaggggtttggtgtacagataattttgttgcccatgcactaagcatagaaccgaataggtatttttttaaattatctccccactcct

SEQ ID NO: 19672 - DNA, 134 bp, Homo sapiens
gtgctgctgaaacagaataccacagactgagtaatttacaaaagacagacttatttctcacagttctggagactgtgaagttcgaagtcccagtgtctgcatctagcaaggaacttctttccgtatcttccatt

SEQ ID NO: 19673 - DNA, 108 bp, Homo sapiens
ggacacaaacaaatggaagaacattccatgctcatggataggaagaatcaatatcatgaaaatggccatactgcccaaggtaatttatacattcaatgccatcccccc

SEQ ID NO: 19674 - DNA, 305 bp, Homo sapiens
cagaaagtccttcatgtggctgggcacagtggctcacgcctgggatcccagcactttgggaggccaaggtgggtgggtcgcctgaagtcgggagtacaagaccagcctggccaacgtggtgaaagctccgtctctgctaaaaatgcaaaaaattggctgggcttggtggcatacacctgtggtcccatctactcgggaggctgaggggggagaattgcttgagcccgggaggcggaggttgtagtgcgccgagattgtgcccttgcattccagcctgggcaggagagtgagactccgtctcaaaa

SEQ ID NO: 19675 - DNA, 349 bp, Homo sapiens
  misc_feature 137: w=a or t
  misc_feature 139: w=a or t
  misc_feature 160: w=a or t
  misc_feature 269: k=g or t
  misc_feature 300: d=a or g or t
  misc_feature 301: w=a or t
  misc_feature 302: k=g or t
  misc_feature 303: n=a, g, c or t
caaagaaaattaatctatatttactttgaactactcatatatttggaactctttctacttctcattttctatattctatttatcatcccttttcttcatttaaattttttttttttacttttttaaactatcctttwgwtgaactgattaagttttcaawattctcttttgcccttctgctgctttgagagctataatggtttgtatttccattattttagttaaatcttttcagtttttttcattacatatatttaattatacatttkgctagaagagtctgaattacttaatattttdwknttcctcttgaacatgaagagggccttaacatattataccttcccac

SEQ ID NO: 19676 - DNA, 126 bp, Homo sapiens
aagtgtaagctcacactcaatgtgaggggccaaggagatgtactttgtagtgagttcttttaaatctaagtaaatatttactttcacgcctaatgttgtatttatattttatagaaaccctccctt

SEQ ID NO: 19677 - DNA, 95 bp, Homo sapiens
ctcagcctctccttagcgctcatccaacatactatcttttttaaaagatttattattattacttttttgactcagggtctcactctgtgtccagt

SEQ ID NO: 19678 - DNA, 142 bp, Homo sapiens
ctttaagttttagggtatatgtgcacattgtgcaggttagttacatatgtatacatgtgccatgctggtgcgctgcacccactaacttgtcatctagcattaggtatacctcccaatgctatccctccctcatacccctcac

SEQ ID NO: 19679 - DNA, 202 bp, Homo sapiens
taacaaggggctaagaaaaaaataggaatatgccatctgtgtgccagctggaaaaacaggttccagttgcagggactttatagattgggaaagtctacaactagggaagctggaaaagaagatagctgcagtagtttaagtcaggtatggatattggtgagggtttatttgcaaaaaactaaatccattcttagtaaaggca

SEQ ID NO: 19680 - DNA, 51 bp, Homo sapiens
attatagcatgtatcaaaaaatttccttccttttttttttttttttttttt

SEQ ID NO: 19681 - DNA, 191 bp, Homo sapiens
ttcttttttttggtattctttttttttattatactttaaattctagggtacatgtgcacaacgtgcaggtttgtttcatatgtatacatgtgccatgtcggtgtgctgctcccattaactcgtcatttacatttggtatatctcctaatgctatccttcccccctgcccccactccatgacaggccccggt

SEQ ID NO: 19682 - DNA, 108 bp, Homo sapiens
  misc_feature 55: k=g or t
  misc_feature 84: w=a or t
  misc_feature 92: k=g or t
cactcaagcctgggcaacagagtgaggccccatctctttcattaaaaaaaaaaaktagggtcgggtgtggtggctcatgcctgwaatcccaktactttgggaggccga

SEQ ID NO: 19683 - DNA, 158 bp, Homo sapiens
ttttagtagagacggggtttccccatgttggtcaggctggtctcgaactcctgaccttgtgatttgcctgcctgggcctcccaaagtgctgggattacaggcatgagccaccatgcccggcctaaactttgtttttaaaatgaactttttttcccccc

SEQ ID NO: 19684 - DNA, 138 bp, Homo sapiens
cggtgaaaccccgtctctactaaaaaaaataaaaaaaaaatagctgggcatggtggtaggtgcctgtagtcccagctactctggagtgcagtggcatgatctcggctcactgcaagctccgcctccgggttcgcgtca

SEQ ID NO: 19685 - DNA, 154 bp, Homo sapiens
  misc_feature 149: h=a or c or t
ccaaaggggcaggtgcagaaggctgtcaccctgaccctccactgacctattaacacttagccatccatggatggcagagctaaaagagcactaactttaacataccactagatgctgccatggggccacagcccaaaagtgctgatcchggccc

SEQ ID NO: 19686 - DNA, 151 bp, Homo sapiens
tctgggctgtacttgagtatggaaattctcttatagacttagttttagtactctattacacctttactaagccacataaaagtaatctgtttgtgtgtaactgccagatataccacctggaattccaagtaagataaggaagaggatgacc

SEQ ID NO: 19687 - DNA, 199 bp, Homo sapiens
  misc_feature 165: n=a, g, c or t
gagctctgtgctggctgtgagccgcctcccggcccctctccgcagccgccctccagccctcccagcctggcgctggacggagcctttgggaacaagggggagaaatgccagaacttgatcttagaagctaatcaagcttcttgtgactttcaagttcaagatggnatcttagaatagggggattttttttttttttaaa

SEQ ID NO: 19688 - DNA, 240 bp, Homo sapiens
  misc_feature 125: r=a or g
  misc_feature 126: r=a or g
  misc_feature 129: w=a or t
  misc_feature 149: k=g or t
  misc_feature 156: v=a or c or g
ttctagcgaacttactgctttaaagcaggaatggatgtcaaaaagaaatcagactgggcgtggtggctcatgcctgtaatctcaatactttgtgaggccaaggcgggcggatcacctgaggtcarrggwttgagaccagcctgaccaakatgatgvaaccccatctctactaaaaatacaaaaattagctgggcgtagtggcatgcgcctgtaatcccagctacttgggagactgaggct

SEQ ID NO: 19689 - DNA, 306 bp, Homo sapiens
ctagtttatttgcatagaggtgtttgtagtattctctgatggcagtttatatttctgtgggattggtggtcatatcccctttatcattttttattgcatctatctgattcttctctctttttttctgcattagtcttgctagcagtctatcaatttgttgatcctttcaaaaaactagctcctggattcattaatttttttgaaggttttttatgtcactatttctttcagttgttctctgattttagctatttcttatcttctgctagcttttgaatgtgttttctcttgcttttctagttctat

SEQ ID NO: 19690 - DNA, 65 bp, Homo sapiens
  misc_feature 5: m=a or c
  misc_feature 9: w=a or t
gcggmggtwgcggtgatacaagatcgcgccattgtactccagcctgggcaacaagagcaaaactt

SEQ ID NO: 19691 - DNA, 254 bp, Homo sapiens
  misc_feature 220: m=a or c
  misc_feature 221: m=a or c
gaggccgaggcaggtggatcacaaggtcagaaaatcgagaccatcctggctaatgcgttaaaacccagtctctactaaaaatactaaaattagctgggcatcgtggccacaacacaatctcttgaacctgggagacggagattgcagtgagcagagattgcaccactgcattccaacctgggcaacagagctagatcatgtcccaataaataaataaatmmgaaaatattgagactgcttttttcctgaattaa

SEQ ID NO: 19692 - DNA, 54 bp, Homo sapiens
ccaagttatgagtggttgggtgctcacctggaggtgaatgactttttttttttt

SEQ ID NO: 19693 - DNA, 128 bp, Homo sapiens
tctgttgcctaggctagagggcagtggcgccattttggctcactgcagcctccgccttctgggttcatgcaattctcctgcttcagcctcctgagtagctgggattacaggcacccgccaccacacca

SEQ ID NO: 19694 - DNA, 439 bp, Homo sapiens
  misc_feature 260: d=a or g or t
  misc_feature 261: s=g or c
  misc_feature 262: k=g or t
  misc_feature 380: n=a, g, c or t
  misc_feature 401: w=a or t
cctgtaatcccagttcctcaggtggtggagacaggagaatcacttgaacccagggggtggaggctgcagtgtgctgagattgtgcactgcactccagcctgggcaaaaaaacaaacaaacaaacaaaaaaccctcttataaatcacatacccaaaagaggtaggaaacttagaatccaaatatcatattcagtctatgccttaatttcatccaaattttggatgctatttcatatgcctccagtactacagttgatcttdskcaagatgtattaataaaaacaggtacatccatatccaagagctctcaaatcaaaataaaagttccattcatttactggaactgcacgtcagaaacgtgaaagtagattctaggttggncgcggtggctcacgcctgtawtcccagcactttgggaggccaaggtgggcagatcacga

SEQ ID NO: 19695 - DNA, 110 bp, Homo sapiens
tcaatttgctattgagtcagtatgtatgtatgtatgtcttttttaaggaattagcatttattgagtattatatcttacactcttgacatgcattcttttttttttttttt

SEQ ID NO: 19696 - DNA, 158 bp, Homo sapiens
tatttttagtagagatgggatatcaccatgttggccaggctggcctcgaactcctgacctcaagtgattggcctgccttggcctccgaaagtgctaggattacaggcatgagccaccacgctggccccttgtaggtttagaatcctctcaatcagttc

SEQ ID NO: 19697 - DNA, 82 bp, Homo sapiens
  misc_feature 13: y=c or t
  misc_feature 20: y=c or t
  misc_feature 59: b=c or g or t
tttttttgtggtyctttggytagaaagtgcaaatttctctagggaccattgttgctttbgtttttgtttgtctgcacccgta

SEQ ID NO: 19698 - DNA, 84 bp, Homo sapiens
ccatcctggctaacacagtgaaaccccgtctctagttcttttagctgtgatgttagcttgccaattggagatgtttctggcttt

SEQ ID NO: 19699 - DNA, 158 bp, Homo sapiens
  misc_feature 15: r=a or g
  misc_feature 16: k=g or t
tatttctcaggtggrkggttatttagttaaggtgagaagtagagccaggcacggtggcctgtgcctttggtctcagctacttaggaagctaaggagagacttgagcccaggagtttgacaccagctttggcaatatagggagaccccgtctcgaaaaa

SEQ ID NO: 19700 - DNA, 157 bp, Homo sapiens
tttcagtgcatttgtgttttctagatttataatctttttcatttacttttatattttgattttaagataatggcacataacttttttccataccagatttcagtatatactaggttttaatgtgaatatttctgactcgttttattttagtgatttt

SEQ ID NO: 19701 - DNA, 310 bp, Homo sapiens
  misc_feature 207: d=a or g or t
gagatggagtttcgctcttgtcgcccaggctggagtgcagtggcatgatcttggttcactgcaacctctgccttccagtttcaagtgattctcctttctcagcctcctgagtagctgggattacaagcgcccaccaccatgcccggctgatttttgtatttttagtagagacgggatttcaccatgttggccaggccagtctcgagdctcctgggctcaagtgatcctctcatctcagcctcctagaatgctgggattacaggcataaatcaccatgcttggcgctcttgtcttgtctgtctgtccctcc

SEQ ID NO: 19702 - DNA, 119 bp, Homo sapiens
cttgaatttctggtattggcctctgagcaaagaaaaagagctcaatatggttttctacacttcttttacatactgaaaaatctctttccatatagttacatcatgttattgcaccccac

SEQ ID NO: 19703 - DNA, 255 bp, Homo sapiens
  misc_feature 16: k=g or t
  misc_feature 17: r=a or g
cagaattatctatatkrtttttactagcattttcttttgattcgtattctctattaagacattgttctcatacttcagattttcttttttttaaattttattttgttattattatactttaagttttagggtacatgtgcacaatgtgcaggtttgttacatatgtatacatgtgccatgttggtgtactgcacccattaactcgtcatttagcgttaggtatatctcctaatgttatccctcccccctcccctt

SEQ ID NO: 19704 - DNA, 73 bp, Homo sapiens
ccccttttctccctttccgggtttggttcctcccttttcttcccctctcccccctccttcccaagccccgagt

SEQ ID NO: 19705 - DNA, 72 bp, Homo sapiens
  misc_feature 10: d=a or g or t
  misc_feature 11: w=a or t
agtgctgggdwtacaggtgtgagccaccatgcccggctgtcaaaataggtgttttgttgttttttttttttt

SEQ ID NO: 19706 - DNA, 276 bp, Homo sapiens
  misc_feature 68: n=a, g, c or t
tactgcccttatatgagatgaactgttttgattcaggcatgcaacgcacaataataacatcatggagnatggggtatccatcccttcaagcatttatcctttgttacagaccatccaattacactcttttaattaattttaaaatgtacaattaagttattattgcctacagtcaccctgctgtgctgtcaaatagtaggtcttattcatcctttctaactatgtttttttgtacccattaaccatccctgccttcccccacagctccccccaaac

SEQ ID NO: 19707 - DNA, 123 bp, Homo sapiens
caacaaagaatggacttaaactataccatagaacaaatggacttaacagatatttacagaatattccacccaacaactgcagaatatacattcttgtcagcacatggaacattctctaagata

SEQ ID NO: 19708 - DNA, 101 bp, Homo sapiens
tcaatttgctattgagtcagtatgtatgtatgtatgtcttttttaaggaattagcatttattgagtattatatcttacactcttgacatgcattctttttt

SEQ ID NO: 19709 - DNA, 114 bp, Homo sapiens
  misc_feature 31: k=g or t
  misc_feature 33: d=a or g or t
  misc_feature 38: w=a or t
  misc_feature 40: d=a or g or t
  misc_feature 45: w=a or t
  misc_feature 48: b=c or g or t
  misc_feature 53: w=a or t
  misc_feature 54: d=a or g or t
  misc_feature 73: n=a, g, c or t
tcatttctaattgtatctatttggatcttckcdctttwcdtcttwatbcgtcwdgtagtggtctattgatttngttgatcttttcaaaaaaccacctcctggattcattgattt

SEQ ID NO: 19710 - DNA, 157 bp, Homo sapiens
tttatgtctacttgttttggatgaaacacattgggattttctgaagttctgttttataaaatacgtagtatattcactttgtttggtagttggtttagtgctaccttgtagttttaagagaagataggaaatgctcctacccagtctctagcaccac

SEQ ID NO: 19711 - DNA, 190 bp, Homo sapiens
  misc_feature 176: m=a or c
  misc_feature 178: d=a or g or t
  misc_feature 179: v=a or c or g
ctctgtttcccaggctagagtgcagtgacatgatcttggctcactgcaaactccgcctcccgggttcaagagattctcctgcctcagcctctgagcagctgggattacaggtgcccgccaccgtgcccggctaatttttgtattttttagtagagatggggtttcaccaccttggmcdvgcgcggtggct

SEQ ID NO: 19712 - DNA, 157 bp, Homo sapiens; identical to SEQ ID NO: 18479

SEQ ID NO: 19713 - DNA, 154 bp, Homo sapiens
  misc_feature 15: w=a or t
tcatggtatgggtawggatggtttgagcacccactcacctgctcatgggcatctagacttttccagttgttggttattgataataaagctacgatgagcattagcatgtaagtctctgtgcggacagatgttttcttttctttttttttttttt

SEQ ID NO: 19714 - DNA, 237 bp, Homo sapiens
  misc_feature 16: r=a or g
ccaaccttgcatcccrggactaaagcctaattgatcatagttcattagctttttaatttgctgctggatttgctttgccagtattttgttgaggatttttgaagcaacattcgtcaatgatattggcgtgaagttttcttttttgttttgtttctatcaggttttggtgtcagaatgatgttgttcttacataatgagttaagggttaagggggagtcccttcttttcaatttttaa

SEQ ID NO: 19715 - DNA, 90 bp, Homo sapiens
tgttgatgcattggttttgagcagacagagtttcagtctggatgtgttgagtctgagatcatggtgctatttcttttttttttttttttt

SEQ ID NO: 19716 - DNA, 266 bp, Homo sapiens
  misc_feature 223: k=g or t
  misc_feature 224: k=g or t
ttttttctcagaattgttttggctattcggggtctttcatgggtccatacaattttaggattgtttatttttatttctgtgaagaatgccattaggattttgagatggattgcattgagtctgtatattgctttgggtaatgtgaacatctaaaaaatattaattcttccaatccatgaactcagggatatgttttcatttgtgttttttttcctaatttctkkcatcaatgttttatagttttcagtgtatacatggtccccact

SEQ ID NO: 19717 - DNA, 73 bp, Homo sapiens
  misc_feature 31: r=a or g
  misc_feature 32: r=a or g
  misc_feature 41: r=a or g
  misc_feature 42: r=a or g
ggcgggaggagggaatgcgcgtgcgcgctgrraccgcctcrrtcccgttccgtcccaatcattgtaaacaggc

SEQ ID NO: 19718 - DNA, 219 bp, Homo sapiens
  misc_feature 203: s=g or c
  misc_feature 204: s=g or c
gttctgcctcctgggttcacgccattctcctgcctcagcctccccagtagctgggactacaggcgcccgccaccacacctggctaattttttgtatttttagtagagacggggtttcaccatgttagccagaatggtcttgatctcctgaccgcgtgatccacccgcctcggcctcccaaagtgcttggattacaagcgtgasscaccgcacccggcct

SEQ ID NO: 19719 - DNA, 185 bp, Homo sapiens
catataccagacatacacttccaaaaactattagaaaatattaacttagggctaagagttctgttaagttgtggattttttaattttaatttttattttactctaagttccggaatacatgggcagaacatgcaggtttgttgcataagtatacatgtgccatggcggtttgctgcacccatcac

SEQ ID NO: 19720 - DNA, 202 bp, Homo sapiens
cattatatttgtaccacttaaaaaaggaaaagcgctgccattaaactaaaatataccatcatttgtaagaatcttcttaatttcagaggtgctaacatgtaaaaagatgtgtatcttagaattgatgacatcataataatactttgataggattgttgtaaggattaagtgactcaacatttataaagaacttagaacagtc

SEQ ID NO: 19721 - DNA, 114 bp, Homo sapiens
  misc_feature 39: m=a or c
  misc_feature 51: m=a or c
  misc_feature 52: m=a or c
aggctcggagaaacaggcgccgcgggctccgcgcccggmcggacccgggcmmgagatcatgatgctgccgccaccgccgccaccacggagcgagaagcccagatagacgcccaa

SEQ ID NO: 19722 - DNA, 193 bp, Homo sapiens
  misc_feature 40: y=c or t
  misc_feature 139: k=g or t
tatttttagtagagacagggtttcaccatgttggccaggytgttctcacacttctgacctcaggtgatccgcccgtctcagcctcccaaagtgctggaattacaggcatgagccaccacacccagccaatttactgtckctttatccaatccccattattccttaaccacctagggtcatgtcattggacctt

SEQ ID NO: 19723 - DNA, 148 bp, Homo sapiens
  misc_feature 15: s=g or c
  misc_feature 16: k=g or t
  misc_feature 98: r=a or g
  misc_feature 108: r=a or g
  misc_feature 128: w=a or t
  misc_feature 130: m=a or c
  misc_feature 131: w=a or t
ctgagtagatgggaskacaggtgtgcatcaccatgcctagctaattatttatttatttttaattttttatagagacggggtcttgctatgttgcccargtggatctaragctcttggccttaagcgawcmwcctaccttggcctcgac

SEQ ID NO: 19724 - DNA, 217 bp, Homo sapiens
tagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggtgacagagccagactccgtctcaaaaaaaaaaaaaaaaaaaaaaa

SEQ ID NO: 19725 - DNA, 107 bp, Homo sapiens
tcagcctcccaaagtgctgggattacagacatgagccaccgcacccggcctgattttttcttaaataaacttcttctcattaaagttctgcatcctttccctccaca

SEQ ID NO: 19726 - DNA, 302 bp, Homo sapiens
  misc_feature 144: r=a or g
  misc_feature 190: n=a, g, c or t
  misc_feature 239: k=g or t
  misc_feature 254: d=a or g or t
attctgtctaataagtctattattaaaataatatattaagtcattaaatttcaggttataattttcaaactcagagtttttctttgtctcttttatagatttcagttttctagtggaattccctatttgtcttctatttttttrtatgtattcatcataagtatttttaaatctctatccaataatcacngtatctcaatagtatatttctactgtcagtttgtctcttgacatttggkaatcagcatttaagdaacttttttattgaatggcagacatttgtttcaaactttgaaaagctc

SEQ ID NO: 19727 - DNA, 112 bp, Homo sapiens
  misc_feature 103: n=a, g, c or t
  misc_feature 104: s=g or c
gtttgttacatatgtatacatgtgccatgcttgtgcgctgcacccactaactcatcatctagcattaggtgtatctcctgatgctatccctcccccctccccnsacccccct

SEQ ID NO: 19728 - DNA, 249 bp, Homo sapiens
  misc_feature 27: k=g or t
  misc_feature 101: w=a or t
  misc_feature 103: k=g or t
  misc_feature 242: s=g or c
ttgggaccagcacctggcttgtaaatkatttgtttcagttattttgcttaaatacattattttatttattcttttcaatatttcttttctacatatttctwtktttgagatggagcctcactctgttgcccaggctggagtgcagtggtgcgatcttggctcactgcaacttctgcctcctgggttcaagcaattctcctgcctcagcctcccaagtagctgggattacaggcgcccaccasacccccc

SEQ ID NO: 19729 - DNA, 114 bp, Homo sapiens
  misc_feature 36: n=a, g, c or t
gcctgaccaacatggagaaatcccatctctactaanaaaaaattgtggaacctgagacttaacatagctaacttcttacaccttaaaatgttattcatttatcttttttttttt

SEQ ID NO: 19730 - DNA, 234 bp, Homo sapiens
tcactagttaaatggaaatgtggatgaatctgaacagctaacctaagccgatgtattttattcatcgtagtaaatatagtataggtaaatataaacagggagcttgttattctcattccaataaattgaaagattaattttttgcttttttttctttgagacagggtctcactctcttgcccaggcttgcccttcaccactgcaaaacttgaacgctgacactctgcctccact

SEQ ID NO: 19731 - DNA, 115 bp, Homo sapiens
ttctcctttcatatacgttaacttgccactaagtttttaattgaataactagatttattgattatttggtaaatctacgtgtacttttaaaaatactcttttttttttttttttt

SEQ ID NO: 19732 - DNA, 130 bp, Homo sapiens
  misc_feature 99: r=a or g
  misc_feature 114: r=a or g
tgttctgacttgctgagtttactcagcagccttatgctggctctgccactgcacaataaaaccaaagcaggacagttgcaggtcaagcaagggggaacrtgttttgcatttagrgagtttgaccacaccc

SEQ ID NO: 19733 - DNA, 116 bp, Homo sapiens
cgggcgcagagtcccttcctaggccagatccgcgccgccttttcccgcggcccgcacggggcccagctgacgggccgcgttgtttacgggcccgagcagccctctctcccaccgcc

SEQ ID NO: 19734 - DNA, 84 bp, Homo sapiens
gtgattctcctgcctcagcctcctgagcaactgggaccacagatgcacgccaccatgaccggctaattttttttttttaaatct

SEQ ID NO: 19735 - DNA, 95 bp, Homo sapiens
tcattagtcaaaatagtcacagagatccatctaggttcaagggaggaacataaactgcacctttttctttctttctttttttctctttttctttt

SEQ ID NO: 19736 - DNA, 342 bp, Homo sapiens
ttaaatgcagtagtccaggtgggggcaatggagagggagagaagtgggctcatttagaaaatatttgggagatgaaatatgatgaggtttagtccctgattgggtctgaaagtgagaggaaaaggagtcaaggatgacttccagggtttctagcttgagcaaacaggataacaaacatggaggaaggtcaaattaggagggggaatgtgaatttggatttgtacattttgagtttgagttacctgtgagataccgggtagcaggtggagccctggagacttgggagttggtcgtaaatgttactgaggtcgtagaagtgattgagattgcgcagggaggaaa

SEQ ID NO: 19737 - DNA, 179 bp, Homo sapiens
  misc_feature 136: w=a or t
  misc_feature 137: n=a, g, c or t
  misc_feature 138: d=a or g or t
  misc_feature 145: h=a or c or t
  misc_feature 149: k=g or t
  misc_feature 151: h=a or c or t
aattttttataataattaacaagtgaaaagtctcagattgtgagaataaagaagcaaccaactattttctatctgtgcatctatacttgctgatagatgcatggagtacaggtgtctgtgagttagtggaatctcwndattccthccakghgaagcgtttggtattttaaagtggatat

SEQ ID NO: 19738 - DNA, 163 bp, Homo sapiens
  misc_feature 148: w=a or t
  misc_feature 149: w=a or t
attaacctttttttcttttttattatacttttaagttttagggtatatgtgcacaacgtgcaggtttgttacatatgtatacatgtgccatgttggtgtgctgcacccattaactcgtcatttagcattagatatatctcctaatgcwwtctctccctcctct

SEQ ID NO: 19739 - DNA, 231 bp, Homo sapiens
  misc_feature 147: w=a or t
  misc_feature 156: r=a or g
  misc_feature 165: r=a or g
  misc_feature 166: w=a or t
  misc_feature 170: w=a or t
  misc_feature 198: k=g or t
  misc_feature 200: r=a or g
  misc_feature 206: k=g or t
accatgctgttttggctagtatagctctgtagtataatttgaagtcaggttatttgattcttctaattttctccttttgctttggattgctttggctattcaggctctttttttggttccatatgaacgttagaatacggttttctwattctgtgraaaatgatrwtggwagtttgataggaatagtgttgaatctakarattgckttgggcagtatgaccattttaatga

SEQ ID NO: 19740 - DNA, 88 bp, Homo sapiens
  misc_feature 64: s=g or c
  misc_feature 67: r=a or g
  misc_feature 70: w=a or t
  misc_feature 72: d=a or g or t
gcgcatgctcgggggaggcggattccgggtccggagttggaggctttgggcggccgcggcgtasgcrcgwtdccggggccggcgggga

SEQ ID NO: 19741 - DNA, 102 bp, Homo sapiens
cttatccataagagctttgcttgcaaataccaccacaaagatggttacctttctagccttctcagaaattctgttgtttgtgtgaccatctctttacccgcc

SEQ ID NO: 19742 - DNA, 314 bp, Homo sapiens
cctcctgggttcaagtgtttctcctgcctcagcctcctgagtagctgggattacaggtgtgtgccacccccggataatttttgtatttttagtagagatggggtttcaccatgttggtcaggctggtctcgaactcctgacatcgtgatccacccgcctcgacctcccaaagtgctgggattataggcgtgagcaacctcgcccagccgcatccgatatttttagaacttacactgttcagtacaggagttagcagtggttaaaacacaaactttggaaagagttatgatatctaaagttacagagctagcaaa

SEQ ID NO: 19743 - DNA, 158 bp, Homo sapiens
caaatgcatcagtttgataccaccatcatactttttgccatatctgtgtattttctttaaatcgactcattttttttttaattttttttgagattgagtattgctcttgttgcccaggctggactgcaatggcatgatcttgggtcactgcaacctcc

SEQ ID NO: 19744 - DNA, 134 bp, Homo sapiens
gttcaagcgattctcctgcctcagcctcctgattagctgggattacaggcatgggccaccgtgcctggctgatgtttgtacttttagtagagacggtgtttttccatgttggtcaggctggtctcccactcccc

SEQ ID NO: 19745 - DNA, 50 bp, Homo sapiens
  misc_feature 14: s=g or c
  misc_feature 15: y=c or t
  misc_feature 38: s=g or c
gtagaggtggtgtsygtgtggtagagtgtgtgtggtasaggtgtgtgtgt

SEQ ID NO: 19746 - DNA, 84 bp, Homo sapiens
ctttcaaacaaatctaatgctgttacgtctagaatgccacatgcccatcctttctgtcatcaacctggaaaagaacaacaaaca

SEQ ID NO: 19747 - DNA, 172 bp, Homo sapiens
  misc_feature 102: s=g or c
  misc_feature 124: k=g or t
  misc_feature 149: w=a or t
aaaaaaataagaaagagaaaatattcaacttttacaagatggaatgaaacaaagattgactgcaattggagtaaatacttctatttgacattttttaaaaascacagaaaatctttaaaatgtkgtgtaaagtttctgcctggtgcggwgactcacgcctgtaatcccggct

SEQ ID NO: 19748 - DNA, 117 bp, Homo sapiens
ttttccaatttataaatttttgcttttgtgggtcacaagtttggtgtcaagtctaaggacatttcgactagccctgtaacccagtgattttccttcttttttttttttttttttttt

SEQ ID NO: 19749 - DNA, 106 bp, Homo sapiens; identical to SEQ ID NO: 18247

SEQ ID NO: 19750 - DNA, 297 bp, Homo sapiens
  misc_feature 240: b=c or g or t
  misc_feature 260: k=g or t
  misc_feature 261: n=a, g, c or t
gggccttgaaattcccatcagagttatatatgtggatttataaagtgcagtctgagcccccgtgatcacaaaatggcaaatgattttgtcctcgggggcctggtgtctctgatgggtactcagtagtaggagtgtctattcccttagggaggagggtggacctcagtggatccatggacttggtcccaagatcgttagagatgttagatttgtcccttagaagatcacttctatatatcbgaggctgtgactcatgcctkntaatcccagtactttgggaggctgaggtgggcgcac

SEQ ID NO: 19751 - DNA, 166 bp, Homo sapiens
tggaggaggaacatggggaggagcgtaatgtatcttaatttgggagtagttaacagtcttaaaccaagccttgagatgtatctttgaagctgaagctgggaatacactagggtgagggaagtgggaaccagccctgcaaagtatggatttcaatggcacaccgccc

SEQ ID NO: 19752 - DNA, 81 bp, Homo sapiens
  misc_feature 75: k=g or t
tgccttagtgcatgacttgaattagtttcctatatgttactatatttttatttatttattttgattttgattttktttttt

SEQ ID NO: 19753 - DNA, 286 bp, Homo sapiens
  misc_feature 263: v=a or c or g
  misc_feature 264: d=a or g or t
gaatacaaacttataatttatttcttatctaaatttaaaaagcagaggcgaatacctcctaaggaaacaatacctaaaaaaacaaagccatgtggagagcataaagaatgaatttgttggttattatacctcgcatttgctgatggacattgctatatgtgtgtgtgtctgtacagatacgtacaaatatgtgtatgtacattcccattaaactcatgagtgtagctgcataatagagtaaggcctcagccttgtggaatttvdagatgtctccctccccctgtaa

SEQ ID NO: 19754 - DNA, 259 bp, Homo sapiens; identical to SEQ ID NO: 17311

SEQ ID NO: 19755 - DNA, 415 bp, Homo sapiens
  misc_feature 317: h=a or c or t
  misc_feature 318: b=c or g or t
  misc_feature 319: w=a or t
atttatccatttcctctagagtttctagtctgtgcatgtaaaggtgttcatagcagccttgaatgatcttttgtatttctgaggcattgattgtaatgtctccagtttcatttctaattgagcttatttggatcttctctcttcttttcttggttaatctcactaatggtctatgaattttctttatcttttcaaagaaccagctttttgtttcatttttatctttttttgtttgtttgtttgaggtctttttaaaatagtttctatttctctgcagagacatcctatttttccattcattccacatcatttccathbwttcaaatgtgtttactttgacctcatggatcatagttatagtagatgctttaaagtcttctataattcacatctttttgggattcacatctttttt

SEQ ID NO: 19756 - DNA, 232 bp, Homo sapiens
  misc_feature 134: k=g or t
  misc_feature 150: k=g or t
  misc_feature 223: n=a, g, c or t
tctgtaatcccagcactttgggaggccgaggcaggcggatcacttgaggtcagcagtttgagaccagcctgggcaacatggggaaaccccttctctactaaaaatacaaaaattagctcagcatggtggcacgkgcctgtaatcacggckactcaggaggctaaggtaggagaatcgcttgaaccctggaggtggaggctgagtgcgccaccgcactccagcntgggggaca

SEQ ID NO: 19757 - DNA, 126 bp, Homo sapiens
ctgtccattcccacccctttccccccagcatctggtaaccaccattctactctctacttctaggagttaaactcttttagagtccagataaaagtgagatcatatggtttctgtctctctgtgcct

SEQ ID NO: 19758 - DNA, 171 bp, Homo sapiens
ctcagttctttttagtattgaataatatttttaaacaaaaaacaaatgatcatctcaattgatatgggttggctgtgtccccacccaaatctcaacttgaattgcagctcccataattcccacatgttgtgggagggaccttgtgggagataattgaatcatgggggcagt

SEQ ID NO: 19759 - DNA, 79 bp, Homo sapiens
aaatggactttcgctctgtcacccacgctggagtgcactggcgcaatctaggctcattgcaacctccacctcccgggta

SEQ ID NO: 19760 - DNA, 143 bp, Homo sapiens
  misc_feature 15: w=a or t
  misc_feature 128: v=a or c or g
  misc_feature 137: w=a or t
  misc_feature 138: k=g or t
atggcctggggagawggggctgtgtgctccattccaggatcaagactttgtagaaatcatgttttctagatggttgtgggctgttgtcagcagaaggactcaaggcaattaacatacagctaatgaavctccaaagwkgcacc

SEQ ID NO: 19761 - DNA, 109 bp, Homo sapiens
  misc_feature 69: k=g or t
ttctcctgcctcagcctgctgagtagctgaaattacaggtgcacaccaccacgcccagctaatttttgkattttttgtagagacagggtttcaccatgttggtcaggct

SEQ ID NO: 19762 - DNA, 150 bp, Homo sapiens
agttggttctttgaaaaaactaaaaaaacaaactaagctctggcaaattaaatgaaagaggtcaaatatcccctaccagaaatttaaaatggaacataaagttaaatacagcagaagttttaaaaggcagagaggatataatgtactttt

SEQ ID NO: 19763 - DNA, 146 bp, Homo sapiens
  misc_feature 55: m=a or c
  misc_feature 56: m=a or c
cttgtggttcataaactaagagaccttcatgcctgtagagattggggagactggmmagtttgagtgagtcaagagtgctagaatgatttccccatcaaaagggcatgacccctggccccaagcttgtacagcagcatctgcccctc

SEQ ID NO: 19764 - DNA, 120 bp, Homo sapiens
  misc_feature 41: y=c or t
taattgttttatttactcagtcagatttcaactccctcaayttctgaatgactcccttgctgggagtcaggttctcagttattattacaaaatttaataatggaacagttccatatgcat

SEQ ID NO: 19765 - DNA, 151 bp, Homo sapiens
  misc_feature 108: y=c or t
  misc_feature 123: s=g or c
  misc_feature 125: r=a or g
  misc_feature 131: r=a or g
  misc_feature 135: w=a or t
  misc_feature 137: d=a or g or t
  misc_feature 138: k=g or t
aaaattagccgggcgtagtggcgggtgcctgtagtcccagctacttgggaggctgaggcaggagaatggcatgaaccccggaggcggagcttgcagtgagccaagatygcgccactggactcsarcctggrgggwcdkaggtgatactcca

SEQ ID NO: 19766 - DNA, 168 bp, Homo sapiens
  misc_feature 120: r=a or g
  misc_feature 142: s=g or c
agaaaagccctggccagtggcgggcgcgacactatccgtgcggccaggcggagacccggaggaccgaagcttccggacgacgaggaaccgcccaacatggcctcggaggtggctgaggartggggccagggcaccttcaaastgaactccaatgatgaggacatccac

SEQ ID NO: 19767 - DNA, 100 bp, Homo sapiens
  misc_feature 27: k=g or t
  misc_feature 92: r=a or g
atcccttctctcttccttggtgcttckttttcctgctcggtgagtttgtttgtttgtttgtgtttgagacagagtctcactttgcttcccargctggagt

SEQ ID NO: 19768 - DNA, 51 bp, Homo sapiens
  misc_feature 7: m=a or c
  misc_feature 37: k=g or t
cacccgmtgcatcacacccacgggcacccaccccctkgcaaagaagctccc

SEQ ID NO: 19769 - DNA, 103 bp, Homo sapiens
  misc_feature 99: b=c or g or t
ttagtagagacaaggtgttacccaggatggtctcgatctcctgaccttgtgatccgcctgccttggcctcccaaagtgctaggattacaggcgtgagcbacgc

SEQ ID NO: 19770 - DNA, 91 bp, Homo sapiens
  misc_feature 16: s=g or c
cttttcaccatttttstatggggtgtcttttccttagaggagctgtttataaattagaaaggttagccctgtatgaaatgagtggtggctt

SEQ ID NO: 19771 - DNA, 278 bp, Homo sapiens
  misc_feature 115: r=a or g
  misc_feature 128: r=a or g
  misc_feature 129: d=a or g or t
  misc_feature 131: w=a or t
  misc_feature 140: w=a or t
  misc_feature 141: r=a or g
  misc_feature 144: k=g or t
  misc_feature 162: w=a or t
  misc_feature 216: k=g or t
  misc_feature 232: w=a or t
ttaggagagagactaatgtaagaatggacttgagatgggatgatcagggaaatataaatcaaaattgtaaatataaaaacaagaccagacatggcagctcatcctataatcccargcacttttgaggrdgwccaaggcgwrgakgattgcttgggcccaggwgactaaggctgcagtgaactgggattatgccactgctctccagcctgggaggckacaagaccctgtctcwaaaacaaacaaacaaaaaataccttttttgggtcaaaagccctcct

SEQ ID NO: 19772 - DNA, 333 bp, Homo sapiens
  misc_feature 113: d=a or g or t
  misc_feature 125: k=g or t
  misc_feature 298: k=g or t
  misc_feature 311: n=a, g, c or t
  misc_feature 312: n=a, g, c or t
tttattatactttaagttctggggtacatgtgcagaatgtgcagttttgttacataggtatacacgtgccatggtggtttgctgcacccatcaacccttcacctacattaggdtttctcctaaakgctatccctcccgttattaatttttaaattgttttattttataatttttaaagagcattgttgaggtatgactgacatagaaaaagcagcacatatttaaggtatacaacctaataagtgtggaggtaagtatatacctaggaaatcatcataactatcaataacataaacakgtccattacgtcnnaacgtttcctctccccccccc

SEQ ID NO: 19773 - DNA, 304 bp, Homo sapiens
catctttgcaattgtgagctgtgctgtgataaacatacatgagcaggtatctttttgatataatgacttattttcctttaggtcgattcccagtagtgagattgctggattgaatggtagatctacttttagttctttgaggaatttccatattgttttccaatggaggttgtactaattgacatcactaccagcagtgtataagtaatcctttttcactacctctacaccagcatttattgtttgtttttgggatttttttgtttttgtctttttataatggccattctggctaggaaaaggt

SEQ ID NO: 19774 - DNA, 210 bp, Homo sapiens
  misc_feature 150: m=a or c
  misc_feature 152: y=c or t
  misc_feature 156: w=a or t
  misc_feature 167: w=a or t
  misc_feature 199: k=g or t
tgttttttggagacagggtctcactctgttgcccaggctggagtgcagtggcacaatcagagctcactgcagcctcgacctcctgggctcaagcaatcctcccacctctgttccctgagtagctgaaaccacagaccattacctaagacmtytttwaaaaattagcwagatatggtggcacacgcctgtggtttcagckactcagggaac

SEQ ID NO: 19775 - DNA, 188 bp, Homo sapiens
  misc_feature 125: b=c or g or t
  misc_feature 126: r=a or g
  misc_feature 155: r=a or g
  misc_feature 167: b=c or g or t
tttttttgtagacagggtttcaccgtgttgcccagggtggtctcaaacccctgagatcaagcgatcctcccaccttggcctcccaaagtgctaggattataggtgtgagccactgcacccagctbrggctgagttttgaagcataggtgggcttraggcagttaagbagggcattcatgatgggggcc

SEQ ID NO: 19776 - DNA, 242 bp, Homo sapiens
  misc_feature 115: k=g or t
  misc_feature 143: k=g or t
  misc_feature 150: k=g or t
  misc_feature 151: d=a or g or t
  misc_feature 177: k=g or t
tattttctttatccagtctatcattgatgggcatttgggttggttccaattctttgctattgtaaatagtgcagcaataaacatacatgtgcatgtctcttaatcgtagaataakttataatcctttggggatatgcccagtkgggattkdctgggtcaaatggtatttctggttckagatccttaaggattcaccatactgtcttccacaatggttgaactaatttacactccccccaaca

SEQ ID NO: 19777 - DNA, 173 bp, Homo sapiens
  misc_feature 130: r=a or g
  misc_feature 138: k=g or t
  misc_feature 142: r=a or g
  misc_feature 147: m=a or c
  misc_feature 153: r=a or g
  misc_feature 155: w=a or t
  misc_feature 157: w=a or t
  misc_feature 161: r=a or g
  misc_feature 167: r=a or g
  misc_feature 172: m=a or c
ttatcctttcaattcctttgctaattaaattgctgaaaagtatacattggtaagaatagccactgtcaatggactgcaaacaaaactcgtttctgttattgatgataaaccatttcagagaaagaccagrctgagtckaaarggttmagattrawtwaccraagggraaggma

SEQ ID NO: 19778 - DNA, 103 bp, Homo sapiens
  misc_feature 43: k=g or t
  misc_feature 54: k=g or t
tattgattaaaataaaggagtgcaaaacagatacctgtttgtktcttctctcckcccctactccctccctcttcccctccccagccccctcctccaccccgct

SEQ ID NO: 19779 - DNA, 60 bp, Homo sapiens
  misc_feature 16: r=a or g
aaaaaaaaaaaaaaaraaaaaaaaaaaaaaaaaaaaaaaaaaaaaaaaaaaaaaaaaaaa

SEQ ID NO: 19780 - DNA, 103 bp, Homo sapiens
  misc_feature 36: k=g or t
  misc_feature 39: b=c or g or t
  misc_feature 42: k=g or t
  misc_feature 75: k=g or t
  misc_feature 78: y=c or t
  misc_feature 83: k=g or t
tttttattgtttattttttttttgggttggagtttkgcbctkgttgcccaggctggaggacaatgtcatgatctkggytcackgaaacctccacctccggggt

SEQ ID NO: 19781 - DNA, 61 bp, Homo sapiens
  misc_feature 15: y=c or t
  misc_feature 16: k=g or t
  misc_feature 30: w=a or t
  misc_feature 44: w=a or t
ctcttctgaggatcykgcaagatggcagawgtagagcagaagawgaagcggaccttccgca

SEQ ID NO: 19782 - DNA, 139 bp, Homo sapiens
  misc_feature 93: k=g or t
ggtagtggagatgtccggccggtctaagcgggagtctcgcggttccactcgcgggaagcgagcagtctgagtcgcggggcagctccggtcgcktcaagcgggagcagcgcgcgaggctgaggcaggagaatcacttgaa

SEQ ID NO: 19783 - DNA, 80 bp, Homo sapiens
  misc_feature 16: r=a or g
actggttctgtttgaratcaaaagtacttatttttatgatttttccaaaacaacaaccaccaccactaccaaaaaaaaaa

SEQ ID NO: 19784 - DNA, 290 bp, Homo sapiens
  misc_feature 125: w=a or t
  misc_feature 126: y=c or t
  misc_feature 131: w=a or t
  misc_feature 136: r=a or g
  misc_feature 140: r=a or g
  misc_feature 164: k=g or t
  misc_feature 207: k=g or t
  misc_feature 224: s=g or c
accctctttgttccttgttttctttgtaaggcagaatgtttaacccatattttccaagaactgtgtaggtgggttgctggggacaattgatttttagagaagtattatttctctggatgtagaawycaagwagcaragarttaatattgagcaagagtcctcckgaggaccaggcctgggctaattatggtgatagttgttgcaatktgtttggaccatcatasagtataagaacaccacttccccccaagatgtgcaggacacaggatactccccagggccttgctcta

SEQ ID NO: 19785 - DNA, 166 bp, Homo sapiens
  misc_feature 130: w=a or t
  misc_feature 141: w=a or t
  misc_feature 154: d=a or g or t
taaatgaaacttctcaggataaattgtgatcatctagtttattcactcatgaaacaaatacttgcatccttcttttatacaaagtcctgtgttagttgtgggaatggagagaagagaatgtatctaaggwggcagagcagwcagattttggcadctgattagatat

SEQ ID NO: 19786 - DNA, 191 bp, Homo sapiens
  misc_feature 14: r=a or g
  misc_feature 133: y=c or t
ctaacagggtgaarccctttctctactaaaaacacaaaaattagctgggcgtagtggcaggtgcctgtaatcccagctacttgggaggctgaggcaggagaatcgtttgaacctgggaggcagaggttgcagygagccgggatttgcaccaatgcactccagcctgggtaacagagcgagactccatctga

SEQ ID NO: 19787 - DNA, 135 bp, Homo sapiens
  misc_feature 15: y=c or t
  misc_feature 95: n=a, g, c or t
  misc_feature 96: r=a or g
  misc_feature 117: b=c or g or t
ttcggaaatgggagyacagtactgggaaatgggagctcacagcactgggaaatggagcatagcattgggaaatgggagcacagtactgggaaatnraagctcacagtcctgggaaabgggagcatagtgctggga

SEQ ID NO: 19788 - DNA, 152 bp, Homo sapiens
  misc_feature 97: r=a or g
tatgtatatattctataatgattaccacaatcaaaatgacacatctgtcaccactcatgctgtacattagatcctcagaactaatcttataactgaragtttgtaccgtttgaccaacatctccccatttcccctgctttcccagccccctc

SEQ ID NO: 19789 - DNA, 249 bp, Homo sapiens
  misc_feature 171: k=g or t
  misc_feature 172: n=a, g, c or t
cccaatgttcctgccaccctcctcagtccttttttgtgtgggaggggatccttttctctctttccagattctatctctttcataaaaatcccctttttctttctgagtgaacctctatttgaaatcacccaccaaaaagatggcattgtgaggagtcatattcagtttttknaagaattttatatatcctagaactgtattgctaagaagagttggtttttcagttaagaaaaatccctgccccacacc

SEQ ID NO: 19790 - DNA, 75 bp, Homo sapiens
caataaattatcatcaaatcagtgtatctgactacagccccagggagtgggtttgttttgagaaggggccatgtt

SEQ ID NO: 19791 - DNA, 155 bp, Homo sapiens
  misc_feature 134: r=a or g
aataactgcaggatatacattattttatgcacttatgaaacatataacaacatagaccatatcctggaatataaaacaagcctcaacctgaaaaaataatcaaattcatacagtgttttaatattttcctgttrtatacctgttactgattctta

SEQ ID NO: 19792 - DNA, 81 bp, Homo sapiens
  misc_feature 68: k=g or t
agcagagaggaaacggcagagccagagagaaagaggaagagactgagtgtgaaggagagaggacacakgggatgactgaga

SEQ ID NO: 19793 - DNA, 78 bp, Homo sapiens
  misc_feature 16: s=g or c
  misc_feature 26: w=a or t
  misc_feature 27: r=a or g
agtctccagccctccstggagggcgwrttggaccagcccctgatgggcgcccgggagccacgggatggggcgtgatgc

SEQ ID NO: 19794 - DNA, 160 bp, Homo sapiens
cgaggtcaggagatggagaccatcctggctaacacagtgaaaccccatctctactaaaaatacaaaaaaattggccggacgtggtggcgggcacctgtggtcccagctactcgggaggctgaggcaggagatggtgtgagcccaggaggcagagcttgca

SEQ ID NO: 19795 - DNA, 132 bp, Homo sapiens
  misc_feature 112: d=a or g or t
cctcccgagtagctgggactacaggtacctgccaccacgcctggctaatttttggtagagatgaggtctcactatgttgcccaggctggtttcgaactcctgggctcaagcdatcctcctgcctcaacctcc

SEQ ID NO: 19796 - DNA, 126 bp, Homo sapiens
  misc_feature 110: s=g or c
tccatttgcagcccatggttgtcacatcacgctgtttataatgcccagcccctgcctgatctctcttcttcaatgtgctcatgtgtcccttggcttacagtatccatgcsttctccttctccctcc

SEQ ID NO: 19797 - DNA, 328 bp, Homo sapiens
  misc_feature 107: w=a or t
  misc_feature 111: m=a or c
  misc_feature 142: r=a or g
  misc_feature 143: r=a or g
  misc_feature 147: r=a or g
  misc_feature 148: b=c or g or t
  misc_feature 161: r=a or g
  misc_feature 192: r=a or g
  misc_feature 193: k=g or t
  misc_feature 309: w=a or t
ccttgggacaggtcgtttgcgtggttcatggctgagcttcagtcacgtgccaggtggcatttgggagagatggctctgatttttgcactcttcttttggggatttcwggcmccatcctagagcaggagatggtcaaggcaarrcgarbatagcatcactcrgctctgacatctgctaggaaaggcatgcagrkgtgctggtagcttgcactcttactcaaatgtgtgttccccagggaacaggagccattgtcctttcctgttgacctccagggcacatgccaggaggtgcctctgctggttgggagtwcttgacttaagataaatca

SEQ ID NO: 19798 - DNA, 64 bp, Homo sapiens
ctgtatttttagtagagacagggtttcgccatgttgtccgggctggtctcgaactcctgacctc

SEQ ID NO: 19799 - DNA, 220 bp, Homo sapiens
tacaagtgtgagccaccgtgcccggctagcctagggtatacttctaaaaggccacacaagtcctgtattttaaaaaatacaagtatttcagttttgtttgtttttctcttctggaaataaatgctacaagcgcatctactgcacgtacaaataaagttttaaaatcccaacttctttgcttggcatttaaggtgctacaagctatctttttttttttttt

SEQ ID NO: 19800 - DNA, 129 bp, Homo sapiens
tggtatttttagtagagacgggtggatcatttgaggtcaggagtttgagaccagcctggccaacatggtgaaactctgtctctactaaaaatacaaaaataaataaataaataaataaataaatgcaca

SEQ ID NO: 19801 - DNA, 273 bp, Homo sapiens
cattcattgcctcttttgctaaagttgtttcactgcataagaaaaagatactggtcgggctgggtgctgtgactcatgcctgtaatcccagcactttgggaggccgaggcaggaggatcacctgaggtcaggagtttcaggccagcctggccaacatggcaaaaccctgtctctactaaaaatacaaaattagccgggcatggtggcgcatgactataattccagctactcaggaggctgaggcaggagaattgcttgaaccagggagttgga

SEQ ID NO: 19802 - DNA, 176 bp, Homo sapiens
  misc_feature 123: n=a, g, c or t
  misc_feature 128: m=a or c
  misc_feature 133: m=a or c
  misc_feature 135: y=c or t
  misc_feature 139: m=a or c
  misc_feature 140: r=a or g
ccccatctctactaaaaatacaaaattagccaggctaggtggctcatgcctgtagtcccagctactcaggaggctgaggcagcttgaacccgggaggcggaggttacagtgagccgagatcgncgccmctgcmaytccmrgtctaggcgacaagagcgaaactccatctcaaaaaa

SEQ ID NO: 19803 - DNA, 362 bp, Homo sapiens
  misc_feature 194: n=a, g, c or t
  misc_feature 301: v=a or c or g
  misc_feature 302: v=a or c or g
  misc_feature 341: k=g or t
  misc_feature 342: d=a or g or t
ttttcccacaggtgccagggaaacggagtcatcgacccaagaaggtcgtgggagatgaggtcccagggtaaacagcgggtcccgccactatgtcaccctttcctgccgcctccccggatgaactgcatgcagggcggcacgtaacaacgtttaactttttgagataaatccacacatcataaagcattttcacngatagctcttttttgttttgttttgtttttgagatggagtcttgctctgtcacccaggctggagtgcagtggcactatctcggctcactgcaagctccgcctcccavvgttcacgccattctcctgcctcagcctcccgagcagctkdgactacaggtgccctccacc

SEQ ID NO: 19804 - DNA, 94 bp, Homo sapiens
attattaaagagaaaggctgtatcttatttaatttcaatttgcatttctttgattgcagttgaagcaatcaattatgttttattggacccatat

SEQ ID NO: 19805 - DNA, 224 bp, Homo sapiens
ctggtatattgggacttggatgatttcactgcgtaaataagaggaggaggattctaggtagttttgacatttatttaaatgtttagtaacagaatgaggttacgttagcaggatataaaaggcacatattttgagaaagacgcaaaactgctttagttacagaaacaaaatcagcctccaaacaaaaaaacaaaaactgtaaaattgtaattaataaaggccca

SEQ ID NO: 19806 - DNA, 137 bp, Homo sapiens
ctggagatatttaaaggttaaaatgctgtccatccccatccatccgtgctcttgcattgggcttttagcacggtgtacctccttgctgtcttgcaacttctactacttgcttgcaacttgcaccttccccctgaaac

SEQ ID NO: 19807 - DNA, 331 bp, Homo sapiens
  misc_feature 62: n=a, g, c or t
  misc_feature 255: y=c or t
  misc_feature 302: s=g or c
  misc_feature 303: r=a or g
cttttcttttctttttttatttttttgagatggagtctcacactatcaccgggctggaatgnagtggcgtgatctcagctcactgcaacctctgcctcccaggttcaagtgattctcctgcctcaaccttccaaagtagctgggattacaggttcccaccaccatgcccagtgaattttttgtattttttttgatagagatggggtttcaccatgttggcctggctggtctcgaactcttgaccttgtgatttgygcacctcggcctcccaaagtgttgggactacaagtgtgatccatcasrcccggccaacttttcttttttttttttt

SEQ ID NO: 19808 - DNA, 282 bp, Homo sapiens
  misc_feature 177: k=g or t
  misc_feature 178: n=a, g, c or t
cattaggtgaaaatgggaagccaagaaaatagatcttctgttttctggtgaaaatatgtgcatgtgaagcattttgtttgtaacagataactttttgctttagttatgattttattagtttttatctgaactttttattgatagtgatagctggaaccatcttcagtgaaaattgakncgttgaaataaactgaaggcattccgaaggaggagggaaaaaaatacgtaaaaagaaaaacaaaaaagaaataaactggagcactgcccagtggtggcgaaact

SEQ ID NO: 19809 - DNA, 75 bp, Homo sapiens
tcttattagactttgacttaagtatatgggtatgtgtggcatatccatagagaaatcatgtattttttttttttt

SEQ ID NO: 19810 - DNA, 78 bp, Homo sapiens
atatgacaaagctattgaaagaccatcctggctaacacggtgaaaccccatctcttctaaaaatacaaaaaaaaaaaa

SEQ ID NO: 19811 - DNA, 85 bp, Homo sapiens
ctttaagttttagggtacatgtgcacattgtgcaggttagttacatatgtatacatgtgccacgctggtgtgctgcacccaccat

SEQ ID NO: 19812 - DNA, 59 bp, Homo sapiens
  misc_feature 44: k=g or t
tgtggcacgcatctgtagtcccagcctcccgagtggctgggackacagatgcgtgccac

SEQ ID NO: 19813 - DNA, 212 bp, Homo sapiens
  misc_feature 134: r=a or g
  misc_feature 135: n=a, g, c or t
  misc_feature 137: k=g or t
cagtggtgtgatctcacctcactgcaacctctacctcctgagctcaaaccatcctcccacctcagcctcccaagttgctgggactaaaggcgcgtaccaccacgcttggctaatttttgtgtttttttgtagarnakggggtttctccatgttgccttagctggtctcgaactcgtgagctcaggagatctgcctgcctctctgcccgccaa

SEQ ID NO: 19814 - DNA, 125 bp, Homo sapiens
  misc_feature 1: s=g or c
  misc_feature 111: r=a or g
stgcaaggatttgccgggtgtggtgacgcatgcctgtaatcccagccactcaggaggctgggacgggagagttgattgagcccgggagacggaggttgcagtgggccaggrtccccactgcactc

SEQ ID NO: 19815 - DNA, 203 bp, Homo sapiens
  misc_feature 22: s=g or c
  misc_feature 24: v=a or c or g
  misc_feature 140: k=g or t
  misc_feature 141: m=a or c
  misc_feature 143: v=a or c or g
  misc_feature 176: n=a, g, c or t
gtcggggacgcgcgcacgggcsgvcagctgttgacgcgcttcttagctggtgcgcgccggagcccaaattccaagtggaaactgcaggcgcacgagggaggaacgcgtggagcatgaaaaggcagggggcctcctctgakmgvaaacgagcgcggataccgtccgggaaggccggngcagcaaatggatttctcatggaaggt

SEQ ID NO: 19816 - DNA, 127 bp, Homo sapiens
ctactcgggaggctgaggcaggaggaccgcttgaacctgggtggcagaggtggcagtgagatgagattgtgccgctgcactcaagcctgggggacagagccgggctctgtctcaaaaaaaaaaaaaa

SEQ ID NO: 19817 - DNA, 284 bp, Homo sapiens
  misc_feature 144: m=a or c
  misc_feature 190: s=g or c
taatacacttaagaatttgctaagacacaatagaaactagtaatagcttcttaaaaaatgtaaaatgtatcatcagacttcattcttcattacattcagatagtatgttctctgttgttgactaagaatgcacacactaatgamacaatgatgcaactgaaaaattgtaaaggcttcaaaatttaatgasaaactgttcaagtccacatttggacactgctgtagataaataattcatctttattgaggcaaagttgacatttcatgtttgtatgcggcccaat

SEQ ID NO: 19818 - DNA, 83 bp, Homo sapiens
agaggttgcagtgagccaaggttgtgacactgcactccagcctgggcgacagagcgagactctcaaaaaaaaaacaaaaaaac

SEQ ID NO: 19819 - DNA, 115 bp, Homo sapiens
gtacgtgcaggtttgttacctgggtaaattgcatgttgctggggtttgttgtacaaatgatctcatcacccacgtagtgagcatagcacctaataggtagtttttcaaccctcac

SEQ ID NO: 19820 - DNA, 140 bp, Homo sapiens
  misc_feature 110: s=g or c
  misc_feature 128: r=a or g
tatttttagtagaaacagggtttcactgtgttagccaggatggtgtcgatctcctgacctcgtgatccacccaccttggcctcccaaagtgctgggattacaggcgtgascactgcacccggcctgaractcttgaaaga

SEQ ID NO: 19821 - DNA, 57 bp, Homo sapiens
tctggaataaatatctttcgctgagaaaaaaaaaaaaaaaaaaaaaaaaaaaaaaaa

SEQ ID NO: 19822 - DNA, 84 bp, Homo sapiens
gggaggcagacgttgcagtgagccaagattgggccactgactctagcctgggcaacagagcgagactccatctcaaaaaaaaaa

SEQ ID NO: 19823 - DNA, 56 bp, Homo sapiens
atgaatattttgacaatattaattcttccaatccatgaacataggatatcttcctt

SEQ ID NO: 19824 - DNA, 84 bp, Homo sapiens
  misc_feature 30: k=g or t
  misc_feature 68: k=g or t
  misc_feature 73: y=c or t
  misc_feature 82: y=c or t
aaaaaagataggtttaaaatggtaatcctkgtttagtggtggattgtgtgtgtgggggatgtcacatkgcttycggagaggycc

SEQ ID NO: 19825 - DNA, 95 bp, Homo sapiens
tggctcacgcctgtaatcccagcacttttggaggctgaggcgggcggatcacctgaggtcaggagttcgagaccagcctcaacatggggaaaccc

SEQ ID NO: 19826 - DNA, 91 bp, Homo sapiens
  misc_feature 56: w=a or t
  misc_feature 91: d=a or g or t
gctttcctcaggctctgaggcccgcggtgtggagcgcggcgtaggcagcggggagwgggtcggcggcggggatcctgccgagcccgcagcd

SEQ ID NO: 19827 - DNA, 101 bp, Homo sapiens
caccacgccctgctgattttttgtatttttggtagagatggggtttcaccgtgttagccaggatggtctcggtctcctgacctcgtgatccgcccacctct

SEQ ID NO: 19828 - DNA, 97 bp, Homo sapiens
  misc_feature 6: k=g or t
  misc_feature 12: s=g or c
  misc_feature 24: h=a or c or t
gttttkaccgasagatgaaatgahattgaattagcataataataagccttcagggccgggtgtggtggcttacgcctgtagtcccagcaccttgaga

SEQ ID NO: 19829 - DNA, 79 bp, Homo sapiens
ttccttggggaatgattgtcttttcctattttgttaaatgcttttaaattcattttttttttttttttttttttttttt

SEQ ID NO: 19830 - DNA, 86 bp, Homo sapiens
cagaggttgcagtgagctgagatcatgccactccactccagcctgggcgacagagcaagactccatctccaaaaaaaaaaaaaaaa

SEQ ID NO: 19831 - DNA, 233 bp, Homo sapiens
ttttatatgggaacactaattttatgtgggaacactaacgccagggaacactggatggcgtaaagcaagaaggtaacttgatcagtttttgttgttgtttttgggacggagtatccctctgttgcccagtctggagtgcagttgtgtgatctcggctcactgcaacctctgcctcccgggttcaagcgattctcctgccccagcctcccgagtggctgggactacaggcaccc

SEQ ID NO: 19832 - DNA, 128 bp, Homo sapiens
  misc_feature 30: h=a or c or t
  misc_feature 31: v=a or c or g
  misc_feature 32: s=g or c
  misc_feature 33: s=g or c
agacatggaacttggctggtctgcagggahvssccactgttttggccgggagtagggggcgggagtggcgggagagggggtggccggctggggaggagccagcctggtggagaagctgccctgtgggc

SEQ ID NO: 19833 - DNA, 93 bp, Homo sapiens
cactatgagaggtcgaggcgggtggatcacttgaggccaggagttcaagaccagcctggccaacacggcaaaaccccgcctctactaaaaaaa

SEQ ID NO: 19834 - DNA, 221 bp, Homo sapiens
  misc_feature 96: w=a or t
  misc_feature 119: m=a or c
  misc_feature 121: r=a or g
  misc_feature 123: y=c or t
  misc_feature 128: h=a or c or t
  misc_feature 134: w=a or t
  misc_feature 137: m=a or c
  misc_feature 142: r=a or g
  misc_feature 147: d=a or g or t
  misc_feature 158: r=a or g
  misc_feature 165: w=a or t
  misc_feature 166: r=a or g
  misc_feature 197: w=a or t
actttctcaagtgctagttcttagtaagaaactgttgccaggcacggtggctcatgcctgtaatcccagcactttgggaggccgaggcgggtggawcagaaggttaggagttcgagacmargyctgahcaaccwtgmtgaarccccdatctctactaraaatacwraaattagctggttgtggtggcgggcgcctgwaatcccagctactcagggggctga

SEQ ID NO: 19835 - DNA, 354 bp, Homo sapiens
  misc_feature 129: h=a or c or t
  misc_feature 130: y=c or t
  misc_feature 132: m=a or c
  misc_feature 133: m=a or c
  misc_feature 172: k=g or t
  misc_feature 173: k=g or t
  misc_feature 284: m=a or c
  misc_feature 285: m=a or c
  misc_feature 305: k=g or t
  misc_feature 306: k=g or t
  misc_feature 307: b=c or g or t
ctttttttttgagggaagatctctcctgtcacccaggctggaagtacagtggcatgatcacggcttactgcagccttaaattcctggacttaagcaatcttctgccttagcctcctgagtagctgagahyammggtgcaggccaccaacgcctggctaattttaaatttttkkcttttgtagagatgagggcttgctatgtagacaaggctggtttcgaactcctgacctaaagtgatcctctcaccttggcctcttaaagtgctgggattacaggcgtgacammtgcacctggccagatcatgkkbctttatccattcagccagtttgtatctttcaagtggagacagattca

SEQ ID NO: 19836 - DNA, 119 bp, Homo sapiens
ccagctacttgggaggctgaggcaggtgaatcacttgaacacgggaggtagaggttgcagtgaggcaagatcgtgccattgcactccagcctgggtgacaagagtaaaactccatctta

SEQ ID NO: 19837 - DNA, 204 bp, Homo sapiens
ttgtgatgggcctttggtggagtgaaaggagaccattgaggttgcatcatgtagatccttttacagaatatttatttattggagaagacatggttattatttgaaatttttctgcaaagctgagaatgacgaataaagatttgtacttggaaaagttccttatggctgcagaaggatttactgcagagtttggaggtggaggtc

SEQ ID NO: 19838 - DNA, 118 bp, Homo sapiens
  misc_feature 31: m=a or c
  misc_feature 32: m=a or c
gcaaaaagttagctgggcgtggtggcgggcmmctgtagtcccagctgctcaggaggctgaggcaggagaattgcttgaacctgggaggtggaggttgcagtgggctgagattgtgccc

SEQ ID NO: 19839 - DNA, 259 bp, Homo sapiens
  misc_feature 209: n=a, g, c or t
agcactttgggaggctgaggcaggccgatcacctgaggtcaggagtcccagaccagcctggtcaacatggtgaaaccctgtctctactaaaaatacaaaaattagcgaagtatagtggcgcgcgcctgtaatcccagctactccagaggctgaggcaggagaatcacttgaaccccggaggcagaagttgcagtgagccaaaatcgtgncactgcactccagcctgggcaacagagcaagactttgaccctcccctcac

SEQ ID NO: 19840 - DNA, 335 bp, Homo sapiens
  misc_feature 128: w=a or t
  misc_feature 182: m=a or c
ctgggcatgtagtttgacaagtgccatttattaagttatatacttaaacataaagaagtaaagaaaattatcgggacaaagttgttgcattgtttctgaagttagacaaaaaaaatttaatgtaagcwaaattgaaacagggatgtatctgtttagttttacatgtgattaaatggattttmaaatattttccaaaagtcaagttaagaaaagtcatctctcaaattcctgagtgctctgaactctggtgtttaacctttagatcctcgtactcagttcccaaatccagaggctaaacctgaaatgacaatgccagatgttttcacacacacaca

SEQ ID NO: 19841 - DNA, 248 bp, Homo sapiens
  misc_feature 127: r=a or g
  misc_feature 128: w=a or t
  misc_feature 138: s=g or c
  misc_feature 144: r=a or g
cacagaggaagtctgtcttgaaaataacctgcaacttgtatgaataaaaatgttatttcctggtgagacatggttagagggttgttatcagaatggagtggcagtgcatagtgacagatgatttggrwtaattattasattggrttagatagtatacagacgttctaaggaattgctagatcatttggttatttttcctcctttttgtttaaatcgaaaaacatccataccctagacaaggcccctct

SEQ ID NO: 19842 - DNA, 89 bp, Homo sapiens
acattgtccacattaatggttggcatgattgtgcttgcaggccaagaaatgatcataccccttgccaaaggtaaaaaaaaaaaaaaaaa

SEQ ID NO: 19843 - DNA, 151 bp, Homo sapiens
tttgtgcaagaattccattgttgtatttttccttgacatcttctttaattatctaattcaattaggtgattgatttagtctgcctcttacttgaatttttgttattgctgcataccccattgattaagtataaaaaatgatacgggaatta

SEQ ID NO: 19844 - DNA, 364 bp, Homo sapiens
gctcctgcctgtaatcacagcacttcgagaggccagggcaggtggatcacgaggtcaggagatcgagaccatcctgactaacatggtgaaatcctgtctctactagaagtacaaaaaattggccggggccatgggtggtacgcgcctgtagtcccggctacttcggaggctgaggccggagaatcgcttggacctgggtggtagaggttgcagtgagctgagatcatgccactgcactccagcctgggcagcagagtgagactccatctcaaaaaataaaaaataaaaaaattatttaagtagaacaacattcagtatggacatcaaactgttgatatttaacctgtttcttatttgattgcaa

SEQ ID NO: 19845 - DNA, 141 bp, Homo sapiens
ttacacgcttttgttttgcttttctgtgttgtttttctgtattatatttctttttttaagaatacagttaggtgagacctcaaacatcaattaggtaaaagcaaaatatggttcggtttttgttttttatcttaggctgat

SEQ ID NO: 19846 - DNA, 80 bp, Homo sapiens
accccagagcctgtgatcttaaccaccaagttatcaactgccttggaggttaatcaccagtcaaaaaaaaaaaaaaaaaa

SEQ ID NO: 19847 - DNA, 234 bp, Homo sapiens
  misc_feature 129: y=c or t
  misc_feature 139: v=a or c or g
taactggtgtctttctaagaacagattaggacacaggcataaagggaagaccatgtgaagacacagagagaagaaagccataccagccaaggagagaggcctcagaggaaaccagccctgcagaccacytggataatcvgacttttggtctccagagctgtgagaaaatacatttatgttgttaaagtcactaagtcaatggtactttgttatggcagccctagtagactaata

SEQ ID NO: 19848 - DNA, 51 bp, Homo sapiens
  misc_feature 14: s=g or c
  misc_feature 22: y=c or t
  misc_feature 26: d=a or g or t
  misc_feature 28: n=a, g, c or t
  misc_feature 45: h=a or c or t
aagactgtgtgcasaaggtgaytgtdtnagtggagctgggtcathtcaggt

SEQ ID NO: 19849 - DNA, 106 bp, Homo sapiens
  misc_feature 72: m=a or c
  misc_feature 73: m=a or c
  misc_feature 74: s=g or c
tttcttagcttgtaagtcagtctttgttttattcccttctacacactggtcactaccaagttaaagcactgmmstcatcatataatttctcagttcagaatgtcac

SEQ ID NO: 19850 - DNA, 114 bp, Homo sapiens
  misc_feature 42: m=a or c
agggtgagggagggggtgggatgggtggggggtaacgggggmaactggggaagtggggaaccgaggggcaaccaggggaagatggggtgctggaggagagcttgtgggagccaa

SEQ ID NO: 19851 - DNA, 372 bp, Homo sapiens
  misc_feature 140: h=a or c or t
  misc_feature 217: k=g or t
  misc_feature 218: n=a, g, c or t
  misc_feature 229: r=a or g
  misc_feature 230: k=g or t
  misc_feature 362: k=g or t
agcggctcgctcggaagctgcgacgccgagtttcactctggctgccttctcctgagagtcggagccacagccagagccctgcccaggccgagccggagctgcagcccgagcgcggtggtgccctcagcccccgtcctcthgtcctcctcagcctcggtgccttggaatttgtgtcgctgagtcagcaagcctttcagatttgcccggtttttgttgkntgtggtttgtrkcaagatgggaactcaaacaagtcattcctcctaaggagctggtgtcttcatccagaagggacagtttgtgccagctctccagagagaaaaggtgagagccatggggacttgaccttgctgccttctctatckggtgcagaga

SEQ ID NO: 19852 - DNA, 116 bp, Homo sapiens
  misc_feature 14: r=a or g
  misc_feature 23: d=a or g or t
  misc_feature 40: y=c or t
  misc_feature 48: r=a or g
  misc_feature 59: k=g or t
tttttttttcttgrgctggggtdggttacagtaatgatcygtttatgraaatgcactgkgctgtatgcttataatgtgagcatacagcacagtgcattttcataaacagatcatta

SEQ ID NO: 19853 - DNA, 299 bp, Homo sapiens
atttgttttatatatttaagtgccccaatgttgggtgcatatatatttatgattattatattctcttgctgaattaatccctttatcattatgtaattacttttttgtctctgtatggttttcattttaaaagtcctaagttacctgctacaagtatagctactcctctcttttggtttctttttgtgtggaatgtctttttttattccttcactttcaggctatgtttgtccttacctattaattcagtttcttgtaagaagcatatagttgagtcttgtttcttttttttttttttt

SEQ ID NO: 19854 - DNA, 199 bp, Homo sapiens
  misc_feature 67: s=g or c
  misc_feature 137: k=g or t
  misc_feature 165: n=a, g, c or t
  misc_feature 187: y=c or t
atcccggctcactgcaacctcagcctcccaggttcaggtgattctcctgcctcagcctcctgcgtastgggatttcgggcacatgctgccacgcctggctaatttttgtacttttagtagagatggggtttccgcckgtgttggctaaggctggtcttgaacccncgacctcaaatgatccacccgyctcggcccccct

SEQ ID NO: 19855 - DNA, 98 bp, Homo sapiens; identical to SEQ ID NO: 17594

SEQ ID NO: 19856 - DNA, 160 bp, Homo sapiens
tttttttaaaatttattattattatactttaagttttagggtacacgtgcacaacgtgcaggtttgttacatatgtatacatgtgccattttggtgtgctgcacccattaacttgtcatttatcattaggtatatctcctaatgctatccctcccccctc

SEQ ID NO: 19857 - DNA, 172 bp, Homo sapiens
  misc_feature 123: s=g or c
  misc_feature 129: n=a, g, c or t
  misc_feature 130: s=g or c
actgctctgggaggaggaagagaaggaggaagaggaggaggaggaggagggggaggaagaggagaaaggcgcaggggtgggagctgttgccgaagctgccacagcaaaagttctcccccctcscccctnsccctcctctcaaggcccctagaaaggttggagctaccgccgc

SEQ ID NO: 19858 - DNA, 55 bp, Homo sapiens
tgggagacaagagtgagactctgtctcaaaaaaaaaaaaaaaaaaaaaaaaaaaa

SEQ ID NO: 19859 - DNA, 301 bp, Homo sapiens
  misc_feature 124: r=a or g
  misc_feature 136: n=a, g, c or t
  misc_feature 137: s=g or c
  misc_feature 204: r=a or g
  misc_feature 205: s=g or c
gccaggcgtggtggctcatgcctgtaatcccagcacttttggaggccgagatgggtggatcacctgaggtcaggagttcaagaccagcctggccaacatggcaaaaccctatctctactaaaartacaaaaaattnsccaagtatggtggcacacgtctgtaatcccagctacttgggaggctgaggtaggagaattgcttgarsccaggaggtggaggttgcagtgagctgaggtcgtgccattgcactctagcctgggtgacatggtgagacctcggctcactgtaacctccacctcca

SEQ ID NO: 19860 - DNA, 69 bp, Homo sapiens
  misc_feature 2: s=g or c
  misc_feature 3: n=a, g, c or t
  misc_feature 4: k=g or t
  misc_feature 63: y=c or t
gsnkcagcctcccaaagtgctggggttacaggcatgaaccaccgcacccagactttttttttycttttt

SEQ ID NO: 19861 - DNA, 208 bp, Homo sapiens
aacttataacctacctactttatgacttatggtaaagaccctttactctgactactccaagctttggacctataaattcatttttcctagaacaaatcctgtctgttgcaaatgaaatatattttagttttgacaattaactttccctgaaataatttttatttcagagcctatcaaaatgcacattttaactgaaccctcctatttc

SEQ ID NO: 19862 - DNA, 156 bp, Homo sapiens
acccaactgccggcttaatacttccatgtgtttcatctaagttgacatgcccaaactgagctttcttattcctgttaaaagattgtcctacagtcttcttcactgttaacgtcagttccattctttgagttatataggattattatctttcttttt

SEQ ID NO: 19863 - DNA, 110 bp, Homo sapiens
  misc_feature 102: k=g or t
ggatgtgagggcgatctggctgcgacatctgtcaccccattgatcgccagggttgattcggctgatctggctggctaggcgggtgtccccttcctccctcakcgctccat

SEQ ID NO: 19864 - DNA, 153 bp, Homo sapiens
aacttgcccctggggattgcgcggctgatgtttagaacgcctagtcaagccaaccggctcgctcttgtttcagcaaaccctgacttacgtctcctatttgacttgaggcggcacagtggccaagtcgattgggcgtggcaagtgaccctcccc

SEQ ID NO: 19865 - DNA, 176 bp, Homo sapiens
  misc_feature 143: n=a, g, c or t
ttctcctgcctcagcctgctgagtagctgaaattacaggtgcacaccaccacgcccagctaatttttgtattttttgtagagacagggtttcaccatgttggtcaggctggtggtgggcgcctgtaatcccagcgaactcagnaggctgaggcaggagaatcgcttgaacccagga

SEQ ID NO: 19866 - DNA, 153 bp, Homo sapiens
  misc_feature 142: d=a or g or t
  misc_feature 143: b=c or g or t
atctgcaattaaaaatgtatataattgcagagagagcagtgtgataagaatgctgaatgggatctgtaccttccatttttttcattagcttttatattttaagtgaaatcaggtaaagtgctggtaaggagttactttctcdbccaaccccaa

SEQ ID NO: 19867 - DNA, 228 bp, Homo sapiens
  misc_feature 151: r=a or g
atatacactatctcatgaataataaaaaatagtgctaatactctttctactgaaaactttttaaattgctaagtgaaatgtaacttttcaaaaacttgtcatttttatctgttgtattgaattgttatataactctatttccaggcacaaratcatataactatttgttctgtcttttattttcatatctttagattattttgaacaggatattatgactgccactgt

SEQ ID NO: 19868 - DNA, 106 bp, Homo sapiens
  misc_feature 16: m=a or c
  misc_feature 22: s=g or c
  misc_feature 73: n=a, g, c or t
ctgtatctttccaggmattcgsaacgtctcctttaggttttctagtttatgcatgtaaaggtgttcatagtanccttgaataatcttttgtatttctgtggtatca

SEQ ID NO: 19869 - DNA, 178 bp, Homo sapiens
  misc_feature 11: w=a or t
  misc_feature 137: k=g or t
  misc_feature 139: r=a or g
  misc_feature 140: w=a or t
tgccagtctgwgtcttttaattggggcatttggcccatttacatttaaggttagtattgttatatgagaatttgatcctgtcatcatgatgctatctggttattttgcacactagttgatggagtttttcatgatgkarwtggtctttatattttggtgtgtttttgcagtggctgtt

SEQ ID NO: 19870 - DNA, 248 bp, Homo sapiens
caaataaatatctatcagaggcaactacatggagatacaaatctcatatttcaaaattatatgtgaaagctcatccttttttattattttattttattttattattattatactttaagttttagggtacatgtgcacaatgtgcaggttagttacatatgtatacatgtgccatgctggtgtgctgcactcattaactcgtcatttagcattaggtatatctcctaaagctatccctccccgctccc

SEQ ID NO: 19871 - DNA, 168 bp, Homo sapiens
ttgtctatgcatcctaaaaatcctttcccccttgggaacaactgcctttctgcaaaacaaccctcagagccactgacagaggctgagagcaacatataattgcagaatgagcactgaatttggagtcagacagcctcaggtataaaactccaaattccacgtcagcct

SEQ ID NO: 19872 - DNA, 149 bp, Homo sapiens
aatgtaaagttcaatacattttgacatgtattggcaggtatgtgacatacattggcaggcatgtgaaaaataaaatgtgacccccaccacaatgaaaacatgaaacacttccattacccttggggccccttgaacagtccccctcccac

SEQ ID NO: 19873 - DNA, 219 bp, Homo sapiens
tgcttaaaatttgtgccgttttctgtagttacgttatacgttaatacataatttaatgaaaaaagcctgggctcagaatcatgctaccatttacaggggaaaaaatatgtactaatttttaagatgtattatttataaaatactactttgtttcatgcagtggtccttattattcaaaggaaagaatcaggaaccaggatacagttgttaaaaggaaga

SEQ ID NO: 19874 - DNA, 53 bp, Homo sapiens
  misc_feature 15: w=a or t
  misc_feature 16: w=a or t
gttttaggttgttgwwtctgtgagacctctcgtgtcttttttttttttttttt

SEQ ID NO: 19875 - DNA, 94 bp, Homo sapiens
cccacatgttttacagtagatctcttgaccttattcctcctatctaaccgaaattttatctcctttgagcaacatctctccagttcccaccccc

SEQ ID NO: 19876 - DNA, 153 bp, Homo sapiens
  misc_feature 132: y=c or t
  misc_feature 137: r=a or g
aatagccttggagctggtcctttcagccatatgataaaattaaaaactaagcctctccctcctgatccacctcgtctggaatgtgttgcctttagccaccagaaccttaagctgaaatggggagaaggaacyccaargacattgtcaaccgaa

SEQ ID NO: 19877 - DNA, 171 bp, Homo sapiens
  misc_feature 138: k=g or t
ctgactgaaagatctgatccaaggaatccctttgcccctactgcaaagcagttctcaacttgagtacagtagatttttattagaacaagttcctactgattaatttcatatcagaagcaaacaggttttttttggtakcaaatatggtgatacaggtactgtggcatgtct

SEQ ID NO: 19878 - DNA, 264 bp, Homo sapiens
  misc_feature 156: s=g or c
  misc_feature 188: s=g or c
  misc_feature 189: m=a or c
  misc_feature 193: s=g or c
  misc_feature 194: m=a or c
tgcaccaccacctctggttaattttttttttgagatggagtttcgctcttgttgcccaggcttgagtgcaattgcatgatcttagctcactgcatcctccacctcccaggttcaagcctcagcctcctgagtagctggggattacaggcatgcacsaccatgcccagctaattttgtatttttagtasmgatsmggtttctccatgttggtcaggctcgtctctgaactcccagcttcatgtgatttgcctgcctcgacctcaa

SEQ ID NO: 19879 - DNA, 103 bp, Homo sapiens
tatatttatataaatatatataaatacacacatatatatatgtatgtgtgtatttgtgtgtatcttttttgtgcatgtatgtgtgtatgtgcttttttttttt

SEQ ID NO: 19880 - DNA, 281 bp, Homo sapiens
ttgttcttctgtgtctggcttatttcacttagcataatgtcttcaatgtttgttcatccatgttgtagcatagtcagaacttgattcctttctatggccattgtatggatagcccactttttgtttacctgtttaactgcccgatgggcatttgggttgtttcaccttttggctgtgatccggggcaggctacgttacattatggcagaaaaaaagtgcaactgacatactacaaagagattttttaagtttaaaaaaagtttggatcttttggatttctt

SEQ ID NO: 19881 - DNA, 125 bp, Homo sapiens
acatgtgccatgttggtgtgctgaacccattaactcgtcatttacattaggtatttctcttaatgctatccctcctccctccccccactccacgacaggccccagtgtgtgatattccccaccta

SEQ ID NO: 19882 - DNA, 128 bp, Homo sapiens
tcttacagtccacgtcatatgtcagtaaatcatgttcccaaatagtctctgaaatcactcaggagaaggagcactgaaacgtcggactccatttattttcctaaatgtatgatatattcctgtttttt

SEQ ID NO: 19883 - DNA, 125 bp, Homo sapiens
  misc_feature 16: d=a or g or t
  misc_feature 38: y=c or t
  misc_feature 119: w=a or t
aaaagccagagcctcdgtcgcccaggctgcagtacagyggcgtaatctcagctcactgcaacctctgcctcccgggatcaagcgattctccttcctcagcctcccgagtagctgggatwacaggt

SEQ ID NO: 19884 - DNA, 200 bp, Homo sapiens
  misc_feature 130: r=a or g
  misc_feature 131: m=a or c
  misc_feature 135: s=g or c
  misc_feature 137: m=a or c
cactccgacgaggaggaccgggcaagtgagcctaaatcccaagaccaggactcagaggtgaatgagctgagccggggcccgaccagctccccctgcgaggaggagggggacgaaggggaggaagaccggrmaagsgmccttagggatgaggcctcctcagtcaccagggagctggatgagcatgagctagactacgatga

SEQ ID NO: 19885 - DNA, 154 bp, Homo sapiens
  misc_feature 140: s=g or c
  misc_feature 141: v=a or c or g
  misc_feature 150: h=a or c or t
  misc_feature 151: n=a, g, c or t
ttttttttgagatggagtctcactctgtctcccaggctggagtgcagtgatgcaatccggctcactacaacctccgcctcctgggttcaagcagttctcctgcctcagcctcctgggtagctgggattacaggtgcccasvaccacacchngct

SEQ ID NO: 19886 - DNA, 159 bp, Homo sapiens
  misc_feature 16: r=a or g
  misc_feature 126: w=a or t
  misc_feature 132: m=a or c
  misc_feature 135: r=a or g
atcttcaaggtgtaaractaagccaaaccaacaattaaggcaaagtcctcatggcagcaacaacaaaatacttcttcaaacacaaggactcaacttctagcaacatgcaaagacctgattaaacawagtaamtarttggaaaacgtgattttttttttt

SEQ ID NO: 19887 - DNA, 122 bp, Homo sapiens; identical to SEQ ID NO: 17927

SEQ ID NO: 19888 - DNA, 51 bp, Homo sapiens
cgttatactcatcaacccatctgctcttatttgttccttttcttttttttt

SEQ ID NO: 19889 - DNA, 298 bp, Homo sapiens
  misc_feature 138: m=a or c
  misc_feature 140: r=a or g
  misc_feature 283: n=a, g, c or t
  misc_feature 285: b=c or g or t
ctggagtgcgtggtaccatcatggctcactgcaacctccgcctcccgggttcaagtgattctcctgcctcagcttccggattctcctgcctcagcctctggattctcctgcctcagcctctggaatagctggtactamarggcgcccgccaccatgcccaactaatttttgtatttttagtagagatggggtttcaccatgttggccaggatggtcttgatctcttgaccttgtgatccacctgtcctggcctcccaaagtgctgggattacaggcatgagcnabcacccccaggcga

SEQ ID NO: 19890 - DNA, 179 bp, Homo sapiens
  misc_feature 140: k=g or t
  misc_feature 142: s=g or c
  misc_feature 144: s=g or c
tatttatttattttatttttattttttgagacggagttttgttcttgttgcccaggctggagagcaatggcgtgatctcagctcactgcaacctctgcctcccgggttcgggtgactctcctgcctcgggctcctgaagkascstggaactgcagatgtacagcatcacacccggccaa

SEQ ID NO: 19891 - DNA, 455 bp, Homo sapiens
  misc_feature 95: k=g or t
  misc_feature 96: w=a or t
  misc_feature 142: s=g or c
  misc_feature 149: m=a or c
  misc_feature 285: n=a, g, c or t
  misc_feature 342: n=a, g, c or t
  misc_feature 343: n=a, g, c or t
tgttatatgggtctcttgaagacaatatacagttgggtctttcttctttattcaacttaccactctgtgccttttaagtggggcatttagctaakwtacattcaaggttaatattgatatgtgcatatttgatcctgtcatsatgttamctggtcgttattcagactagattgtgtagtttttttatagtgtgtcagtagttacgttttgtggtggtcagtgacagtgatttttttccccatgtttagcatccctttaaggacctattgtaaagcaggtctagtngtaacaaatttccttggcatttacttatcaggaaaggatctttttttctcctttgcnnatgaagcttagtttggctggatatgaaattcttggttgtcatttcttttctttagcactgctaaatacaggcccccaatatcttttggcttatagggtttctgctgaaaggt

SEQ ID NO: 19892 - DNA, 171 bp, Homo sapiens
  misc_feature 128: r=a or g
  misc_feature 129: k=g or t
  misc_feature 142: k=g or t
  misc_feature 144: y=c or t
gtcattaatttgagacctttctgcttttctaatataagtgtttagtgttagaaaattccccctacatatagctttatcgcatctcacaaatttggatatgttgagtttcagttccattcagttcaaarkactttctaaatgktycctttagagtatttctttttttttttt

SEQ ID NO: 19893 - DNA, 122 bp, Homo sapiens
tgtcattgcctactatgcattccatatgcacattttcacaattgtcccaatcataacatggcttggaaaattcagaatccaatcaaacatcagacattgcattttctgttcatgattttttt

SEQ ID NO: 19894 - DNA, 50 bp, Homo sapiens
cctgtaacaagtaactgatccaactggactagtcaatacttttttttttt

SEQ ID NO: 19895 - DNA, 71 bp, Homo sapiens
  misc_feature 17: r=a or g
  misc_feature 21: r=a or g
  misc_feature 22: m=a or c
  misc_feature 38: r=a or g
cctaagataactctcgraagrmtggaagtatctctctraatcaaaagtcactttttgaggataatatcctc

SEQ ID NO: 19896 - DNA, 252 bp, Homo sapiens
  misc_feature 131: k=g or t
  misc_feature 133: d=a or g or t
  misc_feature 134: s=g or c
  misc_feature 147: w=a or t
  misc_feature 148: r=a or g
  misc_feature 228: y=c or t
  misc_feature 230: y=c or t
  misc_feature 237: r=a or g
acagcgctccgccagagctgccgccgcggactcgccgggagtgggggtctccgctggtgccagcccgcttctggagaccctccgcctcctgccaacccctgctcttccaggtcgggccccggggttctgckgdstgttagggacagwrgcaaagaagggcaggacggtccggtttcccgtggatgttcccgcccgagaaagacagcaagttgtgtgtgcgcccgggaygygggaggraaggtagccgccgcc

SEQ ID NO: 19897 - DNA, 168 bp, Homo sapiens
  misc_feature 15: h=a or c or t
  misc_feature 27: w=a or t
  misc_feature 55: s=g or c
  misc_feature 56: m=a or c
  misc_feature 58: s=g or c
  misc_feature 59: m=a or c
  misc_feature 75: y=c or t
  misc_feature 80: w=a or t
  misc_feature 98: w=a or t
  misc_feature 102: y=c or t
  misc_feature 119: w=a or t
  misc_feature 141: w=a or t
  misc_feature 144: d=a or g or t
  misc_feature 147: y=c or t
atcagcacagtgcchaaagctattccwgtgagtccttcagctgtggaagaggatsmasmtgaagatggtcatacygtggwggccacagcccgaggcgwattyaacagcaatgggggcgwgctgagttccatagaaactggwgtdagyataattatccctcaaggagcc

SEQ ID NO: 19898 - DNA, 132 bp, Homo sapiens
  misc_feature 27: m=a or c
aatacaaaattagccaggcgtggtggmtgtgcctgtaacgccagttactcaggaggctgaagcaggagaatcgcttgaactcaggaggcagagactgcagtgagccaaaactgcgccactgcactccagcct

SEQ ID NO: 19899 - DNA, 118 bp, Homo sapiens
aagtttcactctgtcacccaggctggagtgcaatggcgcgatctcaggtcactgtaacctctgcctcccaggttcaagtgattctcctgcctcagcctcccaagcagctgggattaca

SEQ ID NO: 19900 - DNA, 292 bp, Homo sapiens
  misc_feature 226: b=c or g or t
ttatagctttataacccctatgccaaattttgacaccttatagtatttagcaggaataagtatgaaattgcttaattaataaatgcaaacaaaaatgtatgctagcaattcttaagacattttctaatataattatactttaccaataatcttaaagctagcttatttattaaagattttagttaagttgcataaacttgaaaaagcatttgactagtcttttttbcacataaagtatttgattcaagtgcttttattttcttaagccaattaattagagctttcttctttt

SEQ ID NO: 19901 - DNA, 406 bp, Homo sapiens
  misc_feature 184: n=a, g, c or t
  misc_feature 248: n=a, g, c or t
  misc_feature 345: n=a, g, c or t
  misc_feature 347: n=a, g, c or t
  misc_feature 348: n=a, g, c or t
tggctcaaaccaataggacaatttgctgaggtctgagaggactccctccagaaaatccctgatctcttaaaatttggtagagatcggaagtttattttgctgtacaacacctctttttttggagttttacttgctcccaacaaggaaggcaagttttcctgctttcatgatgatggaaggcagntgatgtttttatggagtttcagctttcttccaatgcacttagagcactcagaaattgtataatntgtgtgaccattgttagttttgcttaactgttttgttgtttgtttctgtcttagtcaaatctgaaggggaaccctaaattacggggtcaaggactcnanngtggtaggaaaacagccagcttaaaaaactttttttaaattttaattactataggggc

SEQ ID NO: 19902 - DNA, 244 bp, Homo sapiens
  misc_feature 185: n=a, g, c or t
  misc_feature 186: r=a or g
tatattttttgagatggagtttcactattgttgcccaggctggagtgcaatggtgcgatctcggctcactgcaacctccacctcccgggttcaagtaattctcctgcctcagcctcctgagtagctgggattgcacgtacccaccaccacactattcttcccctccatttcttatgctctgactnrgatggccttcttttacttctgtcaatatataatcctccctcccaatacagggtctctc

SEQ ID NO: 19903 - DNA, 215 bp, Homo sapiens
  misc_feature 58: w=a or t
gtggagaccggcgcgtgaggaacctaccggtaccggccgcgcgctggtagtcgccggwgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaa

SEQ ID NO: 19904 - DNA, 104 bp, Homo sapiens
  misc_feature 15: r=a or g
  misc_feature 16: d=a or g or t
  misc_feature 35: h=a or c or t
  misc_feature 63: y=c or t
  misc_feature 72: w=a or t
  misc_feature 76: k=g or t
  misc_feature 82: y=c or t
aagaaaaaaagatgrdaaaaatacactgggcaaghaatgttatcctctagtccaactgaaggycttcacttwtgtkagctcygttctccctgaaagttcaaact

SEQ ID NO: 19905 - DNA, 158 bp, Homo sapiens
tctttttgataacagccatccgaactggggcgagatgatacctcattgtagttttgatttgcaattctctgatggttagagatgtgagcacattttcacatatttcttgaccatttttatgtcttcttagggaaatgtctattcagatcatttgcatt

SEQ ID NO: 19906 - DNA, 199 bp, Homo sapiens
  misc_feature 136: n=a, g, c or t
  misc_feature 166: h=a or c or t
  misc_feature 183: m=a or c
  misc_feature 184: m=a or c
  misc_feature 187: r=a or g
ttcaaaacaaaacaaaaaccttatgaattttttattatttattttttatatatttatttatttttgaggcaggagaatggtgtgaacccgggaggcagagcttgcagtgagccgagatcaagccactgcactccgncctgggcaacagagcaagactccgtctcahaaataaataaatatatmmaarataaataataaa

SEQ ID NO: 19907 - DNA, 258 bp, Homo sapiens
  misc_feature 27: w=a or t
  misc_feature 100: k=g or t
  misc_feature 101: w=a or t
  misc_feature 132: m=a or c
  misc_feature 136: r=a or g
  misc_feature 214: s=g or c
cagggttctaggttagtgtaggaaaawaaactggtgtattttattccacaagaagcttttggtaaattatttattaaggaaacaactgttggacattgakwtggcttttaaagatttacctagaagagatamtaaracagataaaactgatctgctcaggggcctgtcttcagtcttttcaggctcgtttactgtggtgttcatgccagcgcasctggtagacagtgttgctgtggctgtagaaataacactgctctc

SEQ ID NO: 19908 - DNA, 154 bp, Homo sapiens
  misc_feature 149: d=a or g or t
cagtattagaaaactttaagaactaagatttcagcctgaggaagctgattaaaaaataaaaataaaaaaccacaccaagattgatggcaatagatgtaattgaaaagaggaaacagaactgaggaatgatttttgaatttgagtaggadgaggt

SEQ ID NO: 19909 - DNA, 122 bp, Homo sapiens
aaccacaatttactgtccaagtcttactctagaagccttgaataaactctagcattccaaaatagttacaccaaacagattctgtcagtgcagttgttgtataggtgaatagatggatttct

SEQ ID NO: 19910 - DNA, 282 bp, Homo sapiens
  misc_feature 9: y=c or t
aaaggatcytaggacttggagactggacgaggggcccaggaaaatgtaggggccgaggtcgccgcccaatttcccatttggaagctcggttgcctggtggcgcatgccctagatggaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggtc

SEQ ID NO: 19911 - DNA, 124 bp, Homo sapiens
caggaggctgagaccagagaatcgcttgaacccgagaggtggaggttgcagtgagccaagattgtgccactgcactccagcctgggtgacagagtcagactctgtctcaaaaaaaaaaaaaaaa

SEQ ID NO: 19912 - DNA, 132 bp, Homo sapiens; identical to SEQ ID NO: 17706

SEQ ID NO: 19913 - DNA, 201 bp, Homo sapiens
gccctaccaaaatggagaaaccccgtctcgactaaaaatacaaaattagccgagcacgatggcgcatgcctgtcatcccagctactcaggaggctgaggctggagaattgcttgaacccgggaggtggaggttgcaagtgagccgagatcgcgccactgcactccagcctgggcaacaagagcgaaactctcccccacgca

SEQ ID NO: 19914 - DNA, 250 bp, Homo sapiens
  misc_feature 13: r=a or g
  misc_feature 162: m=a or c
  misc_feature 163: r=a or g
  misc_feature 228: m=a or c
gactggaataaartggagagaaatggagtggagcagaatgtaatggaatggagtgaaatggcatggagtggaatagagtggagttgaatggaattgaatggaattgagtggagttgagaggagtggagtggagtggaatggactgcactggaatgaaatggmratggaattcagttgaatggaatagaatggaatggaatggagaggaatggaagggagagtaatgamgtggattggagaggagtggaat

SEQ ID NO: 19915 - DNA, 347 bp, Homo sapiens
  misc_feature 130: m=a or c
  misc_feature 189: r=a or g
  misc_feature 239: b=c or g or t
  misc_feature 275: k=g or t
tataaaacattagaattattgaattttgcatggttacttcatgtagcacaaatatgcaaagcaattataattgtttttctgacaacctacttaaaaattttataattgatacaatttataatagaatcamaaatatcaaattcctaggaatacatcaaagaaaagttataccaaacctccatacataaratgatattattgaaggaatttttaagagacttaggcaagggagatatatbccatgttcattgtttaaaagactcaatatgttaaakatttcagttctcaccaaaatgatctatagagttaatgcatactcagtgtcagtaggacatttcatagaaatt

SEQ ID NO: 19916 - DNA, 138 bp, Homo sapiens
  misc_feature 8: y=c or t
  misc_feature 9: m=a or c
  misc_feature 13: s=g or c
aaaaattymaagsaagagtaggaatttgccaggtgacaaaaagcaggagagaatgccaggcagagactcagagaaggttctgaagggcagggggtgagtaggagagagaggcgtgaaatgagcctgcaaatgtgggaa

SEQ ID NO: 19917 - DNA, 130 bp, Homo sapiens
tgagagttaagggttcaggcatttggcaattcaactgacctttgacaaagttgacaagaacatacactggggaaagagtgttctagccccagcagccctcaacaggcccagggagggaagtgtgagctga

SEQ ID NO: 19918 - DNA, 277 bp, Homo sapiens
tggttatgattatcacgactatcgtggaggctatgaagatccctactacggctatgatgatggctatgcagtaagaggaagaggaggaggaaggggagggcgaggtgctccaccaccaccaaagggggaggggagcaccacctcccaagaagtagagctggctaattcacagaggggggcacctttgggaatagccaaagctactttttcctcccttcctatttatcctgtgtccctgagtgattttttcctcaaccaccatcacttccctaataat

SEQ ID NO: 19919 - DNA, 141 bp, Homo sapiens
atgcgtgtaagtttcctctatgtctttttgtgtctggagttggttcctaccggtgggtttatggtctcgctgacttcaagaatggagctgcggaccttcatggtgagtgttacagctcttaaagatggcatggacccaccc

SEQ ID NO: 19920 - DNA, 348 bp, Homo sapiens
  misc_feature 215: k=g or t
  misc_feature 298: b=c or g or t
  misc_feature 299: n=a, g, c or t
gtgaagaaaatcactactgagttttatagtgttttaaacaaacacatatttacagttttgtaaataacttgtaccatgtcgttattaaaatgatttttttctttttttgtctcctggaaggtgtgtgagctgaacattttcaccttttggattggcctcttatagcatcttatctgtttaccacaattctgtggtatctgcaatcattattattktgcgataaacttgaggtttaaagaggttataattaactcatcctacgactacaaaactcactttaaaagtttactaagttgtbnactcattcattcagcctgcgcaacatagtgagacctcatctgtacccac

SEQ ID NO: 19921 - DNA, 171 bp, Homo sapiens
tctacctgattgctcactggtgaagttaaccttgatcacttggttaaggcgttgtctaccagagttacccaccgtaagctgctaatttccctttccatactctgttccaggggtgtccaatcttttggctgccctgggacacattggaagaagaattgtcttgggcaacat

SEQ ID NO: 19922 - DNA, 243 bp, Homo sapiens
  misc_feature 109: n=a, g, c or t
  misc_feature 145: r=a or g
tgaaaatggggaaagaaggaacactgtccagggtagagaggcgtggagagatgctgtgactgatggtaggtcttttcttttgggctcctggttttaaatcattttttgnttcgctaatagcttggaagatggtttaaaagaggarggagagaaaaagatgagtgtctttgcagattcattgaccctgtgagaatagggctttggcactgctgaagtcctcagcctctgactagtagcttgcca

SEQ ID NO: 19923 - DNA, 274 bp, Homo sapiens
tatcgtgaaagaatattgaattttatcaaatctttttttgtatctgttgagatgattacatggttattatccttcattctgttgatgtgatgtatcacatttattgatttgcatatgttgaaccctccttgcatccctggaatgattcctacttcattatagtgtataatctttttgatgtgctgttggatttgggttgctagtattttgttgagaatttttgcatctgtgttaatcagggatatttacctgtggttttctttttttttttttt

SEQ ID NO: 19924 - DNA, 312 bp, Homo sapiens
  misc_feature 145: y=c or t
  misc_feature 148: w=a or t
  misc_feature 149: w=a or t
  misc_feature 150: w=a or t
  misc_feature 299: s=g or c
ctttgggtgagtcagtgagtgagtggtacgtggatgtgaaggactaggacattactgtagactttataaacactgtacacttaggctatactaattttatttaaaaattatcttcagtaataaattagcttgctcaactttattyatwwwtttaactttttgactcttccataaaaacacttaaatataaacactgtgagactcaaagaagagccagatgatggaagtttttaatactgccatcctgaggttaccaaaagaataggcaattggtgctgggcatggagcctcagccttcsaattcctaagcac

SEQ ID NO: 19925 - DNA, 151 bp, Homo sapiens
acgatcttggctcactgcaacctccgcctcctaggttcaagcgattcttctgcctcagcctcccgagtagctgggattacaggcatgcaccaccacgcccggctaattttgtgtttttagtagagacagggtttctccatgttggtcaggc

SEQ ID NO: 19926 - DNA, 185 bp, Homo sapiens
aataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaagaacaaaacaaacaaacaaaaa

SEQ ID NO: 19927 - DNA, 111 bp, Homo sapiens
tatttttagtagagatggagtttcactatgttggccaggctggtcttgaactcctgacctcaggtaatcctcccacctcggcctcccaaaatgctgggattactggcgtga

SEQ ID NO: 19928 - DNA, 258 bp, Homo sapiens
  misc_feature 179: k=g or t
  misc_feature 180: k=g or t
gaagaagactgaaaaaaaagttggaaaaatcctctaaagacacacagtgttccaagcacaatcagaccactaattactgttaagcttgagcccctttttgtgctctgagggggacttcggtgtgcagcaaccactcgggtcttttcttgagtccgggctaactcctgaatagcagattkktcttttcttcccctttcaacgtttgcttgccagtgcctttcttttccttcatcttcatcttcaccttctcctttttcc

SEQ ID NO: 19929 - DNA, 116 bp, Homo sapiens
  misc_feature 26: r=a or g
  misc_feature 27: r=a or g
  misc_feature 37: r=a or g
  misc_feature 38: w=a or t
  misc_feature 39: m=a or c
  misc_feature 82: v=a or c or g
ggaggctttggctgcccaagcaggarrgagggctcarwmcaggtgggcagggggagtcaggcaggatccaggaggctgtgcvcactgaccctaggacagcattaatgcacagccaa

SEQ ID NO: 19930 - DNA, 222 bp, Homo sapiens
  misc_feature 194: k=g or t
ctaacatcataatgacaggatcaaattcacacataacaatattaatcttagatatatatgggctaaatgccccaattaaaagacacagactgcaaattggataaatagtcaaggcccatcagtgtgctgtattcaggagacccatccttttagtttgagcctatgagcatctttgcacatgagatgggtctcckgaatacagcacactgatgggccttgact

SEQ ID NO: 19931 - DNA, 155 bp, Homo sapiens
cgattctcctgcctcagcctcccgagtagctgggactataggcacttgccaccatgcccagctaatttttgtatttttagtagagacagggtttcaccatgttggccaggatagtctcgatctcttgacttcgtgatctgcctacctcggccccc

SEQ ID NO: 19932 - DNA, 238 bp, Homo sapiens
  misc_feature 129: r=a or g
  misc_feature 151: v=a or c or g
  misc_feature 155: k=g or t
  misc_feature 198: s=g or c
caggcctcagagcattgctcatccgtgccagactgggtaggtggatttgagcggaaagactcccaaaatgtgccaagaatttcccagtcccaggcagggcaggggaaactaagggcaagcaggatacarggcgagggatgtggggcaggtvaggkggctcccgcctgtgccccttctcctcaccaatgtctcccccascctgcctcagttctccgttccccttcatctccgtccccca

SEQ ID NO: 19933 - DNA, 177 bp, Homo sapiens
  misc_feature 147: r=a or g
  misc_feature 157: m=a or c
ttggcacgtgcctgtagtaccagccacttgggaggctgaggcacgagaattgcttgaacccgggaggcggaagttgcagtgagctgagatccaatcatcgcgctccagcctgcgtgacaaagcgagactccggctcaaaaaaaagaraaaaaaaggmccattgcaatttagagatgt

SEQ ID NO: 19934 - DNA, 180 bp, Homo sapiens
  misc_feature 146: d=a or g or t
cccaaatgaagttttgtgagcaagaaataccattttgggttgttatgaagcctataagaatgcatggttggttttaacatgcttgagtctaggaccttatcagaccccatcagaaagtagttagcgtggaaagacaaccattgtgdcacatattcacctactgcaagcaatacaaggcct

SEQ ID NO: 19935 - DNA, 109 bp, Homo sapiens
  misc_feature 14: s=g or c
ggtgcatattttgsaaatattttctctcattctgtaggttgtctgttcactctgttgatagtttcattcactgcgcagaaagttttttgtgtagttaccatttgtcttt

SEQ ID NO: 19936 - DNA, 115 bp, Homo sapiens
caacaaatcattttgatttcagtgcctgttggggacttgatttcttctcagttttgtttgtttgtttgtttccttaatctggctcatttgaaatttcttctccctctcaaccaaa

SEQ ID NO: 19937 - DNA, 309 bp, Homo sapiens
  misc_feature 82: k=g or t
  misc_feature 123: m=a or c
  misc_feature 130: b=c or g or t
  misc_feature 133: w=a or t
  misc_feature 134: d=a or g or t
  misc_feature 142: w=a or t
  misc_feature 144: s=g or c
  misc_feature 161: k=g or t
  misc_feature 183: r=a or g
  misc_feature 231: r=a or g
  misc_feature 235: k=g or t
tatatttttcatcatgtaaacaagtttcccatttccctttcttagattgcaccagtgaaggagatgttttgcaaagattcakagaactaatttttcactggataagacctgagtaacccagamcccccabcgwdgttctttwtsaccaagccctcgacttkgcacttaaaaagggatattgtraatgaaaggctgcagtgccagttttaagaaagaatttctgtgaagtgrtgakgactctggagtctagctcacataaagagagtgtcgaggagccatatgatcaccaacctcaacagttaaatcaac

SEQ ID NO: 19938 - DNA, 102 bp, Homo sapiens
  misc_feature 52: m=a or c
tgtctactgggcatgctccagtcatggacaagggcatgaggtcagaccaggmtttgcattgagaagattgtagaaatggatgcagtcactgaaggagactgt

SEQ ID NO: 19939 - DNA, 96 bp, Homo sapiens
  misc_feature 15: s=g or c
  misc_feature 40: k=g or t
  misc_feature 52: k=g or t
  misc_feature 58: k=g or t
  misc_feature 79: k=g or t
cagtgtagtttagtsgcaaaaccaagttcaactttcagtktccctacttackgatackgcatttggcaaatcttgatckctcaggacaccaggtgt

SEQ ID NO: 19940 - DNA, 63 bp, Homo sapiens
  misc_feature 2: k=g or t
  misc_feature 3: w=a or t
  misc_feature 15: r=a or g
  misc_feature 55: k=g or t
tkwaaatctttcaaragacataaaaagacagcagaatcaagaccccataactgckcatccagc

SEQ ID NO: 19941 - DNA, 97 bp, Homo sapiens
  misc_feature 9: w=a or t
  misc_feature 10: r=a or g
  misc_feature 12: y=c or t
ggatgtggwrgytcacgcctgtaatcctagcactctaggaggccgaggcaggtggatcgcttgagctcaggagttcgagaccagtctgggcaacaca

SEQ ID NO: 19942 - DNA, 91 bp, Homo sapiens
  misc_feature 15: b=c or g or t
  misc_feature 16: n=a, g, c or t
  misc_feature 33: r=a or g
  misc_feature 54: y=c or t
  misc_feature 65: y=c or t
  misc_feature 78: y=c or t
aagatcagattgtabncatgttttgaatagaaragttttagagattttgatttygttttgctgtyattggggtgtgtyatagtgtgtgtct

SEQ ID NO: 19943 - DNA, 117 bp, Homo sapiens
  misc_feature 22: r=a or g
agtaaggcagtgaaccacataragcatccttattcttacaccagttgctccctccttgacatcagggcaatcattctggtcatttattgaacacttattacgtgcttgcctctgcca

SEQ ID NO: 19944 - DNA, 106 bp, Homo sapiens
  misc_feature 15: k=g or t
  misc_feature 16: k=g or t
tttgttttttaccakktgttttttgttttgttttgtttttttacctagagaagtgaaaggggcatcaagagcagctggtcttggccgtcgcgctgttgtctggtta

SEQ ID NO: 19945 - DNA, 95 bp, Homo sapiens
aagctcctggtaagtgccctatataggtatgccattttttttaaccctttataatagtgtttttgtggggtttttttttgttttttttttttttt

SEQ ID NO: 19946 - DNA, 128 bp, Homo sapiens
  misc_feature 31: r=a or g
  misc_feature 103: b=c or g or t
  misc_feature 104: m=a or c
  misc_feature 120: v=a or c or g
aattgcattttcttacttttgtgaaatcagrtgtcaagcctggcttacaagcacattctgtgtgcactgaagctctgaaaccttgcgttaagtttcaactctbmagtgagccaagtgagvatacttta

SEQ ID NO: 19947 - DNA, 121 bp, Homo sapiens
atttagtagagaaggtgtttctccatgttggtcaggctggtcttgaactcccgacctcaggtgatccgcctgccttggcctcccaaagtgctgggattacaggtgtgagccaccgcgccca

SEQ ID NO: 19948 - DNA, 184 bp, Homo sapiens
  misc_feature 124: m=a or c
  misc_feature 167: k=g or t
actttcttttgatagagccgtttagaaacactttttttttattatactttaagttttagggtacatgtgcacattgtgcaggttagttacttatgtatacatgtgccatgctggtgcgctgcamccaactaactcgtcatctagcattaggtatatctcccaatgckatccctcccccctccac

SEQ ID NO: 19949 - DNA, 201 bp, Homo sapiens
  misc_feature 116: h=a or c or t
  misc_feature 131: m=a or c
  misc_feature 149: m=a or c
  misc_feature 151: m=a or c
  misc_feature 152: k=g or t
  misc_feature 161: k=g or t
  misc_feature 199: v=a or c or g
tgggcaacaacagtgaaacaccgtctcaaaataaataaataaataaatatatgaaaattagccaggtatggtggcacacacttgtaatgccagctacttgaatggctgagacagghaaatcgacttgagcmtgggagacagaggttgcmgmkagctgagakcacaccaccgtactccagcctgggtgacaaagtgagavtc

SEQ ID NO: 19950 - DNA, 168 bp, Homo sapiens
  misc_feature 123: m=a or c
  misc_feature 124: n=a, g, c or t
  misc_feature 126: y=c or t
  misc_feature 137: r=a or g
  misc_feature 148: r=a or g
caaagaattggccgggagtggtggcgcgtgcctgtagtcccagctacttgggaggctgaagcaggagaatcgcttgaacccgggaggcggaggttgcagtgagccgagagtgcgccactgcamntycgggccctggrgcgacagagtragcgagactccatctgaaaa

SEQ ID NO: 19951 - DNA, 82 bp, Homo sapiens
atggattaagtggaactactgtgtgtgtacagatatatatatatatatacacacacacacacacaaacacatatatgtatat

SEQ ID NO: 19952 - DNA, 192 bp, Homo sapiens
cagaaatcttcagtgttgtcttctctgaccttcattggcagtttccctaacttttaccactcccatacaacttttctaaaagttatgtaagttataaaacttctctaatatttacgtatgtccacaattctatattaacatttttttatttatttttgagatggagtctctctctgtcatccaggctggagt

SEQ ID NO: 19953 - DNA, 163 bp, Homo sapiens
  misc_feature 144: w=a or t
  misc_feature 154: w=a or t
  misc_feature 162: m=a or c
ttttttgtaggtgttcttcatcgtggtgagaatattgcttcctatacctagtacactgaaaatttttatgaagaatggatattggactttgtgttttctatatttgttgatatgcttccatagtttttctttgtagtttggtawtataattacwtgagccamc

SEQ ID NO: 19954 - DNA, 92 bp, Homo sapiens
tgccttagtgcatgacttgaattagtttcctatatgttactatatttttatttatttattttgattttgatttttttttttttttttttttt

SEQ ID NO: 19955 - DNA, 231 bp, Homo sapiens
  misc_feature 124: m=a or c
  misc_feature 125: y=c or t
  misc_feature 128: w=a or t
  misc_feature 135: m=a or c
atacctgcaggtccagaacgtgatggttcagataaactatatatcaagtcttggcagctatattactgctttgtgggaaggtcaagtagtcctttgaaaaatttgaaggacacaacaatattamycawggcacamatttagagtttagagaggactgcaagacaaaactccttggcattcacacaataatcttccaaaattgtacccaaatcttacttctttggagtcatc

SEQ ID NO: 19956 - DNA, 358 bp, Homo sapiens
  misc_feature 305: d=a or g or t
  misc_feature 306: s=g or c
  misc_feature 317: d=a or g or t
catttattctctgaatgcaaactctttgggatgccaaattataagcagcatcagaccaaagttatatgttataggtatttagtggcattagatattgacatcaagatgcagtatctccatgttagagacatacctattaccagaatgtaacaggtttaatctttgggtcaaaaaaacttctatccttgccttctgatattagttctggccttctttctctagttctaaaatacttagtataatgatctccaggctgttccatctcttaaagatgatcttgtatatatctctgttttgatatattdstcttttctttdagggaaggcagccttgttcccaggatcttggagagaccccc

SEQ ID NO: 19957 - DNA, 135 bp, Homo sapiens
ttttagggtacatgtgcacaatgtgcaggttagttacatatgtatacttgtgccatgctggtgtgctgcacccattaactcgtcatttaacattaggtatatctcctaatgctatccctccccccttccccccac

SEQ ID NO: 19958 - DNA, 132 bp, Homo sapiens
  misc_feature 130: s=g or c
gaagtacccgttctggttctcattaagggttgcctcggaatttgtaaataaaggaacgttcagaataaggacagggccttccttttctttagttcattggtttttaaaatttctattttggctgggcgcsgt

SEQ ID NO: 19959 - DNA, 55 bp, Homo sapiens
taatgttgatactgtaagggtgtttcgttccctttaaatgaatcaacactgccac

SEQ ID NO: 19960 - DNA, 120 bp, Homo sapiens
gagtttcttaagagtttagaagattttgttttgtaaatctgtccagtcaggcattaaaaatgtttaaaagaacataattatgtttgtaagttgtatttaattgttttttcttttcttttt

SEQ ID NO: 19961 - DNA, 138 bp, Homo sapiens
taaaactggaaattaactccaaaagaaaccctaaactatacaaatacatggaaattaaataatctgctcttgaatgatctttggattaacaatgaagttaagacagaaattattttttgagctgaataatactggcac

SEQ ID NO: 19962 - DNA, 115 bp, Homo sapiens
  misc_feature 16: k=g or t
  misc_feature 96: y=c or t
ctttatttaaaactakgagtaagttttaacttttctatgaataatgggagatctacagcagacgttgaagttatttgaagaaaatatgtagatgcyatcagtactaactaatagc

SEQ ID NO: 19963 - DNA, 241 bp, Homo sapiens
  misc_feature 125: m=a or c
  misc_feature 155: v=a or c or g
  misc_feature 157: y=c or t
  misc_feature 193: s=g or c
  misc_feature 217: s=g or c
  misc_feature 220: k=g or t
aaaaaagccgcgctggcaacctccgcagcggtcgcgcgcacccttcacccctcttgctgcttttgtctggcacaaccttctcaggccctccgcgaggccggccctttttttctttcactttcccmacccggagagccaggtgccgagaactaggvcytcgtccccttctctatcccttcccctgatccatctsgtctctgttctccttcccttttcsgtkcccgaagccggaaggagcaaa

SEQ ID NO: 19964 - DNA, 120 bp, Homo sapiens; identical to SEQ ID NO: 17437

SEQ ID NO: 19965 - DNA, 59 bp, Homo sapiens
  misc_feature 20: m=a or c
ggaaactcgggcggcggggmacgcgggaggatgtggaacccgaggcggggggagccgga

SEQ ID NO: 19966 - DNA, 195 bp, Homo sapiens
  misc_feature 129: n=a, g, c or t
aaaacatgggccaccatgttcagctatttatttatttgtttgtttatttattttgagatggaagcacgctctattgccaggctggagtgcagcggcgctcttggctcactgcaacctccgccttccagnttcaaacgattcttcagcctcggcctccagagtagctggaaatataggtgcccaccaccacgccca

SEQ ID NO: 19967 - DNA, 253 bp, Homo sapiens
  misc_feature 111: w=a or t
  misc_feature 195: k=g or t
  misc_feature 196: d=a or g or t
  misc_feature 221: v=a or c or g
  misc_feature 222: w=a or t
  misc_feature 230: m=a or c
gcagagccatgcgaggcgcgaggagcaggcagccggagggctccgtgtcacaaaggctgccggggcagcacgcgagccagagtcacgacaagcccgggtcccaggctcgcwgctgcctcaaatctcatccggtcccaaagccagctgccctgcggagaggagcctaccgacaccgggcacgtctgtgggagggckdggctgggagaaaggcactgagctavwgatgagamgaagcgttccctggagcctgcat

SEQ ID NO: 19968 - DNA, 103 bp, Homo sapiens
atgaagggagaaaaaaaactaagaaatctagttgcaatgtttttcttaattctgcagtttatggtgcctatactttgaccacttttttttttttttttttttt

SEQ ID NO: 19969 - DNA, 94 bp, Homo sapiens
  misc_feature 29: m=a or c
tataaatgcactgcaagaagtctacctcmtttttactggttaggatggtgagattttaagagactttcattttcatgattgtatctttatgtat

SEQ ID NO: 19970 - DNA, 152 bp, Homo sapiens
  misc_feature 103: k=g or t
  misc_feature 104: k=g or t
  misc_feature 143: d=a or g or t
agattaggagtggggctagagaaggggcgaggacgcgaggtgtggcgtcctggggtctggggatgtgaggccagggcctccgaggtgaactggtcctgccctkkcgaccccgtgtgtgccctccctcaggccaagtttgagcdgatcacctc

SEQ ID NO: 19971 - DNA, 196 bp, Homo sapiens
  misc_feature 119: b=c or g or t
  misc_feature 193: b=c or g or t
  misc_feature 194: s=g or c
gatacaaaaattagctaggtgtggtggtgcatgcctgtagtcccagctacttgggaggctgaggcaggagaatcacttgaacctgggaggtggaggttgtgatgagctgagattgtgcbactgtactccagcctgggtgacagagcaaaactccatctcaaaacaacaacaacaacaacaacaacaaaacacbsca

SEQ ID NO: 19972 - DNA, 102 bp, Homo sapiens
tggaaaggaatggaatgcaatcaacccgagtgcaatggaatggagaggaatggaatggaatggaaaggaaactacccgaatggaatggaatggaatggaaaa

SEQ ID NO: 19973 - DNA, 151 bp, Homo sapiens
  misc_feature 50: y=c or t
  misc_feature 57: w=a or t
  misc_feature 81: y=c or t
  misc_feature 101: y=c or t
  misc_feature 144: y=c or t
atgagaacacatggacacaggaaggggaacatcacactctggggactgtygtggggwggggggaggggggagggatagcaygaggatatatacctaatgcyaaatgacgagttaatgggtgcagcacaccagcatggcacatgyatacata

SEQ ID NO: 19974 - DNA, 113 bp, Homo sapiens
  misc_feature 72: s=g or c
  misc_feature 108: k=g or t
caggaggctgaggcaggagaatcaattgaacccaggaggtggaggttgcagtgatctgagattgtgccactstacttcagcctgggcgacagagggagactcccatckcaaaa

SEQ ID NO: 19975 - DNA, 91 bp, Homo sapiens
agaaacagcgggctggggcagccactgcttacactgaagagggaggacgggagaggagtgtgtgtgtgtgtgtgtgtgtgtgtgtgtatgt

SEQ ID NO: 19976 - DNA, 186 bp, Homo sapiens
gtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcgggttagggggagacggggcaaa

SEQ ID NO: 19977 - DNA, 177 bp, Homo sapiens
  misc_feature 152: n=a, g, c or t
caagtagctgggactacaggcacatgccaccacccccagctaatttttgtatttttttcttttaaagtggagacagggtttcaccatgttggccaggatggtctcaatctcttgacctcatgatctgcctgcctcagcctcccaaagtgctnggattacaggcatgagccaccgcct

SEQ ID NO: 19978 - DNA, 191 bp, Homo sapiens
  misc_feature 132: b=c or g or t
  misc_feature 158: s=g or c
  misc_feature 160: m=a or c
ctgaggcaggagctggccgggcaagggtgggaagacatctgcgggcgcgtgtccactcaccctgttccctgagcagcagctccctccagggaggccctgggtcccacgccctgggtgcccacatggcctgcbaactagggcctgcaaatggagtgggsgmgtcctggcccctgaatcaccagagccaccaa

SEQ ID NO: 19979 - DNA, 78 bp, Homo sapiens
agactatactttcagggatcatttctatagtgtgttactagagaagtttctctgaacgtgtagagcaccgaaaaccac

SEQ ID NO: 19980 - DNA, 236 bp, Homo sapiens
  misc_feature 163: r=a or g
ttacatcagtacagttcacagctggggagcacttggatgggacttattgattgttggtgtccttgcattttgagttgacttggctgtttcactgggaaaccaacccttggaggctaagacctgggtgactgcattggaagctgtgcagggcagaggctggcarggaggggtggtggtggttggtgtgtgctaaatccctttatttctggtatggtccagcacccttgcccccacca

SEQ ID NO: 19981 - DNA, 95 bp, Homo sapiens
ctttctttcttttcttttcttttttgaggcagagtctcgctctgctgcccaggctggagtgcagtggcactatctcggctcactgcaacctccgc

SEQ ID NO: 19982 - DNA, 146 bp, Homo sapiens
  misc_feature 128: m=a or c
ccgggacaggcagctgaggaaggagcgccatggaagccacagatgggatgactctgctgaagcaggaatgcacccagccgggaggccgccagccctgccagccgtcagcacacaaaggcaccgctgtmctgctggggaggtcgaat

SEQ ID NO: 19983 - DNA, 309 bp, Homo sapiens
ttcaccagtactacactgtcttgattactgtagctttacagaaggtcttgaagtcaggaagtgtcagtcctccaactttgttcttctcctttaaaattgtattgtttattctgagtcttttgcctcttcatataaactttagaatcagtttgtcaatatcaaaataacttgctgacattgattgggattgtgttaaatctacagatcaatttgggaagaactgacatcttgacagtactgagtctttctatccatgaacatggaatatctctaatgcccctctttatctctgataacttccctggctca

SEQ ID NO: 19984 - DNA, 220 bp, Homo sapiens
  misc_feature 96: w=a or t
  misc_feature 130: k=g or t
  misc_feature 136: k=g or t
  misc_feature 152: r=a or g
  misc_feature 158: k=g or t
agcaattctcatgcctcagcctcctgagtagctgggattacaggtgtgtgccaccatgcttggctaatgtctttttttgtgtgtatttttttttgwatttttaggagagatggggtttcaccatgttggkcaagckggtcttgaactcctgrcctcgkgatccacccaccttagcctcccaaagtgctgggattacaggcctgagccactgcacccgccc

SEQ ID NO: 19985 - DNA, 51 bp, Homo sapiens
tggtttcatcctagggatgtgaggaatcattgtgggatatttttttttttt

SEQ ID NO: 19986 - DNA, 120 bp, Homo sapiens
  misc_feature 15: k=g or t
cctgtaatccgagckatccaggagactgagacaggagaatcgcttgaacctggaggcagtaagccaagatcgcaccattgcattccagcctaggcgacagagcaagactctgtctcaaaa

SEQ ID NO: 19987 - DNA, 208 bp, Homo sapiens
  misc_feature 132: y=c or t
  misc_feature 158: s=g or c
  misc_feature 159: r=a or g
caggctggagtgcagtggcacaatctcgactcactgcaagctccgcctctctggttcacgccattctcctgcctcagcctcccaagttgctggactacaggcgcccgccaccacgcccggccaatttttttyatttttagtagaggtggggtttcacsrtgttagccaagatggtctcgatctcctgacctcgtgatccgcccgcctt

SEQ ID NO: 19988 - DNA, 194 bp, Homo sapiens
  misc_feature 104: s=g or c
  misc_feature 105: m=a or c
  misc_feature 137: y=c or t
  misc_feature 146: w=a or t
atatactgatgaagagccagtaaaaaaaatctcaacacatttaaaaggactgaaatcatacaacgtatgttttctgaccacatggaattaaattagcaaataasmaaaaaaaaagcacgtttaacccataggtggcycatgcttgwaatctcaacactttggaaggctgggaaaagaaggactgcttgagctca

SEQ ID NO: 19989 - DNA, 162 bp, Homo sapiens; identical to SEQ ID NO: 17222

SEQ ID NO: 19990 - DNA, 184 bp, Homo sapiens
  misc_feature 145: r=a or g
cacatgcttatgtctcattttccttttggcatgtggaaagctgtcaatgcagtgtaaggccaacgtgtgtgtggcttctatgtgttgagataatgttttggtatccttgtccgtttcatttatttttttaagtgtacaaaaaatracctgttaatttttgaaggctacttttctgttctttttt

SEQ ID NO: 19991 - DNA, 271 bp, Homo sapiens
  misc_feature 126: y=c or t
taatcttaaaataggctcacacctgtaatcccaggactttggggggctgaggtgggcagatcacctgaggttgggagttcgagactaacccgggtagcacggtggaaccccgtctctgctaaaagytcaaaaattagctgggcatggtggtgcatgcctgttatcccagctactcgggagcctgaggcagaagaatcacttgaacctgggaggcagaggttgcggtgagccaagatcgcgccactgcactacagcctgggcgacagagcga

SEQ ID NO: 19992 - DNA, 146 bp, Homo sapiens
ttatgactggtgtgagatggtatctcattgtggctttaatttgcatttctctgatgattagtgatgttgaacatttttcatgtttgttggttgcttgtatgtctgaagaaatgtctgttcattgtttatgtcctttgcccaccttt

SEQ ID NO: 19993 - DNA, 119 bp, Homo sapiens
  misc_feature 35: y=c or t
gatgtggatctgagagtcaagcaatactatgaggyaccaataacaatgaagtctgtgtttgatctgatcgatactttccagtcccgaatcaaagatatggagaagcagaagaaggagga

SEQ ID NO: 19994 - DNA, 115 bp, Homo sapiens; identical to SEQ ID NO: 17310

SEQ ID NO: 19995 - DNA, 151 bp, Homo sapiens
  misc_feature 128: r=a or g
caacacgagtggaatggcatggattggaatggaatggaatggaatcaacccgagtaaaggggaatggaatggaatggaatgcaatggaatggaatcatccgtaatggaatggaaaggaatggaatggraatggaatggaatggaatggaat

SEQ ID NO: 19996 - DNA, 109 bp, Homo sapiens
tctattaaccccatctagtgtattttttattttgcattgttttttcttctggacaacttattgacagcctagagataaagttttgtcatgcctctctgaactcaccccc

SEQ ID NO: 19997 - DNA, 188 bp, Homo sapiens
  misc_feature 160: r=a or g
gggagaatcacttgagacctgggaggcagaggttgtagtgagccaagatcctgccactacactccagcctgggcgacagagcaagactctgtctcaaaaaaataaataaaaatttaaaaatttaaaaaagtccaaataattggggtatgatttaaagatrgctatatgagaccttgttcaggggtacc

SEQ ID NO: 19998 - DNA, 147 bp, Homo sapiens
gctaaggtttatttattttattttattattagttttaaacgttaacccacttttgattaaatcactgtaattgaatttgttgcctatgacatacaaagataaacacaagttgattcaggtgattttctcagaagtgctgccctgctc

SEQ ID NO: 19999 - DNA, 298 bp, Homo sapiens
  misc_feature 16: y=c or t
  misc_feature 163: r=a or g
  misc_feature 164: s=g or c
  misc_feature 234: b=c or g or t
  misc_feature 235: n=a, g, c or t
  misc_feature 236: n=a, g, c or t
gctcgccaacacgccyggctaatttttttgtatttttagtagagatggggtttcaccgtgttagccaggatggtctcgatctcctgacctcttgatccgcccgcctcggccccccttgaaatcacaagcattcctaaacaccaacaacagacaagcagagagrsaaattaggaatgtactcccatgcactattgccacaaaaagaataaaacacataggaatacagctaacaabnnaggtgaaggaacaatccagcctgggtgacagagcgagactccatctcaagaaaaaaaaaaaa

SEQ ID NO: 20000 - DNA, 233 bp, Homo sapiens
attaatttcattttacattcattcattcattcatgagatagggtcttgttctgtcacccaggctggagtgtagtggtgcaaaccacagctttgacctccgggactgaagcagtcctcccgcctcagcctcccaagtagctgggaccacaggtgtgtgcctccatgcttggctaacttttgtactttttgtaggctagtcttgaactcctgggctcaagcagtccacccacctc

SEQ ID NO: 20001 - DNA, 67 bp, Homo sapiens
atgagccaccgtgcccggccccccaacttttatttatataaataaaagttggagggccgggccccgt

SEQ ID NO: 20002 - DNA, 324 bp, Homo sapiens
agtatagtataaaaggcttgataggccaggtgcggtggcttatgcctgtaatcccagcactttgggaggccgaggtgggtggatcacctgaggtcaggagttcaagaccagcccgaccaacatggagaaaccccatctctactaaaaatacaaaattagctgggcgtggtggtgtgcacctgtaaatcccagctacttgggaggctgaggtgggagaatcatttgaacccaggaagcataggttgcagtgagccgagatcgcgccactgtactccagcctgggtgacagaacaagactctgtctcaaaaaaaaaaaaaaaaaaa

SEQ ID NO: 20003 - DNA, 120 bp, Homo sapiens
agagatgaggtctcactatgttgcccaggttggtctccaattcctgagctcaagcaatcctcccaccttggcctcccaaagtgctgtaattacaggtgtgagccaccgcacccggcccat

SEQ ID NO: 20004 - DNA, 357 bp, Homo sapiens
  misc_feature 281: s=g or c
  misc_feature 283: k=g or t
  misc_feature 319: n=a, g, c or t
  misc_feature 346: n=a, g, c or t
ctctgtaaatctaaaattaatctaaaataaaaaagtttggccaggcgtggtggctcacgtctgtaatcccagcactttgggaggccaaggcaggaggatggcttgtggccggctgatcaatttagacgtttcagaggaaaacattacccaacacacaattctagagaacctacagaatgagctacacacacacacacacacacacacacaaactgaaaacacacccatactcacacacacgcagaaactcacaagttctaacacacacagacacgcgcacsckctgaagaaacagtgagtttctgcgtgtgtgtgagtntgggtgtgttttcagtgtgtgtgtgtngttttgtgtgt

SEQ ID NO: 20005 - DNA, 187 bp, Homo sapiens
  misc_feature 27: m=a or c
  misc_feature 52: s=g or c
  misc_feature 64: k=g or t
  misc_feature 96: y=c or t
  misc_feature 187: s=g or c
tgcaacctctgcctcccagattcaagmaattctcccgcctcagccacctgastagctgggattkcaggtgcccaccactacacccagctaattttygtatttttagtagagacggggtttcaccatgttagtcaggctggtcttgaactcctgaactcaggtgatccacccacctcggcctcccaas

SEQ ID NO: 20006 - DNA, 190 bp, Homo sapiens
  misc_feature 74: y=c or t
ttaaataagatacttctaaaaaatccatgggtcaaataaaaatcaaaagagaaattagaaagtatttgtactcyctaaaggaaattagaaagtatgtggatcaaataaaagtgaaaatagaatatagaagcaaagagttttaaaaaatgaagctactgaaaacaaattccatatttttcctgccccccca

SEQ ID NO: 20007 - DNA, 188 bp, Homo sapiens
  misc_feature 14: r=a or g
gctttgtcacccargctggtgtgcagtggtgtgatcatagcttactgcggcctcaaactcctgggttcaagggatcctcccacatatctagaactacaggtgctggccaccatgcccagattttttaatttttttcccccagagatgggagtctcgctgtgatacccaggctggtctttttttttttt

SEQ ID NO: 20008 - DNA, 98 bp, Homo sapiens
atccaggaggtggaggttgcggtgagtggagatcgtgccattgtactccagcctgggcaacagagcaagactccatctcaaaaaaaaaaaaaaaaaaa

SEQ ID NO: 20009 - DNA, 117 bp, Homo sapiens
  misc_feature 22: m=a or c
cccccacgcctggcttggctgmtgtttgtgtttttagtaggcacgccgtgtctctccatgttgctcaggctggtctccaactcccgacctcctgtgatgcgcccacctcggcctcga

SEQ ID NO: 20010 - DNA, 171 bp, Homo sapiens
  misc_feature 7: w=a or t
  misc_feature 8: m=a or c
  misc_feature 17: s=g or c
  misc_feature 117: s=g or c
  misc_feature 118: s=g or c
ctccttwmcaccggagsaaaggggagaaggcgggtagtcatcaattccaggtccagcctaagttctgggtccccggccccagcgagagcctcgcctcgcctcgcgcgcctgcgggassggctggcttcctgaacggccctcgcctcttcaccaccagggccgcccaccgaa

SEQ ID NO: 20011 - DNA, 130 bp, Homo sapiens
tgttttgggcacatattttcaacttccagaccaatacaaaatgtaaaataagtaaaaaacgtgatatagttgtatcctttctaaacactgacctattttttttcctttgctacccttttttttttttttt

SEQ ID NO: 20012 - DNA, 308 bp, Homo sapiens
acatatttgagggaactaagtggtgttcggaggcacagtgacgattcgagagattctggaggacgcatgttgggtgttggtggttttccagttggtatcatagtgtcatattctcttcaattgtaggtttagctctttgggacccaaaaagacaagattagtcaggatagtgacatgcacttggcatgctgtggcttctgttgaggaaaaagtgacccaaatttgaacatccaacttcaattcttagtaattggcaatggctccttgcatctctttctgcttgactataaaactataaaatgctgcta

SEQ ID NO: 20013 - DNA, 357 bp, Homo sapiens
tgctttgttttattattttgctaataaaattaaattcactgtacattgttccagaagtatgttgactctaaggaaaatgttttaaatggaatagcctgaggatatcattgtggggaagtattggatgtccttgatcttttctgttcattgtagatgttttctagaagacagcacatcttaaagatatttcaggcttcttatgaaggaaacagtaaaccttttacaaactatattttccaattttcttgtcttttcttgaagtaccactgtacaactcttgttggagagctactgtaattatttgtgacatgtttttctttggccaattctctatggcttctactcagtacagcctga

SEQ ID NO: 20014 - DNA, 174 bp, Homo sapiens
atgaagccagcactggggcacatatgcactgcggtttcttttcaaaagacctctccagttgctgttcatgctcatgagaaggtgtcctagactgaattagctggagatgtcatacactgccgatgaatcgtgtgacgatgactgcatgtttgcagatatatttaccccaggcat

SEQ ID NO: 20015 - DNA, 144 bp, Homo sapiens
  misc_feature 13: w=a or t
  misc_feature 31: s=g or c
  misc_feature 32: r=a or g
  misc_feature 43: s=g or c
  misc_feature 44: s=g or c
gggtaccaagatwataggtgtgagccaccasrcccagcctctsscttacttttgaaggacagttttgccagatatatgattcttggttgacaattctttctcttagcatcttgatatattatcccactgctttctggcctccaa

SEQ ID NO: 20016 - DNA, 167 bp, Homo sapiens
  misc_feature 24: w=a or t
tatgactcaagagttttttggttwtgttttttctgagacagggtctccctccctgtctcccaggctagagagcagaggtgggctccctgcagccttgacttcctgagctcatgtgaccctccaaccttagccccccaagtagctgggactactggggcacgccacca

SEQ ID NO: 20017 - DNA, 105 bp, Homo sapiens
tggaaaggaatggaatgcaatcaacccgagtgcaatggaatggagaggaatggaatggaatggaaaggaaactacccgaatggaatggaatggaatggaaaaggg

SEQ ID NO: 20018 - DNA, 108 bp, Homo sapiens
atatgagaaaagtttaagacagagatggcgtgttcctcctcttgctttctgaggatgccctattctgtgactgagtagctttcaataaactatcctctccctgcacac

SEQ ID NO: 20019 - DNA, 227 bp, Homo sapiens
acggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaagaa

SEQ ID NO: 20020 - DNA, 114 bp, Homo sapiens
  misc_feature 25: m=a or c
caggaggctgacgcaggagaatcamttgaacccaggaggtggaggttgcagtgatctgagattgtgccactgtacttcagcctgggcgacagagggagactcccatctcaaaaa

SEQ ID NO: 20021 - DNA, 263 bp, Homo sapiens
  misc_feature 259: w=a or t
ttaaatgagaagtttaagaaagtacaataatgcaagagaaaggcataaaaattagagagtatgatgaaaccccatctctactaaaaatacaaaaattagctgggcatggtggtgtgcacctgtggtcccagctactcagaaagctgaggcaggagaatcacttgaacccaggagacaggttgcagtgagccaagatcgcaccactgcactccagcctgggcaacaagagtgaaactctgtctcaaaaaaaagaaaaaawaaaa

SEQ ID NO: 20022 - DNA, 86 bp, Homo sapiens
  misc_feature 37: b=c or g or t
aagactatactttcagggatcatttctatagtgtgtbactagagaagtttctctgaacgtgtagagcaccgaaaaccacgaggcaa

SEQ ID NO: 20023 - DNA, 98 bp, Homo sapiens
  misc_feature 76: r=a or g
  misc_feature 77: r=a or g
aaggaaaaagcattttgtattattgggacaggatactacaaaagccctaaaatagatagtggcaatgggaatgagrrcaagagagtagattcaaggga

SEQ ID NO: 20024 - DNA, 351 bp, Homo sapiens
ggataggaaattctgggttggaaattcttttctttaagaatgttgaatattggcccccactctctgctggcttgtagagtttctgccgagagatctgctgttagtctgatgggcttccctttgtgggtaacccaacctttctctctgactgcccttaacattttcccctcatttcaactttggtgaatctgacaattatgtgtcttgcagttgctcttcttgaggagtatctttgtggcgttctctgtatttcctgaatttgaatgttgacctgccttgctaggttggggaagttctcctggataacgtaatgcagagtgttttctaacttggttccattctccctggcac

SEQ ID NO: 20025 - DNA, 105 bp, Homo sapiens
agagtcgtcgctgcggtcgctgaggaaggacggagcagaggcccgcgctgtctggggagaagactgtggtgtcatcccgtcgggaatgaagggaaatgcagcgac

SEQ ID NO: 20026 - DNA, 58 bp, Homo sapiens
ctttaagtttgactattttagattccacatatgtgagatcatacagtatttgtctttt

SEQ ID NO: 20027 - DNA, 105 bp, Homo sapiens
ttgtgcaggttagttacatatgtatacatgtgccatgctggtgtgctgcacccattaactcgtcatttagcattaggtatatctcctaatgctatccctgccccc

SEQ ID NO: 20028 - DNA, 277 bp, Homo sapiens
taaaacaacagctagctaacagagttaatcccaaccatattattaatcattttaaatataatggtgtaagcacctcaattaaaaagagactgtcagattggatttttttacttttttattttattatttttttaattatactttaagttttagggtacatgtgcacaatgtgcaggttagttacatatgtatacatgtgctatgctggtgtgctgcacccattaactcgtcatttagcattaggtatatctcctaatgctatccctcccccctccct

SEQ ID NO: 20029 - DNA, 100 bp, Homo sapiens
aacctcggctcactgcaacttccgcctcccaggttcaagcaattctcctgcctcagcctcccaagtggctgggactacaggcgcacaccaccacgcccag

SEQ ID NO: 20030 - DNA, 174 bp, Homo sapiens
  misc_feature 32: k=g or t
caccctcaggaccttggatgagcttgtgtgtkcaggaaattgggcaccgagattttttttgtatctttgattttagttgatatgtagtccttccaaggaaagtattcgttggatgccctttctacactttggcattgtgcaagaggtatcaaattttaaagtaaaagtgcacca

SEQ ID NO: 20031 - DNA, 135 bp, Homo sapiens
ttggtgaggatgagttggaagaggctctctctgtccccactgctagtaggaatgtacataagcactaccttttttaaaaaaaaacaacaaaaaaagagatattaagctccttaaaaacatccatacccctgtcct

SEQ ID NO: 20032 - DNA, 105 bp, Homo sapiens
ttgtaccaccacgcccggctaattttgtatttttaatagagatgcggtttctccatgttggtcaggttggtctcgaactcccgccctcaggtgatctgcccgcct

SEQ ID NO: 20033 - DNA, 128 bp, Homo sapiens
tggtggtggccactatagtcccagctactcaggaggctcaggcaggagaatggcgtgaacccaggaggaggagctggcagtgagccaaaatcgcgccactgcactccagcctgggcgacagagctaga

SEQ ID NO: 20034 - DNA, 82 bp, Homo sapiens
  misc_feature 35: s=g or c
  misc_feature 81: k=g or t
gtttcctttgaagcagaaggccggaacaagcgtasaataaacttgctggacttggagagaaggctaagacaaacccgccaka

SEQ ID NO: 20035 - DNA, 207 bp, Homo sapiens
  misc_feature 23: w=a or t
tgatgtaatcccacttgtctgtwtcggcttttgttccttgtgcttttgggggtcatatccaaacaaagattgctgaggggccaaattttaaattgtgtataattttaatgacttcagatttaaatagctgcatttggcttatggagtcttttgagcagcatggttttaaaaaggtttttgccaagtggggttctaatggacaccttc

SEQ ID NO: 20036 - DNA, 124 bp, Homo sapiens
tgatcctttgtcaccaagaagagattatatgtatcttcaaaacatgaacatatttctcccttgtcattcatccatctgtccattcattccacaggcattttctgagaactctcagagggagggg

SEQ ID NO: 20037 - DNA, 228 bp, Homo sapiens
ccatcttaaattcattgaagtgtacatttcagggccaggcatggtggtggcttacatctgtaatccagggattttgggaggccaagacaggagtatcacttgagcccagaatttggagaccagcttgggcaacatataaagacccagtctacaaaaaaaactatttttaaagacaggcatggtggtgtgcacttgtggtttcggctgcttgggagattgatgggggag

SEQ ID NO: 20038 - DNA, 129 bp, Homo sapiens
aaattagctggctgtggtggcacatgcctgtaatcccagctggggcaggagaatcacttgaactcaggaggtagaggttgcagtgagccaagatcgcaccactgtattccagcctgggtgacagggcga

SEQ ID NO: 20039 - DNA, 155 bp, Homo sapiens
  misc_feature 12: y=c or t
  misc_feature 48: d=a or g or t
gtgtctgtagtyccagctattctggaggctgaggcaacaggatcactdgagcccaggagttcaaggctacagtgatctataatcatgctatagcactccagcccagatgacagagcaagactctgtctcttaaaaaaaaaaaaaaaaaaaaaaaa

SEQ ID NO: 20040 - DNA, 231 bp, Homo sapiens
  misc_feature 211: y=c or t
gaatcaaaactaaatttcttaacacggtataaaaacagataagctcctgcccgtttctcttgccccttatctcacttcactgaacactttaaaactctcttatcctaccacactgaattccttttagttgtcaatgtgctgacttgtgtatctgtgtctttacttacactgcttgctcaggccttcttggttttattctcttttttttttycttttttttttttttttttt

SEQ ID NO: 20041 - DNA, 102 bp, Homo sapiens
atgtacaggaaatttctgcttttaaaaagggttctttggaactgcaacttggaaataccagttttgaaactggttttgaaaaggtctgaactttggggaagc

SEQ ID NO: 20042 - DNA, 89 bp, Homo sapiens
ctttggcactgtctcaccgtctttcctttttcctcggctgtcagcgttttcctgttgcccattggttttgttttctttttttttttttt

SEQ ID NO: 20043 - DNA, 52 bp, Homo sapiens
actctgtaaatatactaaaacttacgtaattgtatacttttttttttttttt

SEQ ID NO: 20044 - DNA, 84 bp, Homo sapiens
ttttatgtttgctggctgcatacaagtcttcttttgtgaaatgtctgttcatatccttcacccactttttcatggggttgtttt

SEQ ID NO: 20045 - DNA, 269 bp, Homo sapiens
  misc_feature 23: m=a or c
  misc_feature 41: s=g or c
ctgttcagccgcacgcgcggggmgtcacatgcgcggctacscgcacggcttgaagtcaacgcgagatatcaagccaaaacgaccccaagtgcccgtccatcaagcgtcgctagctatccaataaagagcaaaaacaaaagcgcccagggcgcttttgttcttgtcgatgggtgcgtgaacgcttgggccccacacgagtgcagccgggatagctaaccgccgcgcaatgcccgtgcaggcactccagcggcgccacctcccgccgccca

SEQ ID NO: 20046 - DNA, 249 bp, Homo sapiens
  misc_feature 246: s=g or c
cacacacacccacagtcacatgtacacaatcacatacaacacacacatgcattctcatacactcttacacagtcacatgcaatcacatacaacacacatatgcattctcatacactctcacacacccacagtcgcatgcactcatacgccatcacatacacactcacataaacccagttaattacatgcacacaatcacatacaacacacacatgcattctcatacactctcacacacccacattstca

SEQ ID NO: 20047 - DNA, 116 bp, Homo sapiens
gagtacatcttggctcactgtgatctccacctctgggctcaagtgattctcccacttcagcctcccgagtaacttaaattacaggcacgcactaccacgcgtggcttttttttttt

SEQ ID NO: 20048 - DNA, 105 bp, Homo sapiens
acagttggctctgccgtgtgattgcatttgtgtattgtgagctagaaatgatccccccgcccccgatggtagccatttgtcccggggacatctgttgaggccggg

SEQ ID NO: 20049 - DNA, 82 bp, Homo sapiens
  misc_feature 35: s=g or c
gtttcctttgaagcagaaggccggaacaagcgtasaataaacttgctggacttggagagaaggctaagacaaacccgccaga

SEQ ID NO: 20050 - DNA, 132 bp, Homo sapiens
ctcaaaaaaaaaaatcctagaagaaatgaacaattcttatatgtcgaattgccagatcaaggggtgtaccatcaccatccccatactcaccatcactatcctcattatcatcatcagtctcaccctcaccgc

SEQ ID NO: 20051 - DNA, 138 bp, Homo sapiens
  misc_feature 82: k=g or t
catgaaatcaatggactgtgaggtcaaagttctagaactagctcagccgctgttctgtcctgtgactttgggtaagacagtktatgtctgctttgcccatctgtgcaatttagttcttcaaagctgcaaggaggcaca

SEQ ID NO: 20052 - DNA, 57 bp, Homo sapiens
tcttatctggaaagacttcatttctccttcacgtataaaggagaaatgaagtctttc

SEQ ID NO: 20053 - DNA, 366 bp, Homo sapiens
  misc_feature 32: s=g or c
  misc_feature 337: n=a, g, c or t
  misc_feature 356: k=g or t
ttctggttattaatcacttgtcaaatggatgsttttccaatattttcttcctttctatgtgttgtcccttcaatgtcttgattgttcatttgcagaagaaactttttagcttgatataaacccagttctatatttttgctttggttgcctgtgctttcgaagtcgtatacaaaaaaaaattgccaagaccaatgtcctggagcatttccccaatgttttcttctagcagtttcatgatgtcaggtcttagattcaagtctttaattcattttgatctgatttttttgtgtatggtgagagattcagggtctactttcattcttgtgtacatagctcnctagtttttctagcactgkttcttgaaaa

SEQ ID NO: 20054 - DNA, 137 bp, Homo sapiens
ctttatgtattgtagctattctgatctacttcctattctttaaatgcacttgaactttctttcctttgagttcaatttgatgaaactggcttgtaaggttttttgttttgttttgtctttttttttttttttttttt

SEQ ID NO: 20055 - DNA, 101 bp, Homo sapiens
cctcagcctcctgagtaactggaattataagggtgcaccaccatgccctgctaatttttgtatttttgacggggccatgggatacgtgcagccaccaccac

SEQ ID NO: 20056 - DNA, 346 bp, Homo sapiens
caaataagttcagagtaaagacctctcatagaatttttttttctttttaataatgaagacccttctgagggtactatgtttaacaaaatcaaactcattctttttcaaggtattctgtttctagaaattactgaagagtaaagggaagttgtacataccatatttgattttcagcacctgaatcagacttcgaaagagctgtgcaattacaaacagaaatcacatctcatcattttagtacttcttaaagctataacaattttaaaaatagatgatggagaagaaaaggctcctacactcactcacacacacacacacacacacacacacacacacacacacacac

SEQ ID NO: 20057 - DNA, 376 bp, Homo sapiens
  misc_feature 297: n=a, g, c or t
  misc_feature 298: r=a or g
  misc_feature 331: n=a, g, c or t
taagcaaggaataaaggaatttgattttagtttttagatcatcttggcaatagagggaagagtggtttggaatggggtgagagtggatgtggcagtgttagcaccagtggctcagccttgctggtgatggtggagaggagtaggcagatcaagagatacttaggaaatggagttggcagcttttggttacactggtctggggagggggccgtgagagattagaagtcatggatgactcccaggatggtttttaaatcacagtgggcttagaggccatagtgtgatgtcatttgctgnrgtaggcaacggtggatcaagttgagttgtggtncttgagtaagggaatcgagatgtcagctcaatagctggggtatct

SEQ ID NO: 20058 - DNA, 222 bp, Homo sapiens
cactgtcttatgaaccattatcttcagcaactgtttccactgggagccttttaagttatgaaaacacagatttgagccttacagatccaggtaataaggtcaaaatgtttataaataagttgaaagaccggcaccagttgagttgcaatacagtgatggaaggaagcattgggttttcatgatacaccatggggaactatttctctaaatctcacaagtaaa

SEQ ID NO: 20059 - DNA, 209 bp, Homo sapiens
actcctgcccgatcctccgtgggtgccaggcccagccacgcagagggagagccgccgacccgctggccctttgcaagcagccacgctccatgggggtgccagggggagacacaggcccactgtgcttccaccaactgtggacaactgtgctggacggaccgtcacactgatggcagagccaaccacgaccatcccagaagcaaccccgg

SEQ ID NO: 20060 - DNA, 64 bp, Homo sapiens
tacatgcgtacaggaaaagtccgcgctgctcacggtttctctctctctctctctctctctctct

SEQ ID NO: 20061 - DNA, 259 bp, Homo sapiens
tagaaagtatgaggcagtttagaatatagtttcatttaaaaaaaattgatggggataatgccaattcgtctgagatttcacagaagacatgagtactcatcgtgatcttggggaagggataggtttggggttggcaaagaattgggaacattgggtctggtggggaagaaagtgtcagtgaaaaccagaggtgggactgatcctccatgggatactctatgtgaatgcaatggagagcctgagtccggggagagatagc

SEQ ID NO: 20062 - DNA, 95 bp, Homo sapiens
ttaaaaaggtcatcttagatttatcttagtaaatgtaataaattattttttagatcttgaaatttataataaaaatactttacctaccctgatgc

SEQ ID NO: 20063 - DNA, 98 bp, Homo sapiens
cacttgaatccaggaggcgaaggttgcagtgagctgagattgtgctgctgcactccagcctaggagacagagcgagactctgtcttaaaaaaaaaaaa

SEQ ID NO: 20064 - DNA, 432 bp, Homo sapiens
  misc_feature 359: m=a or c
actttgggaaggatccttctgtggagtttgatcctggggactctgactttagagttcttgctgatctttcctctccctttaaggattccctataaggagcccctgctggtgcaccagaactaccgggggccatctgcccaactgccccagactctggcagtggggcccccgatggcagtgggcacctccccgtgaaacctgccaagctggacgccacagctctgcacgacgacactttggccaactccgtgcccccttcggaggcatgcaaccatgcagtcctagcctgcagcctgggcatccctgaggaacactacataagcgaggctgtggaagatgctcccagctacagagggtamcgggatgcctgcaccattactgatgtgtgcacagcaccgatcttccggaagtcgagatcattagcctgctgga

SEQ ID NO: 20065 - DNA, 181 bp, Homo sapiens
ttaattaaaaaaatataaatcagccagcacttggttttgtgttcaacagtgtatatgcataagtgaaaatatgtatatattaatatgtgcagttacttgaatcatttagttgttttcttcactttactacagcctacataattggacttggtatttaaatgtaatatggtatgcctattta

SEQ ID NO: 20066 - DNA, 182 bp, Homo sapiens
accaagtggaaactaggaaaaggagctagcttttgagggtgtgtggagatggaaatcagaatcggctcatttcattcatttcgtcttccatcactgataccctttcttccagttgatcgcatcggctcctgaggcttctgcattcttcacgtagttctcaagccttggttttcagctccaac

SEQ ID NO: 20067 - DNA, 452 bp, Homo sapiens
  misc_feature 125: k=g or t
  misc_feature 127: d=a or g or t
  misc_feature 137: s=g or c
  misc_feature 138: b=c or g or t
  misc_feature 139: k=g or t
  misc_feature 297: n=a, g, c or t
  misc_feature 298: k=g or t
  misc_feature 299: m=a or c
  misc_feature 375: n=a, g, c or t
  misc_feature 376: d=a or g or t
  misc_feature 386: m=a or c
  misc_feature 388: y=c or t
ccatttctatgtttagatacacagatatttaaccattgtgttataattgtctacagattcagcacagtcacgtgctgaacaggtttgtagcctaggagcaataagtgatatcacatagcctatgkgdgttggtgggsbkgtaccatctaggttttgtgtaagtacactctaccatgtttacacaacaacgaaattgcctaaggactcatatcttagaacgtatcctcatcattaagccacacagactgtaattgttactagcataggtaactttgtgatgcttactgtatgccatankmcgtgctaatacttctgccttcaccataatccccatttttataaggaaattgacataaagagttgtcccatggtcandgcactgctgmcytgaccttgggtccatctgctgccagtgttcttgcttaaactaagctgtgctgtgtcggaggcac

SEQ ID NO: 20068 - DNA, 163 bp, Homo sapiens
  misc_feature 122: r=a or g
  misc_feature 128: m=a or c
  misc_feature 134: k=g or t
cagttatcattatgaaaatgaactttttgagggctggaatgaagaaattataggtgtttagtaaatgaactgaaaatgaaagagcatgagtgaaaagtaaatgagaagtagattgactcagratgccmaccatkgacctgaaagaaggtagggtaccagcaga

SEQ ID NO: 20069 - DNA, 396 bp, Homo sapiens
  misc_feature 186: y=c or t
  misc_feature 258: y=c or t
  misc_feature 285: w=a or t
  misc_feature 293: m=a or c
  misc_feature 306: r=a or g
  misc_feature 309: w=a or t
  misc_feature 310: w=a or t
  misc_feature 315: m=a or c
  misc_feature 316: y=c or t
  misc_feature 330: k=g or t
  misc_feature 339: n=a, g, c or t
  misc_feature 346: w=a or t
  misc_feature 351: r=a or g
  misc_feature 361: y=c or t
caattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgyccaaaaagttaagcaacaagttttacgtgactacaacctggagttctgcaaagaaggtaatatttacttggyctttgactaaagttatctccccattcwatggttamattttattttggrctwwggggmytccaaaaccgtttkggtaaagangagagtwtaagraaattcttgycaaatttcactcaaaagtaatttcatgagaaatca

SEQ ID NO: 20070 - DNA, 146 bp, Homo sapiens
ctaatatccctccatcagtagcagaagaggatctacgaacactgttcgctaacactgggggcactgtgaaagcatttaagttttttcaagatcacaaaatggctcttcttcagatggcaacagtggaagaagctattcaggcctaa

SEQ ID NO: 20071 - DNA, 120 bp, Homo sapiens
tattattatgtactttatttttacttcaatggcaggaattcgaaatattggcatatggttcttttggattagattatataaaatcagaagaggtagaaccaggccccaagcactcctggt

SEQ ID NO: 20072 - DNA, 85 bp, Homo sapiens
tattaggtgtcttatctcccgtgagttagcatcagatgaagcttgctgacagcgtaatggcagggaaagcttccgacgcctccat

SEQ ID NO: 20073 - DNA, 140 bp, Homo sapiens
tagattttaaaaagaaattaataataacttgacttggaagagtaaagttatatttcccatgaccacctccttacaactctaacatatcggtacctcactgttattgccaactactactattttttttttttttttttttt

SEQ ID NO: 20074 - DNA, 274 bp, Homo sapiens
ttttagagatggggtttcgccatgttgtctaagctgatgatacttattttaattttttaaataacacaaataattttaggatttactcataaatagtattaaatatagcagaacagctctaacttgctctctatgaccactgacagattattttaatactctagttttcatttccttatctggaagaagatagacttggactaaatggtctctaaattgtctttaaattctgtcagcttgtaagtcttcagtttgttcaaatcagctctaccac

SEQ ID NO: 20075 - DNA, 351 bp, Homo sapiens
  misc_feature 137: k=g or t
  misc_feature 142: k=g or t
  misc_feature 297: v=a or c or g
  misc_feature 299: s=g or c
cgtttcattatgtacccagtagtcattcaggagcaagttgttcagtttccatgtagttgagcggttttgagtgagtttcttaatcctgagttttagtttgattgcactgtggtctgagagacagtttgttataattkctgtkcttttacgtttgctgaggagtgctttacttccaactatgtggtcaattttggaataattacagtgtggtgctgagaagaatgtatattctgttgatttggggtggagagttctgtagatgtctattaggtccacttggtgcagagctgagttcavtsctggatatccttgttaactttctgtctcattgatctgtctaatgttgacagt

SEQ ID NO: 20076 - DNA, 67 bp, Homo sapiens
acctgataagttagtcatcttaatctgacacattgtaaagtaatctccttgttttaacttttttttt

SEQ ID NO: 20077 - DNA, 389 bp, Homo sapiens
atttcaaaggcagagttccagaccagagaggtctttccatacaatgaaagctataactagctggttgtgtttaaccactgctatcacgctatcctgggactgcatagaactttgacaaaagacagacttcatggtacacaacttcaacagattttctgtcatattctcaccagcacatctgaatgaggctttgtgttttccttgctctcttgcatgttccttttcaactcatggcccacagtgactctcagagatttatgccaaaattgcatacaattgttttctgaatcataacttgtctatttttctgcctatgtgtgctactttcagtttgtttctcatcaacattttgactctcagaagagctccatttgccctttctctcttta

SEQ ID NO: 20078 - DNA, 144 bp, Homo sapiens
caacattcactgggcacttaccgtgccctgattgaagcactttaacatatattatttaatcacataaaaaccttcatgaggtagatgttattatcttcattttacaacagaatagaagcacagagagtgaaattaacctgaccc

SEQ ID NO: 20079 - DNA, 183 bp, Homo sapiens
ttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcac

SEQ ID NO: 20080 - DNA, 89 bp, Homo sapiens
actgagacgccattttcggcggcgggagcggcgcaggcggccgagcgggactggctgggtcggctgggctgctggtgcgaggagccgac

SEQ ID NO: 20081 - DNA, 211 bp, Homo sapiens
cactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgccta

SEQ ID NO: 20082 - DNA, 256 bp, Homo sapiens
  misc_feature 87: k=g or t
  misc_feature 96: s=g or c
  misc_feature 97: m=a or c
  misc_feature 98: s=g or c
  misc_feature 126: y=c or t
  misc_feature 133: w=a or t
  misc_feature 139: s=g or c
  misc_feature 140: r=a or g
  misc_feature 141: s=g or c
  misc_feature 148: r=a or g
  misc_feature 151: r=a or g
gcctggagagagggagccggtgtcctacgtcagagccgccgccggggaggagcagccgctgccgcccaggactgggcccttagggakgaggaggcsmsaagatggcggacgaccccagtgctgccygacaggwacgtgsrsatctggragrtcaagaagctcattaagagcttggaggcggcccgcggcaatggcaccagcatgatatcattgatcattcctcccaaagaccagatttcacgagtggcaaaaatgt

SEQ ID NO: 20083 - DNA, 119 bp, Homo sapiens
aagataaacttattttagagtttttgtttcaaagtcttttctcaaaatttactaggaaagtttgggccctgtgtcatgtgacttctttctggggtccattattcttgggtacccgacct

SEQ ID NO: 20084 - DNA, 160 bp, Homo sapiens
cccttgtttaattaggcaatacccttgttaattgccctttggcaactaacttaaccatgtgcttcccacacagtacatcaggaaaacttacagggcaatatttttaacttggggcaggaaagaagggagcagcagagaattgactagatatagcaccctg

SEQ ID NO: 20085 - DNA, 110 bp, Homo sapiens
tacttagactcaaccttattctgcttatttgcttttagttctgttctggacactgtgttacttagacccaaagaaaagaacgatgtagaatattatagtgaaacccaaga

SEQ ID NO: 20086 - DNA, 97 bp, Homo sapiens
ttgtaagttgagtattccacagaaagtggtaattatctcttctctcttcctccattagaaaattaggtaaataatggattcctataatgggagcacc

SEQ ID NO: 20087 - DNA, 150 bp, Homo sapiens
tcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcactc

SEQ ID NO: 20088 - DNA, 55 bp, Homo sapiens
ggatgccagtttgaaggatcagtgtctctttgggacatggtcttccctcgatgga

SEQ ID NO: 20089 - DNA, 80 bp, Homo sapiens
caagtattatgacagagaaatatactagatgtctgagagcatatggccatgaaatctgatctagtccaaggacatagtaa

SEQ ID NO: 20090 - DNA, 382 bp, Homo sapiens
  misc_feature 120: y=c or t
  misc_feature 277: m=a or c
  misc_feature 297: w=a or t
  misc_feature 299: n=a, g, c or t
  misc_feature 300: w=a or t
  misc_feature 317: w=a or t
  misc_feature 318: b=c or g or t
  misc_feature 319: n=a, g, c or t
  misc_feature 320: r=a or g
aaaggtaaatgtaacaagtaaaataagtaatttatttatatacaaaccaataggaaaacaaatacagttggcctttcatatccacagcttccacatctgtggattgaaccatccgcagtyctaaaacatttagagaaaaaaaaaattttaaatacagtataaccatttacatagggtttacattgtagggtattgtaagtaatctagaggtgatttaaagcatatgagaggatgtgcataggttatatgtaaatactatgccattttatataaaggmcttgagcatctgagaatttwgnwatcatcgggggtcctawbnrccatttccctgtggatacagagtgatggctgtaattctcaaagaaatgcatggctaagcaac

SEQ ID NO: 20091 - DNA, 107 bp, Homo sapiens
aagtgctgggattacaggtgtgagccaccacgcccggcctcttgctcgatttctaaaaactctctcaatggctagagattccccacacctctcactaaaggggcagc

SEQ ID NO: 20092 - DNA, 120 bp, Homo sapiens
atgagtgagactttggaaccttcatcccaccattagccaggttgaaacaaagtttgaaaccactcttttagggcatttcctataaatttgtttactctttccttttcctaaggccccagc

SEQ ID NO: 20093 - DNA, 125 bp, Homo sapiens
  misc_feature 120: m=a or c
cagatttacaatctccattttcattaacggggaaacatccccgagccactgagtgctgtgctttgtcactgaaggttagatctgaacccagggtgtcaactgctgctctcaactccccamccacc

SEQ ID NO: 20094 - DNA, 67 bp, Homo sapiens
gtgtcttacttaatattctagatgtgatggtgtttaagtactcacttttaaaacaggaaaaaaaaaa

SEQ ID NO: 20095 - DNA, 84 bp, Homo sapiens
atctcacggcttgacgatcaagggggcaaagcctcggtcttcatagaaaaggagaggaggcaaacgcagcccaaactgggggac

SEQ ID NO: 20096 - DNA, 196 bp, Homo sapiens
  misc_feature 138: n=a, g, c or t
  misc_feature 139: n=a, g, c or t
  misc_feature 192: s=g or c
caaagagcaaaaatttacactttttcttttctaacaccgtgaaaatcactgcattttccaagaaaaatgagaacattttcaattgtgatttaatagattctgtagatcaaattaaaaatatgccatgcttggatttannggaatttggaaaggatgttaaaccttggcatgttgaaacaacagaagctgccscatg

SEQ ID NO: 20097 - DNA, 175 bp, Homo sapiens
  misc_feature 64: r=a or g
  misc_feature 74: w=a or t
  misc_feature 126: y=c or t
  misc_feature 133: s=g or c
gtcagaccagttgctctcaaaccctgtctcctgataagatgttatcaatgacaatcgtgcccgraacttcattwagcaattttaattttaccccggtcctgtggtcctgtgatctcgccctgcctyccattgsccttgtgatattctattaccttgtgatgtatgtgatctctgt

SEQ ID NO: 20098 - DNA, 148 bp, Homo sapiens
cattctcctgcctcagcctcccgaggagctgggactacagggacccgccaccacgcccggctaatttttttgtatttttagtagagacggggtttcaccgtgttagccaggatggtctcgatctcctgacctccctgatccgcccgcc

SEQ ID NO: 20099 - DNA, 109 bp, Homo sapiens
agtctatatttttagcactaataatatttgttatatatatttgggtgctttggtgttggtgcatatatatttacaatattatatcctcttgctgaattgacccctattg

SEQ ID NO: 20100 - DNA, 192 bp, Homo sapiens
  misc_feature 140: r=a or g
  misc_feature 143: m=a or c
tcaagaaaatattagctcggtgttatacaaagaaaacatgggcaagggaactcctttagctgtcactcccgagatggagcgagtcaaacacaatcaagaaaatattagctcggttttgtacaaagaaaatgtgggggaargcmaccgcaacccctgtcactcctgagatgcagagagtcaaacgcaatcttc

SEQ ID NO: 20101 - DNA, 449 bp, Homo sapiens
  misc_feature 139: m=a or c
  misc_feature 149: m=a or c
  misc_feature 343: n=a, g, c or t
  misc_feature 354: n=a, g, c or t
  misc_feature 355: n=a, g, c or t
  misc_feature 356: n=a, g, c or t
tttcccactcttccactgacttgctgtgtgaccttaggaagtctctgcccctctctcagcctcagtgtcccgagggccccgaagcattccattctcgtggaggagtttccttgctgagatttcaaatagtcctccccamctcaactgtmaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcncaccttgaaannnctcttggctcctgccgggttcctgctcaggctggaattgggaaaatatgcaggtgacatttgttcattctctaatcccatcctctcacccacg

SEQ ID NO: 20102 - DNA, 100 bp, Homo sapiens
ccctgaaagtactttgtgagtccttctctaaagcaaacataacaaatgtcaaagagcttggggaagccctcccttggtgatcaggcagattcgagggcgc

SEQ ID NO: 20103 - DNA, 340 bp, Homo sapiens
  misc_feature 157: h=a or c or t
ctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcchgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtcccactttcatagtagacttttttttttttt

SEQ ID NO: 20104 - DNA, 260 bp, Homo sapiens
  misc_feature 138: d=a or g or t
  misc_feature 159: h=a or c or t
attcttttctctccttttgctatgtgaagaaggacatgtttgcttctcctgccatggctggaagtttcctgaggcctccccagccatcctgaactgggcttcccctgcacttggtttttcattcttctgtcgcctgcdgccatgtgaagaaagaagtghttgcttccccttccatcatggttggacgtttcctgaggcctctccagtcatgctgagctgctggattgcaatggcgatcttggctcactttaacccccgcc

SEQ ID NO: 20105 - DNA, 373 bp, Homo sapiens
  misc_feature 367: d=a or g or t
agatgaggcctagccgaggcggcgggacccccaagtttggaaagctcttttaacgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgcctgtcccccggattacagtdagccac

SEQ ID NO: 20106 - DNA, 61 bp, Homo sapiens
caaatgaaatttttctaatgttaggctcttgattttgattttttttttttttttttttttt

SEQ ID NO: 20107 - DNA, 116 bp, Homo sapiens
ttacctgtgcatccaccatctaccctatgctaaaaggattattctgcacagtagaataatcgcgtattcacggattcttacaatttccttttttatatctatgtatcacagagagc

SEQ ID NO: 20108 - DNA, 303 bp, Homo sapiens
  misc_feature 140: m=a or c
  misc_feature 145: k=g or t
acaatctgtgaggattgagaggataggctggtgctttgaagaaaggccttgtaagtgacaagacagtcccctgggaagaaagagaaaggaaatgggctattgccaaaggacaggtggcgttagatggctgtgagggtgamctggktgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagct

SEQ ID NO: 20109 - DNA, 76 bp, Homo sapiens
  misc_feature 38: s=g or c
agtaagatcgagcgaggagcccaagagcgagcgcgcasacgaagctcgagccgcctccgccgcgcgaccccaacta

SEQ ID NO: 20110 - DNA, 164 bp, Homo sapiens
  misc_feature 86: m=a or c
tttaactaaacgcaaatctgtagattctctcctctcccatcccagaaaacaaaacaaaataatgcttttcgaaattgtttctaggmctttaaaacataatggtatatccaaaattctttatttcagaatgcaacaatagattccattaatatagactcaagatg

SEQ ID NO: 20111 - DNA, 432 bp, Homo sapiens
tgaggtcgaaaatcttcatcagtatttgaggacttggttcttaagatatattcaagaatgctttccctttgcccaaaggtgaaagtatcattaaagttgtcttagtatggtaaggattttttttttctctgcttggcagttaagagttcaacatggggctgggcggggtggttcacgcctgtaatcccagcactttgggaggcttaggcaggcgttcgagaccagcctgggcaacatggcgaaaccctgtctctacccaaaatacaaaaattggccaggcatagtgctgcatgcctgtggtcccagctatgcaggaggctgaggcggggcaatggctggaggccaggaagtggaggctgtggtgagccgtgattgtatcactgcactccagcctgggtgacaggagaccctgtctcaaaatcaaaggagttc

SEQ ID NO: 20112 - DNA, 207 bp, Homo sapiens
acatttcaactgaacttgtagaaataaaaaagattatgaaggcatattatgaataattttatgtcaataaattatcaatgaagtggacaaattcctaggaagacacaaactaccaaaaccaaactcagaagtagaaaacttgaataaacctatatcaagtaaataggttaaatgagtttttgaaaagatacccacaaagaagagcct

SEQ ID NO: 20113 - DNA, 141 bp, Homo sapiens
gcctctccctataggtaagccaaccagcagtatgacctcccctctgggtgttaactcctcggcctctgtaatcaagacagattcttatgcaggcccagactctgctggtccgcttctcaaaagttctctcattaccccaac

SEQ ID NO: 20114 - DNA, 141 bp, Homo sapiens
cactgtgaatactgcaaagataccagtgctcaatggtataatgtttaatataagagtttaatgtaaggtttggtgagtaaaccaggactatagcagggaaaggagttaaaaagccttatctagctagcctgttcttttgcc

SEQ ID NO: 20115 - DNA, 123 bp, Homo sapiens
  misc_feature 89: m=a or c
gaactgggttaggtgccgctgttgctgctcgtgttgaatctagaaccgtagccagacatgggactggaggacgagcaaaagatgcttamcgaaatccggagatcctgaggaggaggaagagga

SEQ ID NO: 20116 - DNA, 164 bp, Homo sapiens
aagattagaaagggaaaatgaaatctcaggaaaggaaatgcaagattgcatgagaacatcatggtgttttgtgggataggtgatattctgccaaaataaagaggcccgcccctccactccttttgcaaacctgagcttttcccctgcctgcagttgagcccgaa

SEQ ID NO: 20117 - DNA, 116 bp, Homo sapiens
  misc_feature 94: m=a or c
tattagtgaacagttacagaagaatggtctgagaaaaaatggtattttgaaaaatggcttgatctgtgacttcaagtttggaccgtggaagaamcagcactttcaaacccacaact

SEQ ID NO: 20118 - DNA, 167 bp, Homo sapiens
gttctttggtgatacaaacactgtattttgagtaatcttttccctatatttcgaaatgctgcctttatcacctactaaattcctaaatgtgttcttgggcctgttcctctattatcttcaattggtatgtctgcttattatttctttggttttgatatctgggttag

SEQ ID NO: 20119 - DNA, 252 bp, Homo sapiens
tttcaaacaatttcggtagtattgttccatactagctcttctttgtatggggttgtttttgcatgttgaattgtttcaatttcttacagattctggttattggacctttgttggatgcatagtgtattagtctgttctcatgctgctatgaagaaatacccaaaactgggtaatttataaagaaaagaggtttcatttactcacagttccacgtggcttgggaggcctcaggaaacttagaatcatggcatc

SEQ ID NO: 20120 - DNA, 249 bp, Homo sapiens
  misc_feature 87: r=a or g
  misc_feature 215: r=a or g
  misc_feature 227: r=a or g
  misc_feature 230: r=a or g
  misc_feature 249: k=g or t
ccatcagccttaaccctgggaaatgcctgctgcccccagtgactcttggtttcgtctcccacatacagaagcagggtggaggggaarggtgggtctcagttagcaggggtccccagggcaagtcagcctcctccctccatgcctctctggtcagtgtgccttagggtggcctctcactcccaccactctgggccccttgggggaggactggggarggggccgtgggraarccctgacgctggaaccatk

SEQ ID NO: 20121 - DNA, 189 bp, Homo sapiens
  misc_feature 106: d=a or g or t
taggatagtgcttttgaagaatttttatgatacagggaaagcttgggtgaagggccaagtggaaaaacaggacaaaatacaaaattgtctgtgcaaagagatcctdcattctttatcaattaaaagtagccatatacccattcattgacccttaaaagcatgaacgtgcatgggggaagaaaaggctgc

SEQ ID NO: 20122 - DNA, 123 bp, Homo sapiens
ctacatctccccatccacccccttcccatgttattttgaagcaaattcttgatacatttcatctgtagatatttcagtgtgtattttaaaaagaattaggacttaaccacaattatcccacct

SEQ ID NO: 20123 - DNA, 171 bp, Homo sapiens
  misc_feature 37: r=a or g
  misc_feature 44: r=a or g
  misc_feature 54: r=a or g
  misc_feature 75: s=g or c
  misc_feature 83: m=a or c
  misc_feature 89: r=a or g
  misc_feature 91: w=a or t
aaaaaaaggaaaacaagtaggaaatcgcttccgaaaraaggcaragggggcgaraaacaccaatcactgggaaasccaaaagmcccaargwtcacaacctcaggggcatcctcaaagaccaagaccgctcataagctacacagagaactgttcccctcccagccaccgcct

SEQ ID NO: 20124 - DNA, 102 bp, Homo sapiens
gaaaaggaaaataaagagctattaaaggatgtggaggtagtgagacctctagaaaaagaggctgtaggccaacttaagcctacaggaaaagaggacacacgg

SEQ ID NO: 20125 - DNA, 283 bp, Homo sapiens
cctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatacgtagaacatgagtctctcctcc

SEQ ID NO: 20126 - DNA, 174 bp, Homo sapiens
atttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggccg

SEQ ID NO: 20127 - DNA, 93 bp, Homo sapiens
  misc_feature 56: k=g or t
  misc_feature 86: s=g or c
ggaagtggtgaccgtgagagaagaagatggcggcccctgtagtggcgccgcctgcktgtggtggttagtcgggctaacaagcgcasgtcgcac

SEQ ID NO: 20128 - DNA, 147 bp, Homo sapiens
aacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaa

SEQ ID NO: 20129 - DNA, 392 bp, Homo sapiens
  misc_feature 128: s=g or c
  misc_feature 312: s=g or c
acagctgaaacgccagcaccagtgtgaggatggccaggcctctggagcaggcggtagctgccatcgtgtgcaccttccaggaatacgcagggcgctgtggggacaaatacaagctctgccaggcggastcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctsagagcccccctgctcccagtagcctctgctccagggggtgcgctggctgtcgggggctgggcatgtctcccacgcccccc

SEQ ID NO: 20130 - DNA, 186 bp, Homo sapiens
  misc_feature 95: s=g or c
  misc_feature 105: m=a or c
cattgttcttcctctaaactgcctcttgggctttacatcaggtcaaggatttttagggtttctcaaaaataggattcttgtcagtgtatgcatgstgagtaagtmacctttctggctctaatttctgggtggccatctgttgtccagctctgctgccaactggactttccgaaagccatgtcaact

SEQ ID NO: 20131 - DNA, 158 bp, Homo sapiens
  misc_feature 99: s=g or c
acacagaacctcatctcctacggtgctgaagcctgcagcagggcaggatgggcaggagagcagagccgcggagtctgcggcgcgggtgaagagcggcgsgtaaattcccgcagcaagattgttccgcgcccgcagcccctggactagcaggatccccc

SEQ ID NO: 20132 - DNA, 66 bp, Homo sapiens
  misc_feature 2: n=a, g, c or t
anaaggcaaagggcggggcgcgcgcgtcgggaagatggcgctacgtctgctgcggagggcggcgct

SEQ ID NO: 20133 - DNA, 280 bp, Homo sapiens
taactgttacgagggcccctatggacctataatttggcaccctgttccacttaattctttttaccctgtctttctaggtgtctgtagtttaagttattaaagcttcttttacaatgaagatagaattacattttaatactgaggatgcagactcttgcactttttttttttaaagacggagtcttgctctgtcgcccacactggagtgcagtggcgtgatctgggttcactgcaacctctgcctcctgggttcaagcgattctcctagctcagccgccca

SEQ ID NO: 20134 - DNA, 301 bp, Homo sapiens
  misc_feature 128: m=a or c
  misc_feature 132: s=g or c
aagctttaaaataaagaacagggagctgaacttactgataccagaactcattgtacttaacaatttacaggctaaaacctttgaagaggaatttattatatcctacaactgggttatatggctttgamcacsagcacctctctatgaagaaaagagtgtgttgtgaacgaagtcagaatttcctgtgttccctttgccgctcctggagttcactggtgacttgatggagggtgagctctattctgctctcaaggaagaagaagcatccgaatcggtttctagtaccaatttcagtggtgaa

SEQ ID NO: 20135 - DNA, 334 bp, Homo sapiens
  misc_feature 128: k=g or t
ctgaatcgtaagcacttatataataactttttaaaagtcatttttattaccagagctcagaacattgtttggagtcctttgatctaccggttctcttaagtacgtgatttcgtgaagatagcaatggkttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggacca

SEQ ID NO: 20136 - DNA, 190 bp, Homo sapiens
aattaagaaagattacacaaaataagtgttactgtactttaagctattacaaatatccaacttttaaagatatgtaagaatcagtaatattctagaaagcacatatatagtaaaagggcatcctttaaatgtagaacgggtaaacatgaaacagttccatgcttgaattgttaagtatctagggggtatt

SEQ ID NO: 20137 - DNA, 226 bp, Homo sapiens
  misc_feature 167: y=c or t
  misc_feature 225: n=a, g, c or t
  misc_feature 226: d=a or g or t
agaagacctccatcagctcgccgcgctgcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctyagcggcggactgctgcagtaagaatgtcttttccacctcatttgaatcgccctcctgnd

SEQ ID NO: 20138 - DNA, 368 bp, Homo sapiens
  misc_feature 292: n=a, g, c or t
ctttttatcaccatcatggtttcgtagccatgtttaaatttttgtcttttcgtgttcgctctatacaggaagaagtcagtatcaaagaaattgcaattcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaangggaacgtgatatcttggtagaggttaatcatccttttattgtcaagttgcattatgcttttcaaactgaagagga

SEQ ID NO: 20139 - DNA, 235 bp, Homo sapiens
cttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcaac

SEQ ID NO: 20140 - DNA, 159 bp, Homo sapiens
tattcttgctctgtgttcaccaacaataagggagtagctggaacgagctaaatatctctcaaccctatgcacaaaaatagaaaaattgccaaacaagcacagctggcattttggcttaacgtgaattagaaaaacttaaagaagggaaaacaaaaccct

SEQ ID NO: 20141 - DNA, 155 bp, Homo sapiens
taggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccc

SEQ ID NO: 20142 - DNA, 162 bp, Homo sapiens
acaaaagcgattgctaggtctctctctctttaaccccaacattttatgcatgaaaaaatattccttgcctatgactcttctctttctagggtttctgtgtttcagaaagatatggccattggtaaattaaagaagaataacatcatgattttagccagagag

SEQ ID NO: 20143 - DNA, 336 bp, Homo sapiens
  misc_feature 91: w=a or t
  misc_feature 93: r=a or g
  misc_feature 103: k=g or t
  misc_feature 105: w=a or t
  misc_feature 108: r=a or g
  misc_feature 329: r=a or g
  misc_feature 330: n=a, g, c or t
  misc_feature 331: h=a or c or t
ccaagggagtacacaaaagaatgtagtgaaacttaatagtttgtaacagttcatacaaggaataaataagcagaactaagaaccgatattwarggattccagktwaarattggggagttcattttaccatccccatcagcataacttctacctcagctatggctcagtgcaggagatgccataaagaagacctttatttctgaggtagcatcagttatcaatcaatagatttttttgcttaagcatcatggaaccaatgaattatccaagtaaaagaggaactgaaactcatctatttagggcccagactttaaagatgaaaacctaarnhcacac

SEQ ID NO: 20144 - DNA, 88 bp, Homo sapiens
tctaccgtacaacaatcacataatgataaagtgttcacaattatttgattaaaaaattattattaaaagtaacacacttactgcccca

SEQ ID NO: 20145 - DNA, 193 bp, Homo sapiens
  misc_feature 90: r=a or g
tgatccccataccctcaaaatattaatagagacaatcgtgaggactataataaagaaatgtgcaataagctctgggggcacagagggaargaatctattggctgaggagttgaagaaattgtttggacactcagtattgcctgagctcaaaactgaaggatgaataaatgccacatgaccttggggcaggggt

SEQ ID NO: 20146 - DNA, 212 bp, Homo sapiens
  misc_feature 102: m=a or c
  misc_feature 207: w=a or t
tgagtagcttaataatcaaccttctgaatgctttatctggtatttcaaagatttcatcttggtttggatccattgctaggaagctagtgtggatcttttcamccttgttttatcatattacctgtattttctggttccttctcatttgtgtagactgtttcttcaaattgttcttgaatttattcttgatttgactttttttttttwaaatt

SEQ ID NO: 20147 - DNA, 127 bp, Homo sapiens
  misc_feature 92: k=g or t
ttaaatcaacttaatttgagtgagaattgaaaactgattcaagtaagtttgagtatcacaatgttagctttctaattccataaaagtacttkggtttttacagtttataatctgacatcaccccagc

SEQ ID NO: 20148 - DNA, 364 bp, Homo sapiens
  misc_feature 93: k=g or t
  misc_feature 101: s=g or c
  misc_feature 253: n=a, g, c or t
  misc_feature 317: r=a or g
  misc_feature 352: k=g or t
tcagataaaaaggccccatgagggaggagacagataattatagacttggtattctgataactctgtgttacatggaatcagatggcaatgagkttgtaccstgtggggtttcatgctctgctgtgttgtcttctcatggtgagcttttctgtgcccttatttcatccagctctggtttctgtgtttcatgttatttctcctagcctctgtaaagtctgcagcatactaataatgctctggctttctgattaanagtaaatggcttactatcagcacccctggcttgagggccagctcacatgtaatcccttataggrttccaaagttgttaaataaatgcaattctttttgkttttgtcatttt

SEQ ID NO: 20149 - DNA, 142 bp, Homo sapiens
  misc_feature 85: r=a or g
  misc_feature 89: r=a or g
  misc_feature 103: w=a or t
aaggtggaaagtctcgtcagaatacaaggaaatgaaatgaagagatatttccagcaagaacagacaaaatttaggaaacaattarttarataggagcacagawaatcattccagtcttgtccttcaagtttttttttttttt

SEQ ID NO: 20150 - DNA, 385 bp, Homo sapiens
  misc_feature 80: k=g or t
  misc_feature 82: k=g or t
  misc_feature 83: r=a or g
  misc_feature 84: h=a or c or t
  misc_feature 91: n=a, g, c or t
  misc_feature 103: r=a or g
  misc_feature 154: s=g or c
  misc_feature 155: w=a or t
  misc_feature 245: k=g or t
  misc_feature 246: n=a, g, c or t
  misc_feature 372: r=a or g
gatagacccttcagtggagcgggcctccactgcacccattgctttcaggggactgggaaattggctgtacatgaaacaakgkrhgaagcangtctgtgaagarctataaagatatatgatatttccacaaacttggggttaaacctaaatatcswaaaagcgactgctggccctaataagcctgagagtggatttgcagaagacagtgctgctcggggcgagggtgtgtcagacctccacgaagkntctccctgaaggagcggatggcgaggtaccaggcagctgtttccaggggtgactgccgcagcttctctgctaatatgatggaagaatcagaaatgtgcgcagtgcctggtggtttggccaaggtgragaaacaatttga

SEQ ID NO: 20151 - DNA, 386 bp, Homo sapiens
  misc_feature 90: m=a or c
cttgtatcataagtgattgtaacaaagacatttgtggaaatactagaatacagttatatgacttaatctttttcccaacaatattctaamcttggtagattaaaaaaaatttttaatggaaaatgttaagcatctcaaaaagtggtaaccagagtagtataacaagcttccctctatttagccttaagcttcaataattatcaacctgccgggtgcggtggctcacgcctgtaatcccagaactttgggaggccaaggcaggcggatcacctgaggtcaggagttcatgaccagcctgaccaacatggagaaaccccatctctactaaaaatacaaaattagctggggtggtggcgcatgcttgtaatcccagctactcaggaggc

SEQ ID NO: 20152 - DNA, 254 bp, Homo sapiens
  misc_feature 91: m=a or c
  misc_feature 126: r=a or g
gcatcattttgcctttcgctacttctgtagtctttcctgctttccacctcacacccccccaatatcacttaaaaaaaatactaaaaaaaamcccaaactactttattcaggtataattatacctgrataaaatgaaaccattttaagtacatagtttgattcattttgatagatgtatacacccatgttactgctaccacaatagatacagatatagaactttccatcagtccccaaaattctcttgtgcccaa

SEQ ID NO: 20153 - DNA, 90 bp, Homo sapiens
cttgtaaatttaagttctttgtagatctggatatcagccatttgtcagatgggtagattgcaaaaattttctcccattctgtaggttgcc

SEQ ID NO: 20154 - DNA, 175 bp, Homo sapiens
agattgatggtttgctgattgaccagattcagagagatttaatcgatgatgcaaccaacttggtccagctgtatcacgtgctccatccaagaatggccagtcggctcaaggggccaaggatcaggctgctgagggaataaatttaatcaaggtctttgcaaaaacagaagcaaag

SEQ ID NO: 20155 - DNA, 251 bp, Homo sapiens
tacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacaccg

SEQ ID NO: 20156 - DNA, 166 bp, Homo sapiens
tcataacaacttattagagctatgtaggaacatagaggtatctgtgatcaaatgacttgtcattagcactttcagtctttcctattctagccgttgtttttgtttgtattttttattattaatgacatatttagtcttcagatatattattttaaaggcaccaact

SEQ ID NO: 20157 - DNA, 137 bp, Homo sapiens
gtctgaaatgcagaagaataagtgcatgagagtttgtggcaggcaagtaagtaaaacttagcgaccgatttgtctgttcatctgtttacttttgagcacttgtgaaagaagaagggtagaatgagagactgaagtag

SEQ ID NO: 20158 - DNA, 183 bp, Homo sapiens
  misc_feature 95: r=a or g
  misc_feature 97: r=a or g
  misc_feature 110: y=c or t
tgtgtgtctggcctctgtatgcatgtatgtgtgtttgcatctgtaggtattatttgggattttctatgtataggatcacaacatctgcaaattgrgrtcattttgttttyctgttcaaaaatactttttctcatgtttatttttaaaagataatttggccaggtgtagaattgtaggtgactt

SEQ ID NO: 20159 - DNA, 222 bp, Homo sapiens
  misc_feature 100: d=a or g or t
ctttctcagattttaaagtactatattaaagaaaaaaattaatgtctaaagcctagcattcttgcagaaccctatactaacatgtaatggggagagggtdggggcagatgagtagagaaacagattcaagcctcaagcttccaaagcatttttataaatggaaaatccttaaattatgaaacagcttgatatagtgtcctttttttaaaattcagaactttt

SEQ ID NO: 20160 - DNA, 188 bp, Homo sapiens
cagtgctgagttccataacattttccctaaactgtttcatattttgatttatgattttcagaaatgtttttcaattatttgctcttctcatactgttattttaaataaattttaaaaatgttaaggaatcatttcacttgagttaaccatgaggctccatttaaaaacatttaaaaggaggacacatc

SEQ ID NO: 20161 - DNA, 452 bp, Homo sapiens
  misc_feature 354: w=a or t
  misc_feature 355: y=c or t
  misc_feature 400: w=a or t
  misc_feature 401: y=c or t
  misc_feature 422: r=a or g
acggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaawygtttttccattctgaacctgtgctttcaaatgtgagaataaaagwytgtctgctactggattacagrtgagcacttgtagctgatcatctttgcact

SEQ ID NO: 20162 - DNA, 308 bp, Homo sapiens
ttcaatgtcttattcccttttatggctcaagaatactccattaccacattttgtttattcattgattggcatttgggttgtttctaccttttggcttgtcgtaaatataaacattcacgtgtacatttttcttaggaaacctgtttttagttcttttggttatgtctaagaacagaattgccaggacatatggtaactctgtttaaccatttggggaactgccagactgttttccaaagtagctgcaccattttacattcccaccagcaatgcacaaaggttttgatttctccacatccccaccaacg

SEQ ID NO: 20163 - DNA, 252 bp, Homo sapiens
tataaatactttgtccttttttgggaatgaacaactttggctttatcctgtagtgaagggtgaatctttcgtctttcttcaagtaacatccacatgcaaaggattcatagatttctgcctccaaggtccggcagctgagctctggacactcttgatcttccaagctgcactccaatctgggttcttaaacatgtggtgcctgcatcctgtttcttctccagtgtacaaaagattccagaagtgaggcctgtt

SEQ ID NO: 20164 - DNA, 381 bp, Homo sapiens
  misc_feature 17: y=c or t
  misc_feature 18: y=c or t
  misc_feature 37: n=a, g, c or t
  misc_feature 70: n=a, g, c or t
  misc_feature 71: n=a, g, c or t
  misc_feature 90: r=a or g
  misc_feature 189: w=a or t
  misc_feature 215: s=g or c
  misc_feature 216: n=a, g, c or t
  misc_feature 281: k=g or t
ctcttcccttttgcggyyatcaccgaagcgggagcgnccaaaatgaagtttaatccctttgtgacttccnntgaacaagaatcgcaaaarggcatttcaatgcacctccacctcctgggttcaagtgattctcctgtctcatcctcctgagtagctgggactacagacgtgtcccaccacgtccgactwagatggggttttaccatgttggccasnattgtctcagactcctcacctcgtgatccgccccccttggactcccaaagtgctgagattacagkcgtgagccgtagtgcccggcctagatttattctaagtttcattcagctcagcaagattttaggtgggctataaataagtagggtgaaacacttatatata

SEQ ID NO: 20165 - DNA, 164 bp, Homo sapiens
  misc_feature 90: y=c or t
cagtttatggattattatgaataatagtgtagtgtgttctttttcagaagttatatttgataatagagaagggagtttatggaagtttcytttgaaggatttttttttttccatttcgaatcagattatagcaacaatggagtttggaagtttgtatggccatg

SEQ ID NO: 20166 - DNA, 123 bp, Homo sapiens
gaaaaatgcccagagcacagcccagggaggtggttcctgaggctggctgtgggcacagcccagagagcggttcccgggactgactgggggcagagccagcccgcagcgctcctgaccccacgg

SEQ ID NO: 20167 - DNA, 208 bp, Homo sapiens
ctaattgcatcatacttggagaggaagagtgttcctgattgtgttttgtattactatttaaccaagaaaaatgagaattataaagccctcgtcagaaggaattatgggaaacgctgaggcaggagaatggcgtgaacccgggaggcggagcttgcagtgagccgagatcatgccactgcacttcagcctgggtgacatagagagactc

SEQ ID NO: 20168 - DNA, 270 bp, Homo sapiens
  misc_feature 121: k=g or t
  misc_feature 129: w=a or t
  misc_feature 136: w=a or t
gaacttctgcaactgtttctgaccctttagaaaataccaactgtgagaaggatttaatttgcctaatgttaaaaacctatcatctaaattactttcagagaggattttgtcagattttggkttggaaawttgtttwaattgaatatttaatcataatagactttgtatgaactaagctgatttaatcagtttaaaaacctctcattaccttcttagattaaagaagctaatactgttttgagatagaaggaaatattttgtggggcatgt

SEQ ID NO: 20169 - DNA, 278 bp, Homo sapiens
  misc_feature 127: r=a or g
tcgataaaacagtaaagtaattctaaataccttgaaaatcaaaatttctatttcttttgcttaaggaatagttcatataaaaatatgctaaagataggataaaagtgagtgtgagatcacccagggragcagtaaaatatcaattttcattttaagtgtattagtactattgttttatcatttatgctgtctttggattatagcatatttataatatctattttttgttatttcaatataccctcttgtttattcaggaaaaaataataaagtcacgc

SEQ ID NO: 20170 - DNA, 101 bp, Homo sapiens
ttcttttatattttctctacttcctgggaactttcttgaactttatcttccagattttctgttgaatttctgctgtctttttttttttttttttttttttt

SEQ ID NO: 20171 - DNA, 98 bp, Homo sapiens
acaacagagcttccgggacccacgcctcgtttgcactgggtgctggacagccgacgcaactacaaatggggcggactttcggcactggagcagctaat

SEQ ID NO: 20172 - DNA, 139 bp, Homo sapiens
caactttagttttgctttgtttgcatgtccactaatttttttattttgatatttgtcttttttttaaattttacagtagtcatcgaaagttatgtttctttgcttacttcatttttttctctaatcaagactggaacac

SEQ ID NO: 20173 - DNA, 331 bp, Homo sapiens
  misc_feature 142: k=g or t
  misc_feature 145: b=c or g or t
  misc_feature 157: y=c or t
  misc_feature 163: m=a or c
  misc_feature 169: w=a or t
ttggataatttctattgatctgtcttcaatttcactaactttcttctgttattgatattcaactattgagcctatacagtgaattatttcaattactatcttttcttcttataaactttccactcagtttttctttatatcktcbccttcctttgcyggagamtttttwaatgttcccattcctttcaagggtatttgcttttacttgttgaagcatttttgtattaactgcttgaaaatcgtcagataattccagcattggtgtcatcttgacggtggtatctgttggtagtcttttcatgtgcatgctacttgattcttcctatgcccc

SEQ ID NO: 20174 - DNA, 80 bp, Homo sapiens
agaacagcgatttgaattttgggggggtctgctgttcattcctttaggtgctatacattattcaaaaagtctcccgcgcg

SEQ ID NO: 20175 - DNA, 245 bp, Homo sapiens
  misc_feature 146: y=c or t
  misc_feature 147: w=a or t
  misc_feature 151: m=a or c
  misc_feature 154: w=a or t
tccagactatgggaaaataaattatgattgtatgtgacccccagatcactaagcttgcattttggcagaaagaaaaaaaatcagttgtgatttaaaacgtttgttgagattttcaaacatagaaataaagctgtagcatattcacywaaamaawggtttaatatgaggatagggacctttaaatatgtgttttatagaatatctcacacatttgtaatggataacgtgcattaaaatggagttct

SEQ ID NO: 20176 - DNA, 211 bp, Homo sapiens
  misc_feature 26: m=a or c
ctgaaactatttcttattagttaagmtctgttatgcctctgttgtgtcaggcattgtaatatctacagaagatgcagtggtgagcaagagaggtgtgatcctactcttggtgtgaaagttaaaagagtgaaaaatgattagaggaaaggcatggtagatatatttagaagacacaatctgtacataagtggaattccagaaagagcacatc

SEQ ID NO: 20177 - DNA, 308 bp, Homo sapiens
atatttgaatagatcactcatggaggaagacaaagaggaggaaactgggatgaggctgagaggctcagtatgagattcaggatattgaagtacaaactgaagaatcctggttttacatgggccactttagacctctacgaatttctgcacctgagttcaagatcttctccaatggggccttcttgttccatctcttcccaataccctggaatgggagggaagccagggagacaaggcactcctggagctggaatgacaacctttcctcctgcaccaggaatgttgaacttcatgatgcatgaccagcc

SEQ ID NO: 20178 - DNA, 234 bp, Homo sapiens
caggtaaatactaattattattaattcagttaaaggctgtacaatctcactaaatatacttacctttttgaccttttaaaatatactcaagctgggtgtggtggctcacacctgtaatcccagcactttgggaggctgaggcaggcagatctcttgaggtcaggagttcaagactagcctggccaatatggtgaaaccccatctctactaaaaatacaaaaattagctgggcat

SEQ ID NO: 20179 - DNA, 70 bp, Homo sapiens
tttgttgggtataggagtcatggttcacatttttttttcttttaatactttgtatgtcttatcccacttc

SEQ ID NO: 20180 - DNA, 404 bp, Homo sapiens
  misc_feature 26: r=a or g
  misc_feature 78: k=g or t
  misc_feature 79: r=a or g
  misc_feature 220: b=c or g or t
  misc_feature 221: b=c or g or t
tatgagcttttcatttaattatgatrtctttctattataataatggtagaattgtattccattatgtgaatagttttkrctgggtttaaacagccccgtttttggacatttgggttcttccttgtttccccccaattacaaaatgcagcgagcatcattgtagtcatttcaacgtacatatggcagtccacttaggatggatcctaggggagtagtttgbbggacaaagggctgtgagatatcaattttttggctacatattgtcagctttttaaaaaagttatattttggctaggcacagtggcctgcacctgtagtcccagctacttgggaggctgaggcaggaagattgcttgagcctgagaggtcaaggctgctgtgaactgtggttgcaccgtggcaga

SEQ ID NO: 20181 - DNA, 288 bp, Homo sapiens
cataaaacggggaaaagattattatttcttcaatttttttttctgactttccttttatcctcttttatagggacctcaattacatagtaggctgctttaacttgtcccagagtcactgattcttcttcttttttagtatttgtgattcattttggatcatttcagttggtgtgcattcaagcagaccagtttacatgttctgtgtttctacttaatatgctcagtgtttcttctagctccttggccatatggaatatagttatgaaaactgttttaatatccctgtcc

SEQ ID NO: 20182 - DNA, 81 bp, Homo sapiens
aatatagatccggcaagagcttagctgtgatcactcctagctgctcagcaaaccactgaggttcctgggaaaaaaaaaaaa

SEQ ID NO: 20183 - DNA, 232 bp, Homo sapiens
cattacttgaggtcctaaatgcagaagggaaaaagcaacttttgtcagatgcctacttcactttcattcatctctaatattttggatggggaatcatccaaagcttctgagtgcatgaaggtcaagtgtgccagtgtgcagctgggcttcttttccagaattaaaagtattttgggtggtgctgaaggtcagcggaagaagtaaagattgcaagaaaggagaaacatgggct

SEQ ID NO: 20184 - DNA, 467 bp, Homo sapiens
  misc_feature 299: b=c or g or t
  misc_feature 301: n=a, g, c or t
cacagagacagaaagtaaagtagaagttatcaggggctaggagaggggagaatggggagttattgcttagtgggtacagaatttctgtttggggtgatgacaaattttagaactagatagtggtgatggttgcacaacactgtgaatgtaattaatgttgctgacttgtgcatgtaataatgcttaaaatagcaagtttcatgttatatatattttaccataaaaaaattctctccaaaccccaaatcagttaaagtactgaacttttgccagtcctagagtgtttggtgcaatgcatbanctagatgccatagcatatgaaagaacatttgaggggaaggagtaggtgggatttcattattctgttttctggctattaagattagagtctgctgagctctaagacaccaatgttttagttattggttgatatccaaatctcatcttaagctgtggctcccataatc

SEQ ID NO: 20185 - DNA, 376 bp, Homo sapiens
  misc_feature 144: d=a or g or t
  misc_feature 154: n=a, g, c or t
  misc_feature 281: w=a or t
tctcagctgaatctccagggaggctgcagagcatcgtggagaccactttctgcctcggcctttaaatgctgactcacctcctctcggaggaggcgtcctgtcttcacgggggggtcccggtggcctccagacgtagccaatttdcctgacatcnagatgttgaatgtaatctggtctgagctgggcctgtgggaggggccgcctgaggcctgtgcgctgttgtcctcgcagatgtacttatttttgttcatgatacgggcgttccgttccttaaagatgtwtatattttcttactgtacataaagatgttccttaagtcgtacagaaggtggcgcggcaaagggcctcgtgcagtgtgttcagattgcccctggtc

SEQ ID NO: 20186 - DNA, 306 bp, Homo sapiens
tatatcttcttgctatattgacacttattgatgtgtaatatcttttttgtctcaaccttgttttgatttagtttgtctaatattaatgtagctacctgcactctcatttggttattacttgtatagaatgtctttttacatcccttatttgtgtctttggatctgaaatgagtctcttgtagacagcatatacaatctcttgtagattgtgtttttcttatacattctgtcaaactctgccttttgattgaagagttttatcatttacaattaaagtaattattgataaggatttaactgctgctt

SEQ ID NO: 20187 - DNA, 420 bp, Homo sapiens
tggataggaaagctggaggatgagggatgcctcttgcactgcgtggaagcaaggacagctaagtttatcttgtacggtggcaggaaatggatggacttaacttctggtggctttcattttcttggagacataagaggtggagttgtcccttgagaccaagtgacattgtaggatgtctgagaagatttgaaataggcattgttgaaaatgtctgtataagcacagaaggatgcaagcataaagggcccagctgaggttggtatccatgaatctgtagtgaaacctttttttcttgcttcttcccatcttgcactgctaagcagcctgagtataggcaaggaaaagttagagggtttatttacctagggtgcagattttgctaggagaatgtataatgtgaagacagtgagtctcggcagt

SEQ ID NO: 20188 - DNA, 89 bp, Homo sapiens
gaatggatagtaaaagaggggataggcataaacaacaaaatgttcagtatagcattatactcattaattcgctcacttgtcaggggcac

SEQ ID NO: 20189 - DNA, 136 bp, Homo sapiens
atgtcattttttccccacctgatctacagactcaacactatcctaatcaaaatctcatcaagttattttgtggatatcaacaaactgattctaaagtttatatggagaggcaaaatgacctagaatagccaaggac

SEQ ID NO: 20190 - DNA, 254 bp, Homo sapiens
  misc_feature 133: s=g or c
  misc_feature 136: y=c or t
tatatttggtctgtttgtagttttattactagatgatttttccggttgtccttaacaccccttcctgaggttcccttcacccctctctcttgccttccttccctttccctttcttcctgactagccccaagtsccyttcatttgcatctgctatgcaatagtccctctcctttccttcttcttccctcagatttagctgatccttcctcccaccctggccttcctttcctctttcctcctcactctccccgccg

SEQ ID NO: 20191 - DNA, 126 bp, Homo sapiens
cataagttcttgattcttcattttttgaatgactgcatatcagtcagtaagatgactgtactattatttatgtaactattcacttattaatgtacttacaatagtacccccttatctgaggagacc

SEQ ID NO: 20192 - DNA, 186 bp, Homo sapiens
  misc_feature 133: r=a or g
caaaacaaaatgtatttttagaattacggcagcatacgacctgaattttgtgagtttcgtggctttatcttaaatcaccatttccctaaaaacggtttctttctccttagaaatgctggtggcaacttgatgraacaggccaaaatgcaccagggcaggtcactttcccattacactgattccact

SEQ ID NO: 20193 - DNA, 203 bp, Homo sapiens
  misc_feature 117: k=g or t
  misc_feature 130: k=g or t
  misc_feature 131: w=a or t
  misc_feature 140: r=a or g
  misc_feature 143: w=a or t
  misc_feature 144: r=a or g
  misc_feature 148: k=g or t
  misc_feature 157: k=g or t
  misc_feature 180: r=a or g
taaaaagtctgcagtactctgtgtgccattgcatgtttttttttcttcattttgccatttgtttattgcaaaatcccacacttaacagaagacatgtttaaaacatatgagtatgtkaaaacaaaatagkwaaatgaacrttwrtgtkcccatccckaggttaaggttaggaccatatargccccctatgttccctcccccgt

SEQ ID NO: 20194 - DNA, 250 bp, Homo sapiens
ataaaaatccataacctgcaaaaactacttcttctccactagaatttttttatttatgtcagaattatttctgtgtatgttgcatttccgttaacatatatgtacagtgtttttcatgccttttatttcaaataatatgaaaaaagtttagttatgaagaaaaggtatacatatgccagtttctgtatctgtccttttattaattaattaccttatgtatttatgagatagagttttgttcttgtcaccc

SEQ ID NO: 20195 - DNA, 150 bp, Homo sapiens
ctcccctgcccttggctccatgaatggcctcggcagtcctagcgggtgcgaaggggaccaaataaggcaaggtggcagaccgggccccccacccctgcccccggctgctccaactgaccctgtccatcagcgttctataaagcggccccc

SEQ ID NO: 20196 - DNA, 202 bp, Homo sapiens
catttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaa

SEQ ID NO: 20197 - DNA, 186 bp, Homo sapiens
aaacgatacttaaagcaagtgctttcaagttaggttgcacatcacaagcaaagggtgcctcccatcagtggacctgaaggagctaagtgtgaggttcaattgtcccccttctgtagggccatatggatatctttctttcttggatcaggatcactgatgtgcgcagagaacaccttggaaccaggg

SEQ ID NO: 20198 - DNA, 91 bp, Homo sapiens
gaaattgtgcactgtaccagttctgttccaaaaatgaaatctcaggtgggatcagctactgctgatacacttcattagaattgccgccaag

SEQ ID NO: 20199 - DNA, 152 bp, Homo sapiens
caaattcatggacacgggcatcaaatttccactcgagagcactcagccatgggagtggttagaacttgggcttctagagcagtgtttcccaacctttttggcaccaggaactggtttttgtggaagacaatttttccacggacggggccgaa

SEQ ID NO: 20200 - DNA, 329 bp, Homo sapiens
  misc_feature 115: r=a or g
  misc_feature 129: r=a or g
caaaaaaaaagacaagggctgagcacttgcttcccgtggcgaaggtggagtctgggcttacgcatgcatttcccctctaataacaaagcttgagttatggggttatatgtcttgragaaggaaggaaarcatcaacatccagacacacccaggcccagccggcttcgggaggagccgagagcctctgtggctcctccctgtgcctgggaggcctgagtcccacctgctgggctgctctgtcctggcaggtacagcaacatctttcatgtcttcatccgcatctcgagagaagaggggctgaagactctctaccatggatttatgcccac

SEQ ID NO: 20201 - DNA, 252 bp, Homo sapiens
ttggtttggcctgaaaggtgaagtggggtaggcagggggcgggcttacaggttatggtggattcaaagactccctgatttgtgattggttaaggaagcaaagctttgtctaaaaacttgggggtccgcagaaaggaacattaaggtctggccaggcccctcaggaagaaactgagagcaaagaatggaggtcagagtttagtccctggtgttcccccttatctgacgtctgtgtgaatccatttggtggggg

SEQ ID NO: 20202 - DNA, 69 bp, Homo sapiens
  misc_feature 69: k=g or t
tctatcacttcctttctgaagatttttcatgtttttctggcccatagatttttatccatagacattcck

SEQ ID NO: 20203 - DNA, 292 bp, Homo sapiens
tgtaaatcttgatctcattgtcatcttccagttattctgtaaaatacattggcaactaatctctatcacaggggtgatgagagaaatggactgctatggactgtatgggaatgtaaagaacctaagttcttcccaatggatttgcaataattattgtaaaaatcttttgtcccctacagttccccacactgcttaatggccacatgccagtaccaatccccagtctggacagagctgcttctccagtactgctttcttcaaactctcagaaatcctgatgacgtctggccac

SEQ ID NO: 20204 - DNA, 466 bp, Homo sapiens
ttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatca

SEQ ID NO: 20205 - DNA, 201 bp, Homo sapiens
  misc_feature 56: b=c or g or t
tcagaacctcttccccagaaaggagactagattgcctttgttttgatgtttgtggbctcagaattgatcattttccccccactctccccacactaacctgggttccctttccttccatccctaccccctaagagccatttaggggccacttttgactagggattcaggctgcttgggataaagatgcaaggaccagggctc

SEQ ID NO: 20206 - DNA, 132 bp, Homo sapiens
  misc_feature 110: k=g or t
  misc_feature 116: k=g or t
  misc_feature 119: k=g or t
  misc_feature 130: k=g or t
caaacctgtttgtgagatcttcaaatactactgtagaccccagtgtttattcattaaattttttaaatatttgttttatttggaatccatgtatttgtaattttagtgtktgtatkaakatcagggagtkag

SEQ ID NO: 20207 - DNA, 159 bp, Homo sapiens
  misc_feature 110: k=g or t
  misc_feature 139: n=a, g, c or t
  misc_feature 140: s=g or c
  misc_feature 141: y=c or t
cagttgctatttgatgagtcacaactggcccagcaggcagggcatttgaagtcatggtcatcaaaaagaaatgattgttttttgaaaagctaaatgcttaaaatgcttckagagggaagtcgtggggcgtgtgctcatnsyctttaaaatcagggtacc

SEQ ID NO: 20208 - DNA, 177 bp, Homo sapiens
tttttgtggtaaaatgcccctttataggtgcctcacacaggcccagccagtggtcctggggagtttgtgaggagcaagaaaggggtgaaggaatgcttgcgtgcaatgattatagggtttcaaggtaacgtggagattaatttttttcaaaggtgggtttcaaaagccgaggcaccc

SEQ ID NO: 20209 - DNA, 229 bp, Homo sapiens
  misc_feature 171: k=g or t
gtatgttagagcccaccaaggaaccactgaaaccactttctgctgcagaaaaaatagcttccatcggtcagacagccaccatgtcaccagatatgaacacatgtacatctgatcagttccaggagtctctaccaaaccgtccagtttgactggagtagcagtggccttackaaccctttagatgagttaaaggggaacagtacagcttgaggttgcacatcagggtggt

SEQ ID NO: 20210 - DNA, 247 bp, Homo sapiens
  misc_feature 123: k=g or t
  misc_feature 124: r=a or g
ctgttggggtttcgttttttattctgtctcttgctcatggtggcttgtttccttacatggtttagtgatttaaaaaataccaagtacatatttagttgaacttaatctgtgagaatcgtaatkrcctaaattggagaattatttatttcagggaggatttgcactgatttctgtcagaagccagggatctatagacctgagacttcttttttacacccttagagctttcccttacctacaagccccg

SEQ ID NO: 20211 - DNA, 173 bp, Homo sapiens
tgagtaatgacttaaagttattagtttgtttctgtgtttcattttgtataagaaaaagtaccttttattttcctgctttccttttaacatagtagcagtacagtgccttatgacaaattgcaatactgtacaatctactcagctggcagctctcagccacagtacctctccca

SEQ ID NO: 20212 - DNA, 173 bp, Homo sapiens
  misc_feature 132: r=a or g
  misc_feature 165: d=a or g or t
  misc_feature 167: h=a or c or t
  misc_feature 168: n=a, g, c or t
agaagttagttaacatgtatacctcgtgtatatatgggacatacccaagggaaaattagtaactcctaaagtgatggctgagaagtctggcttaaatagcatcttcagcaaagaacagtacattcttagagragtgatgagacaaaggaccttgagtctctaggdchnggcta

SEQ ID NO: 20213 - DNA, 114 bp, Homo sapiens
  misc_feature 110: r=a or g
gtcggagcccaggctccccacgacctgcccgtctgcatgcttcccctaggggtttgagctgcgggcaccgaagacgggagccatacacctgtcacacgccctgcgagggraggg

SEQ ID NO: 20214 - DNA, 192 bp, Homo sapiens
aactgttatattctgactccttcctcattaaatccacatgaaaagacatgtgacctactgcaaggcctcctaattgccctccagcctttaatcctgacttggtaatgtttccaaaaatgcaaatgtggtcacgggactcagttgctcaaaactttcaacaactccctcttgcctacaggataaagcccccca

SEQ ID NO: 20215 - DNA, 123 bp, Homo sapiens
gcagtggcggcgaggaggcgagccggagcgacggaaggacattccccaagaagggccaaacgtgtgtggtgcactacacaggaatgctccaaaatgggaagaagtttgattcatccagagacc

SEQ ID NO: 20216 - DNA, 206 bp, Homo sapiens
acatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcct

SEQ ID NO: 20217 - DNA, 148 bp, Homo sapiens
tatgtgtgtgtgtgtgtgtatatatatatatatttaatttcaatggcttttggggtacaaatggcttttggtcatatatatgagttctacagtagtgaagtctgagattttactacaccttccacttatgtggtcccactacccgccc

SEQ ID NO: 20218 - DNA, 99 bp, Homo sapiens
catctccctgaccccttcaacctttggcctttcagcccttctttctctcttccatattctttggtttgtatgtggtttctcagttaatacatagctact

SEQ ID NO: 20219 - DNA, 171 bp, Homo sapiens
  misc_feature 135: m=a or c
  misc_feature 136: h=a or c or t
  misc_feature 137: m=a or c
catatgtaatgaatctattataggtttttgcattgttgttacaattaggcttataaaacatatcttatagatataagttatcttaaagagatgacaacttatctttgatgacaaataaaaggacagaaaaatgamhmaaatgcttttatgctttaactccatccccccctg

SEQ ID NO: 20220 - DNA, 70 bp, Homo sapiens
tctaattctagaatattagaaaccccatactcactaatagtctctcattcccttctactcccagccacgt

SEQ ID NO: 20221 - DNA, 140 bp, Homo sapiens
  misc_feature 35: y=c or t
aaaaaacactcattttgttttatagcatgacaggytgtctgattccatctttataaccaaagccaattaagatcttaaaaccaaacatataacttcatctttttacaagtacttagagcctgagttgctccacaggaatc

SEQ ID NO: 20222 - DNA, 374 bp, Homo sapiens
gcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggta

SEQ ID NO: 20223 - DNA, 355 bp, Homo sapiens
  misc_feature 352: m=a or c
aattacagaagcaatctaccctaatttgttaacttattcaaataacagttattatacttaactatgctaaagattatcttttttgtggcagattgtttattttttgatgagcctaattactgattttctaaaagtaatttacatttattacaaatacatcttttaaaatgtgacagataaatgttgttcccataatgtattatgaaaaaagttactatttaaaaacacattatttaatttgaaagatgaatggcaaacatcattatttttttttcctgcaacacctgtgccctaagcttattaaaatgtgtgattctgtgtagagctgctagaaatggggactaaggggggmcgt

SEQ ID NO: 20224 - DNA, 226 bp, Homo sapiens
tatcctaaagaaaagaaaacatgataatgtcttcactttataagcagtatagcaaattataagactgaaggattaagtagatgatgataagagaaaaaaatttaaaggactgactttttcacatctatctattccaggtatttacccatttttttccttcctccctttccttttccctcttccttcttccttttccttttcttttcttggtctttctctgtcacct

SEQ ID NO: 20225 - DNA, 403 bp, Homo sapiens
  misc_feature 389: r=a or g
ttaaacataaaatatatcttttctgcttaagataaaagtagatattaaacttccttggataaatacagagatatgcctaaatggattaaacctgcctttctgttttaattgttaaggttctgtaatttattttctggtgtttgagagggattgactttatttcattaacactgtagaaggtgtattaacaaaattgtttcggagaggatgttttgaaagatactggacagatgaatgccttctgagctactttcacttttattcttacatttcaactcctctttggttagagaagtcccaggaccctcaaagacctttgacctctaaacacattttaaatcttcagttctgtgtgcacattgtgtatctcaggcattctacaataaagraaaacttttttttt

SEQ ID NO: 20226 - DNA, 161 bp, Homo sapiens
  misc_feature 121: r=a or g
tcttgagcaacagtggatttctcatacttttgatcacatcaataaaagatggggtccacattacaatgggctgtgactctccacctcagcattgcatcgtatcatcattttcgctacggartttatttttcaacaataagctttaacttaatttggggagt

SEQ ID NO: 20227 - DNA, 98 bp, Homo sapiens
tattggttattattgttatatattcagcaactttgctgagctctcttactactttgaataactaaactggtaaattctcttaagttttctacagcaac

SEQ ID NO: 20228 - DNA, 181 bp, Homo sapiens
ctgagaaagagaagcaatcaattaaatattggaattaattaacaataaatatttcatgagtgtgaaacttgtgaactgcagtgactgaagtccaacaagcagaagtcaccaaagtgctgggattagaggcatgagccatcgcgcccggcaggatgagacaatttctgacctccaaggataa

SEQ ID NO: 20229 - DNA, 150 bp, Homo sapiens
ttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaa

SEQ ID NO: 20230 - DNA, 99 bp, Homo sapiens
cattattttgaatgaactgttaactgttagattaagaattggtaccatatggaacaggttagtggaacttactataaaaggcttttctttgggggggtc

SEQ ID NO: 20231 - DNA, 134 bp, Homo sapiens
tctcgaactcctgacctcaggtgatctgcccgcctcagcctcccaaagtgctgggattacaggggtgagccaccatgcccaacctggacttttttcatgtccacctgtatgttaatctttttagtggcagcctc

SEQ ID NO: 20232 - DNA, 289 bp, Homo sapiens
  misc_feature 280: k=g or t
  misc_feature 281: n=a, g, c or t
aaatagaatcatacatctctaatgaactttgttttaattaggtgagaacgtctttaattatatttttaatatttataagcaatacttattcaattaaaaatgtttcccatattagttatagcattttaatttttccaaatttaaaatgggttgatactatgttcaagagatagtaaaacataattaggagttcaaactgtgtaacaatgaaaacccgggtttgaacctggttttaccatctatgctagtttgtgtgatccaagtcaagttacttaacctkntcaggcta

SEQ ID NO: 20233 - DNA, 237 bp, Homo sapiens
  misc_feature 181: n=a, g, c or t
  misc_feature 182: y=c or t
  misc_feature 184: n=a, g, c or t
gaaatggctccgagaggctttgacgcatgtgtacctttttagtggcggtatctcggccggggattttcgggctccagtggaggtggctatgctcaccccatctcccttaagaggcacagaaggttagagatgtgtgcgaggaacggccaggtccagcgtctcctcgttgctgccccttganycngggaccggcgccaatgcgcgcccgggttcttgggttctttcgtcccgcagact

SEQ ID NO: 20234 - DNA, 147 bp, Homo sapiens
  misc_feature 115: w=a or t
  misc_feature 117: m=a or c
  misc_feature 123: m=a or c
cgatgtatatttttccaaacatgtagctattgtttgctttgatttttgcttggcctcctttatgatgtgcatgtccttgaaggctgaatgaacagtccctttcagttcagcagawcmacaggmtgggagctcttcatgactgtctcc

SEQ ID NO: 20235 - DNA, 146 bp, Homo sapiens
tatttggacaacctttgcatgtttattttctaaaggtaggaaatttatttctacagatttaccttcagcttttttaaaaaattggcattgttatgtcattaacagctatatacatgtacttttttcaaaacaacatttacggcacc

SEQ ID NO: 20236 - DNA, 87 bp, Homo sapiens
aggtttcatgtggatttgcccagtaatggatggctccaccgaggccaggttggggaagttcagcctcgaggacactaggggaccgtc

SEQ ID NO: 20237 - DNA, 295 bp, Homo sapiens
ttgtctgtgacctttcaatttcactttcaatagttgaagaacttggctttgtaaatctctcagaagcttgaaaatatcttgtctctaccccctcagcccatttcatttgccaataaatattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaa

SEQ ID NO: 20238 - DNA, 221 bp, Homo sapiens
  misc_feature 118: s=g or c
  misc_feature 221: n=a, g, c or t
agaggcggttatggacggcaccatggaggactccgaggcggtgcagagggccacagcgctcatcgagcagcggctggcacaggaggaggagaatgagaaactccgaggagacgcacgsccagaagctgcccatggacttgctggtgctggaggatgagaagcaccacggggctcagagtgcagccctgcagaaggtgaagggccaagagcgcgtgcgcggn

SEQ ID NO: 20239 - DNA, 218 bp, Homo sapiens
ccttggcagaatggagttatctgtaggtctgttttgataagtgagatttggtgtgcccttttctttttgaaagtgtggggcattccagttgctgcttcctgtcctcaagcatgttccccttttccctggtgaggatgagaagtctgaggtctaaggggcccaatgcagggctgtagcaagcaggtggtcagggaggctctgctccgtagtctcagcga

SEQ ID NO: 20240 - DNA, 97 bp, Homo sapiens
tgatggacggtaagtattatgaaaaaataaagcaaattaaggggtcgagagtgatggaggggagcaaggggagagccaattttgataagacgatgag

SEQ ID NO: 20241 - DNA, 157 bp, Homo sapiens
agttattctgataaattacagcttctacgaagaaaccactcccctctgatgagtgacctgcaggaagaaggcaagaatgccatcaactcaccgatgtcccccgccctggcggatgttcaccctgaagacacccagcttgaggagaacgaggagcgcg

SEQ ID NO: 20242 - DNA, 176 bp, Homo sapiens
  misc_feature 150: n=a, g, c or t
tgagagaaagcttaatattgaagtatctctcctatgaggtgttagaactatttgcctacaatttattggggaaaaattgctcatttgtgtacataaacctaggacagagcacatagggaagataacattccaacacaggggaattttgcncaaggctcatgaaagaacccaatgcc

SEQ ID NO: 20243 - DNA, 131 bp, Homo sapiens
  misc_feature 48: k=g or t
  misc_feature 59: r=a or g
  misc_feature 75: r=a or g
  misc_feature 76: k=g or t
  misc_feature 101: y=c or t
  misc_feature 107: k=g or t
  misc_feature 114: k=g or t
tgtgtgtctggcctctgtatgcatgtatgtgtgtttgcatctgtaggkattatttgggrttttctatgtataggrkcacaacatctgcaaattgagatcaytttgtkttctgtkcaaaaatactttttctc

SEQ ID NO: 20244 - DNA, 459 bp, Homo sapiens
tagagaaaagggtcccagatcacattttgggatccaagtgaaagtaactagtaaaggaatgtttagtgaggtaggagggaaaccagaagagtgtggttgttaaactaggaaagaaagtgtttcaagaagaatatggttaaacgtttcaaatgtttctgaaatacaagacaattgcctatagaatctggggaaaagaaggttgtatgtgaccttgaaaaaaggatttcgtgcagtggggaaggatgtccagtcagtgggtcgaagacagcagcctgtgatcagtaagaaaaccactatcatttaatgaaggaaaaccactgccatttaatgaatgctttactttatgttggatattgtactaagactttatattaattcttaatttgcacaacacaatgaatgataatgttgtcagtattttagagaggaggaaacagattcagagaaggtatgtacttt

SEQ ID NO: 20245 - DNA, 232 bp, Homo sapiens
tcattctgctttgtagattatttgatttagagcagactacatatctgatggctctgccaagatgaattagcccctcactacatctccagataacggcgtaggagtgaggaactgtataccgtatccctctaaagagaggcttcaaaaagcacaatcttgatttgggtagttgggaattgttcctttgttggacagctttaattattaaattgagatgaaatatgccagcgaa

SEQ ID NO: 20246 - DNA, 221 bp, Homo sapiens
  misc_feature 150: n=a, g, c or t
  misc_feature 165: n=a, g, c or t
  misc_feature 166: d=a or g or t
tgaaatgcggatgaaaaatggtctttcattcattttttttgtttgtttatgaacttttaatttcttgggtaatatagtaagggttcatttccacatcacagtaaaattcacagggaataatcctgcattcaaatacctctcttacagtcnagtctgcctttatcndggctgttctggctgaagtttatagcactttttcctgttacaatgaatgtgaggga

SEQ ID NO: 20247 - DNA, 189 bp, Homo sapiens
  misc_feature 46: m=a or c
tcctttgaagactcatcctcctttaccttgtctttaagtgacagamttcctcaagacttcgtgcttggacttttctcactctactcttgccctaggttggcctcatctttgaccatgtcttcaatactatctatatcctgttgagtcccaaacttgtttctctacctcaggcctctgttatgccccagc

SEQ ID NO: 20248 - DNA, 183 bp, Homo sapiens
catatatttgttggtcacttgtatgtcttcttttgagaagtgtcttttcatgtcttttgcccattttctaatggggttatttgttttttgcttgttgaattaagttccttaagattctggacattagacctttttgttagatgcaaagtttgtgaatatcttcttccattctgtaggtcacct

SEQ ID NO: 20249 - DNA, 147 bp, Homo sapiens
cattctcctgcctcagcctcccgaggagctgggactacagggacccgccaccacgcccggctaatttttttgtatttttagtagagacggggtttcaccgtgttagccaggatggtctcgatctcctgacctcctgatccgcccgcc

SEQ ID NO: 20250 - DNA, 461 bp, Homo sapiens
  misc_feature 106: r=a or g
  misc_feature 148: s=g or c
  misc_feature 149: d=a or g or t
  misc_feature 168: k=g or t
  misc_feature 190: b=c or g or t
  misc_feature 322: k=g or t
gaaattttaagctttgttataaaaattttgacattacaaataaaattttggcttcttataattccagttcccaccagaggtaactattttctccattataaacagraatgaaattatagtcgtttatatagtccttctccatagattsdaatatttaggttagattakaagaagtcagcctgctgagtabttatttctgtgcatttaaattttaatggacaatgttaaattcttctccgtaaccatcataacagcttacatgacccccaaactagatatattctgatttaaaatgtaaggttagatctcattcttttccttkttcattttctttattcttgaggttggttttcttttcatgtgcttactggcaatgaagagccattgaactttttacatattttttgtaactgtgggctttaaaaaatattttccagaaaacaatttttgatatatgtatc

SEQ ID NO: 20251 - DNA, 298 bp, Homo sapiens
  misc_feature 166: w=a or t
tttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagwattacataaatgcatgtatcagaaacttcacagaaattacatggcaactcttgtagctaagaaagtaattctgaggtgtacatttgtcttgcctttttaaatttataaacttgccctaaaaggaaatgcatc

SEQ ID NO: 20252 - DNA, 105 bp, Homo sapiens
agttactcgcgagcttgtctgatactgggatggaaagtcacagtccgtaggctggagtgaggcgcgggaagatgcctggtccttgcctcgcggacttggcagccg

SEQ ID NO: 20253 - DNA, 178 bp, Homo sapiens
  misc_feature 156: b=c or g or t
tgaattgatttttgtataaggtgtaaggaagggattcagtttcagctttctacatatggctagccggttttcccagcaccatttattaactagggaatcctttccccattgcttgtttttctcaggtttgtcaaagatcagatggttgtagatatbcggtgttatttctgagggcgca

SEQ ID NO: 20254 - DNA, 254 bp, Homo sapiens
  misc_feature 117: r=a or g
actttctctgactccacgctgcgtcaaagcattctgatctttttaatgcacatcccgctatggttggccaagtttgaccttcacagctcattatgatcattgatccttatatgatgracctgataaatgagcaacagtcacaacagatggaggactcaatgcttatgttggagaaggaagctacattgtccctgagttcatggaaatgtcaagtctagaagatggaaaagttcagttaatatctccagaggacc

SEQ ID NO: 20255 - DNA, 163 bp, Homo sapiens
  misc_feature 131: r=a or g
  misc_feature 132: s=g or c
  misc_feature 134: m=a or c
  misc_feature 158: k=g or t
attaatgacccggagccacatgatggagcatgacacagcacttttgggcacaaggcagggcctagaggggtgcgtgggggccgcagcccagcccccaagccccgccagcggctttactggggtgtaacaarsamacgataaactgcgcatattccagkgtatc

SEQ ID NO: 20256 - DNA, 304 bp, Homo sapiens
tagtgcccccacccccattcacactctactccctctctgccgtttcatctccttcaaggcatgtggcacccagaggtgtgcgtgtgtgtttgttcattcctcctacctgaatgtgagctgcacaagggtggggcttgttttgttcactgctgtgttcctatcacctgtgaacacaccatcctttgaggtcttgttctgtccatttcccctattgcctggtttccttttctttctctgttggataatttcttgtcagtaagcgtttgcaactttttctcctcattgaaaacacacacagcccgtt

SEQ ID NO: 20257 - DNA, 223 bp, Homo sapiens
atgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgcctttt

SEQ ID NO: 20258 - DNA, 99 bp, Homo sapiens
aagttttcattgtgtcttaacaaaggtgtggtagacactcttgagctggacttagattttattcttccttgcagagtagtgttagaatagatggccctc

SEQ ID NO: 20259 - DNA, 149 bp, Homo sapiens
ccttgctggatgaaagaagcattctttccccccctctatcagtgtggcatcactcaggtgtctacctggaacagacggaactacctaaagaatggtgtgctgaagtctaccttaaaatctgccatggcccatgaccccctctcccctac

SEQ ID NO: 20260 - DNA, 393 bp, Homo sapiens
  misc_feature 225: r=a or g
  misc_feature 341: n=a, g, c or t
acagaggttacagtgagccaagatcacgcactgctctccggcctgagtgagactccatctcacaaaaaagagaaaagaaaattccattcttaatcagctattattgagctttctcattttggactcttacagtgcccacctgcattatatctggcactagattacaatataaaatattttgagtaatctggccaggcacagtggctcacacctgtaatcccagcrctttgggaggctgagacaggcagatcaagaggtcagggagttcgagaccagcctggcctcttgatctgcccgcctcggcctcccaaagtgctgggattacaggcatgagccgccgngcccggcctatggtgatggttttaaaagcgatagttgttcctatgcccacat

SEQ ID NO: 20261 - DNA, 304 bp, Homo sapiens
  misc_feature 201: r=a or g
  misc_feature 281: m=a or c
  misc_feature 291: y=c or t
tagcaatttattcaccaaatcaaaccaatcactgcaatgcagttttctctttcagctcttacttccaaccaaccacttttaactactttgaaacttctgttctacaataacatttctttttcagcaaggggtttaggaaagctatcatgaaaatcctctttttttttttagccttcatagctttgatccgttcttttagargaatatttgtttacagttacactacttattctaggcaaaaatgatcaacacctgttccaaattagtactccagtccccamactccttttycttttcaccacca

SEQ ID NO: 20262 - DNA, 180 bp, Homo sapiens
atagctactactttgttaagagctgaaattgaccagaattaaccacaatttactgacctagtcttcctgtagaacaagcttgtctaacccatggcctgtgggctgcatgcagcccaggatgactttgaatgaggcccaacacaaaattcgtaaacgttcttaaaacattatgattttttt

SEQ ID NO: 20263 - DNA, 97 bp, Homo sapiens
atcctgggttcacgccattctcctgcctcagcctcccgagtagctgggactacaggcgcccgccaccacgcccagctaatttttttttttttttttt

SEQ ID NO: 20264 - DNA, 97 bp, Homo sapiens
  misc_feature 90: k=g or t
atcctgggttcacgccattctcctgcctcagcctcccgagtagctgggactacaggcgcccgccaccacgcccagctaattttttttttkttttttt

SEQ ID NO: 20265 - DNA, 85 bp, Homo sapiens
atgtattttctgtctagtaaaaaggctcattaccaatgcacttgggacacagtagtacatgtgtaattaattttttttttttttt

SEQ ID NO: 20266 - DNA, 185 bp, Homo sapiens
agtagagacagggtttcaccatattagccagacatggtggcaggcgcctatagtcccaactattcgggcagctgaggcaggagaatggcgtgaacccgggaggcggagcttgcagtgagccgagatcgcaccactgcactccagcctgggcattacagtgagactgtctcaaaaaaaaaaaaaaa

SEQ ID NO: 20267 - DNA, 308 bp, Homo sapiens
gcacccagtgtgtgatgttccccatcacacattgtcaaaactctgtcaaagtgttctcgttgttcaattcccacctataagtgagtgagaacatgcgatgtttggttttctgtccttgcaacagtttgcttagaatgatggtttccagcttcatccatgtccctataaaggacataaactcatcatttttgatggctgcatagtattccatggtgtgtatgtgccataaaaggaacatgtttatatcctttgcagggaaatggatgaagctggaagccattatccttagcaaactaactctgggacag

SEQ ID NO: 20268 - DNA, 324 bp, Homo sapiens
ttggacactgttctgtgttggttaaggtccagtttctgccaggtgtggtggctcacacctgtaatcccagcactttgggaggctgaggtaggcagatcacttgaggtcaggcgttagagaccagcctcaccaacatgatgaaaccttgtctctgctaaaaatacaaaaattagtcaggcgtagtagcatgcgcctgcaatcccagctactccagaggctgaggcaggagaattgcttgaacccgagaggcagatattgcagtgggccgagatcgcaccactgcactccagcctggtgagagcgccagactccctctcaaaaaaa

SEQ ID NO: 20269 - DNA, 328 bp, Homo sapiens
  misc_feature 318: n=a, g, c or t
ttggacactgttctgtgttggttaaggtccagtttctgccaggtgtggtggctcacacctgtaatcccagcactttgggaggctgaggtaggcagatcacttgaggtcaggcgttagagaccagcctcaccaacatgatgaaaccttgtctctgctaaaaatacaaaaattagtcaggcgtagtagcatgcgcctgcaatcccagctactccagaggctgaggcaggagaattgcttgaacccgagaggcagatattgcagtgggccgagatcgcaccactgcactccagcctggtgagagcgccagactccctctcnaaaaaaaaaa

SEQ ID NO: 20270 - DNA, 120 bp, Homo sapiens
gcacaagggggcttgactgtgagactgacaggtcgagcagggacgaaagtcgtgactagtgatctgacggtggcttgtggatgcgccgtcactcaacggataaaaggtaccccggggcgc

SEQ ID NO: 20271 - DNA, 149 bp, Homo sapiens
tctgacagctttattagagcagattgcttcttcctgtgcccttagagtttttcttgtttttgttttgtaggtaggatttttagttttgaaggggttggtagagtgaggctgtttttattgtatgtgctttgcatacacagtcacccgcc

SEQ ID NO: 20272 - DNA, 165 bp, Homo sapiens
acgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccca

SEQ ID NO: 20273 - DNA, 96 bp, Homo sapiens
  misc_feature 12: m=a or c
  misc_feature 14: s=g or c
  misc_feature 39: r=a or g
  misc_feature 49: m=a or c
  misc_feature 54: r=a or g
  misc_feature 70: s=g or c
  misc_feature 75: s=g or c
tcctgggttcamgscattctcctgcctcagcctcccgartagctgggamtacargcggccggcaacaagsccagstaatttttttttttttttttt

SEQ ID NO: 20274 - DNA, 215 bp, Homo sapiens
agcaatggcgtgatctcagctcaccgcaacctcagcctcccaggttcaagcgattctcctgcctcagcctcccaagtagctgggattacaggcatgtgccaccatgcccagctaattttgtatttttagtagagactggtctctactaaagaccatgtttgtcaggctggtcttgaactcccgacctcaggtgatctgcccgcctccgcttccct

SEQ ID NO: 20275 - DNA, 220 bp, Homo sapiens
  misc_feature 84: n=a, g, c or t
  misc_feature 87: d=a or g or t
  misc_feature 94: d=a or g or t
  misc_feature 145: v=a or c or g
actcccaacaaaatatacagtaatcctgaattccctattgaactacttaaaagttctgcaattataccaacagaggcgaagganaadgtatcadcatctatgcatacttttgctgtgaagtatgagacaaaggttagggaataavaacagctcttactacacagcaaaagtatgcatagatgttgatactttttccttcgcctctgttggtataattgca

SEQ ID NO: 20276 - DNA, 172 bp, Homo sapiens
attcaactgaaaatgaaaatactgggccaggtgtgggggcaggcatctgtaatctcagctactcagaagcaggaggatcgcttgaatctaggagttcgaggctgcagcgcactatgatcacacttaagaacagccactgcacttcagcccaggcaacgtaacaagaccccga

SEQ ID NO: 20277 - DNA, 208 bp, Homo sapiens
attgaatgtttgcggtcacagagagaacttagagttatatgacactcaaaggaaaagcaaaagagcattaagaagtgtctgtttttgttattgccatttcataaatattttagtaggtgttcaatttcattggatattcttttttttaattgtctttgtacctatgattgaaaacagtagttggtctatgacttttgaggagagggaa

SEQ ID NO: 20278 - DNA, 115 bp, Homo sapiens
gggccgaaagcgaaaacaaattctgggctgcgaggtgctgttctctcccgggcgcccccacccgctccctgcccctccggcgccctccagcgaggtggggaaacgaaaggccgat

SEQ ID NO: 20279 - DNA, 128 bp, Homo sapiens
tcatttttaattctgggacttttaactcatgaaggaaataatctatgtctggcagctgcagagctgacccaaattgcctcctgtgtcccaggaaaatgtagaacagtgaccatatgatccagcacgca

SEQ ID NO: 20280 - DNA, 80 bp, Homo sapiens
aaatataattattcaagggtatgcacatcttttttgccggggaggtgggcagagtatgcacttttttttttttttttttt

SEQ ID NO: 20281 - DNA, 141 bp, Homo sapiens
ctatttgttagaaaattctacataccaggcagggtacagtggctcacacctgtaatcccagcactttgggatgccagggcgggcggatcacctgaggtcaggagttcaagaccagcctggccaacatggtgaaaccccacc

SEQ ID NO: 20282 - DNA, 207 bp, Homo sapiens
gacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggccagggaac

SEQ ID NO: 20283 - DNA, 307 bp, Homo sapiens
gagacacaagggactgtgaaacttttaggattgctatggttttaatgtgtgcctcaaaatttcatgtgttggaaacttaatcttcagtgcaacagtgttgagaggtggggcctttaagaagtaattagatcataagtgttctgcactcataaatgaattaatgtcattatcatgggattgggttggttatcgttaagtgtggactcctgacaaaaggacaagtttgggctccatttctctctgttttgcgcacctgtttctgtcttcccacatgctggcgccatgctcttggacttcccgggctcaa

SEQ ID NO: 20284 - DNA, 193 bp, Homo sapiens
accgtgttagccaggatggtctcgatctcctgaccttgtgatccacccaccttggcctcccaaagtgctgggattacaggcatgagccaccgtgcccggcctctggctaatttttatatttttaatagagaccaggtttcaccatattggtcaggctggtctcgaactcctgaccacaccagatctacccacg

SEQ ID NO: 20285 - DNA, 77 bp, Homo sapiens
  misc_feature 36: m=a or c
tagcttgatataaaacagaattcaaaagtgaaaaamaaaaaaaaaaaaaaaaaaaaaaaaaaaaaaaaaaaaaaaaa

SEQ ID NO: 20286 - DNA, 103 bp, Homo sapiens
atgttggtcaggctggtctcgaactcctgacctcaagtgatccatctgcctcagcctcccaaagtgctgggattacaggcatgaaccactgcacctggccccg

SEQ ID NO: 20287 - DNA, 156 bp, Homo sapiens
ttctgagtgcaagttaaacactgcttgtttacaaatggcttgagtaatggcagtgagccatggcatatagaagtgatgccttaataatgtctttagtgctgtttttctccatgtgagttccttggtggaactcttttacaaatctgggggccacct

SEQ ID NO: 20288 - DNA, 169 bp, Homo sapiens
tttgtggtgtctctgctagattttggtatcaaaatgattctggcctcatagaatgagttagagaggagtctctccctttcaatattttataatttcaataggactggtgccagttcttctgtatacatctggtagaatttggctgtgaatcgttctggtccgggggctg

SEQ ID NO: 20289 - DNA, 110 bp, Homo sapiens
attgagactagggtctcactctgtcactccagctggagtgcagtggtgtgatcatggctcactgtaaccttgacctcctgggctcaagggatcctccctcctcgccccca

SEQ ID NO: 20290 - DNA, 167 bp, Homo sapiens
  misc_feature 167: n=a, g, c or t
gtgattgtatttgttcattcttgaattgctataaggaaatacctgagacttggtaacttaggagaaaagaggtttaattggctcacagttctgcaggctgtccaggaagcatggtggcatcagctcctggggaggcctcaggaaacttacaattacagcggaagcgn

SEQ ID NO: 20291 - DNA, 195 bp, Homo sapiens
ttaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggcgggtc

SEQ ID NO: 20292 - DNA, 174 bp, Homo sapiens
cctctctacaaaaaataagatgtagccaggcatggtggcgagtgcctgtagtttcagctacttgagaggctgaggtgggaggattgcttgagcctagagttcaaggttgcagtgagctatgattgcacgactgctgcactccagcctgggtaacagagtgagacccaatctcta

SEQ ID NO: 20293 - DNA, 203 bp, Homo sapiens
tccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacacct

SEQ ID NO: 20294 - DNA, 57 bp, Homo sapiens
  misc_feature 10: s=g or c
  misc_feature 11: n=a, g, c or t
caagcgtgasncaccacacccagcctgtttttttgtttattgttttttttttttttt

SEQ ID NO: 20295 - DNA, 178 bp, Homo sapiens
  misc_feature 4: y=c or t
  misc_feature 5: y=c or t
tggyyccagggaatttaaataggtatggccagagctgcatacggccttttaaaaaaatagcattctagccaggtgcagtggctcacacctgtaatcccagtactttgggaggccaaggtgggcagataacttgaggttgggagttcgagaccagcctggccaacatggtgaaaacgcc

SEQ ID NO: 20296 - DNA, 379 bp, Homo sapiens
tatgggaagaagagatggcataggatgctgccaaaaggcatggggacatttatgtttcactcattttagtgaaactataaagtgctttattttgccattagaacatactgctaaaattgcaaagatgtccagaatatgctaaactgccattggtcatgttttgttctgtctgtaggaattaagctaatagtcattcatttcaaaacaaatttctcccatccacactcaactttaaaatcccataggaaataggaacgttgttattctagagatcaagtcttgatttcaaaagctatcttataacctgacccttagaagcccactcatcccttacttaatacagctacgtatttatagacagctaaggcccacagtatcc

SEQ ID NO: 20297 - DNA, 91 bp, Homo sapiens
atgtgtgaggagttttttttaaaaaaagactaatatcatctcagcttggagagactagaatttgattgtctgggtcggttatttggtgatt

SEQ ID NO: 20298 - DNA, 158 bp, Homo sapiens
tttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggctcc

SEQ ID NO: 20299 - DNA, 266 bp, Homo sapiens
attccttcccagcacgaaccagtgatttcaggccacttaagtagcaattaaaagtttcgaaagttttgaaagtgaatctgactcattaagcatacaattgtctgaaagacttggtcataaatgaaagcaagcccctcctattctttttaaagacataagcactgtttaatagggtttttaattttttaattacctaagtgatatctgaccacacaccttaaaaaaaattcataaatctaaggatcaaattcttctttaccacattt

SEQ ID NO: 20300 - DNA, 113 bp, Homo sapiens
  misc_feature 43: r=a or g
  misc_feature 44: n=a, g, c or t
  misc_feature 46: r=a or g
aagttcttcaggttcagttccagcggcagcagcgttgctgcarnartcgcttgctattcgagatagccagcagagggaatcggaactttgcttgcagcaggggttgaagcagc

SEQ ID NO: 20301 - DNA, 188 bp, Homo sapiens
  misc_feature 31: v=a or c or g
  misc_feature 131: r=a or g
ttttggctgggcgcggtggctcatgcctgtvatcccagcactttgggaggccaagacagccggatcatgaggtcaggagatcgagaccatcctggctaacacggtgaaaccccgtctctgctaaaaatacraaaaaattagccgagcgtgggtggcaggcgcctgtggtcccagctactcgggatggc

SEQ ID NO: 20302 - DNA, 367 bp, Homo sapiens
  misc_feature 171: r=a or g
  misc_feature 237: m=a or c
  misc_feature 238: w=a or t
  misc_feature 245: k=g or t
ttttaattataaatctgaactgcattaaaagatagtaaatttagctagtcaacatgaataacttttaacagagagttagttgtctcttctgtttccttagggaagaaagatgagttccttcagttcccaaatgagtcctcaattcaacatgagtgatttcaccagaataaratcttcttacttctgcaaaaagcagctaatgctttcggaagctaaataatcccaatgtgtgactcmwgccagtktcttttctttgaaacctcagcagcagcataactagtgattcacccttcttgaaatgaatgctgtgattcgcgttatgcacagatggctactgaatgcccaggtcacagcctttgcgtctggc

SEQ ID NO: 20303 - DNA, 188 bp, Homo sapiens
  misc_feature 31: d=a or g or t
  misc_feature 34: m=a or c
  misc_feature 35: m=a or c
ttttggctgggcgcggtggctcatgcctgtdatmmcagcactttgggaggccaagacagccggatcatgaggtcaggagatcgagaccatcctggctaacacggtgaaaccccgtctctgctaaaaatacaaaaaaattagccgagcgtgggtggcaggcgcctgtggtcccagctactcgggatggc

SEQ ID NO: 20304 - DNA, 232 bp, Homo sapiens
  misc_feature 115: k=g or t
gatctagggtcactgcaacctctgcctcccaggttcaagcgattctcctgcctcagcctcccgagtagctgggattacaggtgcccaccacgacgcctagctaatttttgtattkttagtagagatgaggtttcaccatgttgccaggcttgtcttgaattcctgacgtcgtgatccacgtgccttgacctcccaaagtgctgggattacagacgtgagccaccggcccaaa

SEQ ID NO: 20305 - DNA, 279 bp, Homo sapiens
  misc_feature 50: y=c or t
  misc_feature 51: k=g or t
  misc_feature 154: r=a or g
  misc_feature 235: r=a or g
ataatatcctttgtctttttaaaaaagatataagtatggccaggcgtggykgctcatgcctgtaattctttgggaggtcaaggcaggtggatcacctgagatcaggagttcaagacctgcctggccaacatggtgaaaccccatctctactaaraatacaaaaattagctgggcatggtggctcatgcctgtaatcccagctactcatgaggctgaggcagcagaatcacttgarcctgggaggtggaggttgcagtgagctgagattgcaccactgca

SEQ ID NO: 20306 - DNA, 183 bp, Homo sapiens
aagctgtccttatactcactcttgagcatttatatttcaaaatattcttggcagttaacattactgttaggctaagccttggactattagctagcttaaggacatacaaaatggacttttcattgatgccgttttactatttctttgctttcaccatatatagacatccacacaagcacacat

SEQ ID NO: 20307 - DNA, 412 bp, Homo sapiens
atccatgtgaggaacaatagtggcctgacctgacttggtaagatggcagaaaagttgaaatggctaatgtatgagcaagtagacatggtaatgaatatgatgataataagaatagggaacacttacaaatagctttggtttgtgccaggcagtgtactatgttccttaccaaggttatcttattttctttctttaatcctcacagctgactttgtgagttacagctctatcactgatttagacacatcccaacgttgacttgcatggtgctctgactcaccttctgagcaattttagccattgtcatactggttttctatcagttctgtcaacaggccttgttgtttctgacttagggcctttgtggatgctgtgctctctgtctggaatgctctgtactcccagtccctcc

SEQ ID NO: 20308 - DNA, 183 bp, Homo sapiens
tttttatactttaagttctagggtacatgtgcataccctgcaggtttgatacataggtatacatgtccatgttggtttgctgcacccatcaacttatcatttacattaggtatttctcctaacgctatccctcccccagccctccacccgctgacaggccccggtgtgtggtgttccccgcct

SEQ ID NO: 20309 - DNA, 236 bp, Homo sapiens
  misc_feature 223: v=a or c or g
gatagtttgttttaacggtatagtcctcttataccactttaaagtctttagcataactccagtataatttttaaaaattgtcaaaatggtacttctctgactgaagggaaaggatccaagttggaaggaagagaaagtataaatggagttccaatctctctcattgctaaagaaagcatacctttgaggaaaattcattgagctctgcagagtaaagcttgavaaacactgatata

SEQ ID NO: 20310 - DNA, 281 bp, Homo sapiens
aagacaagaagggtaagaagtaaaggagagggaggaaaggagttgaaagaataagagaatgaggtgaaagctgaagtccccacagagaggagatctctgaagaaattgctgatgaaagtccaacaggctcttccagtttgtctggtcggtcacatttgctgaaacctggaggaattgttagtggaagctcaacaggcctgactcagtctgactgtccattcttctggaagctgcagagaaaagaaacctggaaaccttatatgctgacaaaaagggacaaa

SEQ ID NO: 20311 - DNA, 220 bp, Homo sapiens
agcaccattatctgcatattacagctgaggagacagaggcttaggcaggctaactgattgtctccaggccacacagctgacaagtgacagaagcaggcccaaaccccaggtttctgcctccaggttaaatatactctttccctcttcgacccagatcccaaggaacccaatccaacagcaaaatcctacagtctccccaggagctccattcccggcaatc

SEQ ID NO: 20312 - DNA, 109 bp, Homo sapiens
caaaaccagatcaaaaacattttcattacccccaaaagttctagcctgtctatttccagtcaatcctctggcctccctgaaacatttctctctcactctccaccacagt

SEQ ID NO: 20313 - DNA, 61 bp, Homo sapiens
tgcacaactgtactccagcctgggcgacagagcgagactccgtctcaaaaaaaaaaaaaaa

SEQ ID NO: 20314 - DNA, 255 bp, Homo sapiens
tgaatatctaaccagcaccgtttgtttgagaagactgtttttcttccattgaattgcttttgcactttcgtcagaaatcacttggctgtacttgtgtgactctgtttctgattctctgttgcattccattgatctttgtgtctatcccatcaccaataccgagagtttttattattgtagctcataagaagtctcggtattgggatggaggaagatccaccaagcaaatggaaaacaaaaaaaggcaggggcaga

SEQ ID NO: 20315 - DNA, 101 bp, Homo sapiens
tagtctttttcatgtaatatatacacacacatatgtgattttccctatatattttgtattttatgtctggcttattttacattcttttttttttttttttt

SEQ ID NO: 20316 - DNA, 356 bp, Homo sapiens
  misc_feature 8: b=c or g or t
tgcaagtbgtttgtttctaagctcgttttcccattttgtggaatgtgagattttcttctactttttaaaaattgagaaggggtctcactctgttgcccaggctggaatgtagtggcatgatcacagttcgctgcagtcttgacctcccaggctcaagcgattctcccatctcggcttcctgagtaactgggaccacgggtgggtgccactgtgcccagctaacttttttgtattgtgtttaaaggtgggattttgccgtgttgcccaggctggtcttgaactcctgggcttaagtgatccaccttccttgcccacgcaaagtgttgggattataggcgttacactgcatccagccc

SEQ ID NO: 20317 - DNA, 94 bp, Homo sapiens
ctgctctgcaaacacaaacactctcatctcttcagagttatttcttctggcatcttcactataggcatttattgatatttcttgatttacttat

SEQ ID NO: 20318 - DNA, 267 bp, Homo sapiens
  misc_feature 189: k=g or t
tagagtgcatacctttcagcagtgtgtgtagaaaagttgaagtcatttttatagtatctcccacagttgctacctttaatcggtcaccaaatcctgcttgtttctaccacgaccgtctcaatttctctcataatctgtcccttcttttctgctcttacaacttctgtcctaatttagaccgcaattttkttcctggacaattacaataaccttctgtgtaccagctttacaccagtctctctcaactttaatctctccacaccacag

SEQ ID NO: 20319 - DNA, 114 bp, Homo sapiens
gactaggagagctacgaatcagaacaactggccattttctagctggagatgccagctccgatggcatggagggccctggggcaccccaggtgtctttacctcatcctggtgtgt

SEQ ID NO: 20320 - DNA, 331 bp, Homo sapiens
  misc_feature 255: r=a or g
aatctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagargctgcactgtgcgatgggagaataagaccatgtactgcatcgtcagtgccttcggactgtctatttgacctgcagt

SEQ ID NO: 20321 - DNA, 231 bp, Homo sapiens
tgcttttgggttcttggtcatgaagtctttgcctaagccaatgcctagaagggtttttccaaagttatcttctagaatttttataatttcaggtcttagatttaagtctttgatccatcttgagttgatttttgtataaggttacagacgagggtccagtttccttctgctacatgtggcttgccaattatcccagcaccatttgttgaatagggtgtcctttccccacct

SEQ ID NO: 20322 - DNA, 192 bp, Homo sapiens
acctgtagggtttcaagtggaaaatcgagattatttactgctttagtaagtaaacttaacgcccagtgtactttgggtggtcagcatttcactagatgatttctaaggtcccttcagctcattctaatcagaatttgcgatcttgagggctgagctgggctgggttttacattgcactggaaggagaggaaa

SEQ ID NO: 20323 - DNA, 266 bp, Homo sapiens
  misc_feature 164: r=a or g
  misc_feature 189: r=a or g
  misc_feature 237: w=a or t
  misc_feature 240: r=a or g
tatttttgtttctatttaaaaatatatttaaactgtatttcagaagtgcatttatgaagtgcttttctaaaatcaataatgtaattatggtgattgtacttatcttattctctgttgaaatttatttcaaaggtctaagctttttttcctggtattcttataaraaaattctgaacatttatgtcccaratttttggttaaaagaacaattgtgtgtgtgtatgtattagcatattwgtrtaaacatcctcttcacaatgcacaca

SEQ ID NO: 20324 - DNA, 170 bp, Homo sapiens
ctgccttcactaagggagggtgcaaagggaggagaacatcttggcctaaacagccagacaatgaggattagttatgggacctccagctgccctgactctgaatcatgggctagacagagcttggagattgcctggtccagggtttcctaatgccttagggtgcctttttt

SEQ ID NO: 20325 - DNA, 353 bp, Homo sapiens
  misc_feature 66: k=g or t
tgcaagtggtttgtttctaagctcgttttcccattttgtggaatgtgagattttcttctacttttkaaaaattgagaaggggtctcactctgttgcccaggctggaatgtagtggcatgatcacagttcgctgcagtcttgacctcccaggctcaagcgattctcccatctcggcttcctgagtaactgggaccacgggtgggtgccactgtgcccagctaacttttttgtattgtgtttaaaggtgggattttgccgtgttgcccaggctggtcttgaactcctgggcttaagtgatccaccttccttgcccacgcaaagtgttgggattataggcgttacagctgcatcca

SEQ ID NO: 20326 - DNA, 181 bp, Homo sapiens
  misc_feature 35: k=g or t
ctgcaatgaacatcttttggcttcttttgactgtkacagttatattctaaggagtgggacactaggtcaaagggcttgataagcgctatgacttagggactgccaaattgctttgcaaacaggcggtgcttgtttacagtgaaggctgccagctgtagatgagtgcaccattttcaccgct

SEQ ID NO: 20327 - DNA, 165 bp, Homo sapiens
agcctgggcaatgtggtgaaactacgtctctacaaaaaaatacaaaaattagctgggtgtggtggcacacgcctgtagacccagctactaggaaggctgaggtgggaggattgcttgaacctgggaggttgaggctgcagtgagctatgctcacaccactgcact

SEQ ID NO: 20328 - DNA, 387 bp, Homo sapiens
  misc_feature 21: m=a or c
gttgggattataggcgtgacmacggcgcccggcccatttgtttgatttgggtctagacaaggtctacactttgcatccggttgataggcctcttttttttgttttgttttgttccctttgttacccaggctgaagtgcagtggagcgatcagagctcacgtgcagccttgacctcccctgctcaagcaatcctcccgcctcagtctcctgaatagctgggaccacaggtgtgcgccgtcatgctcagatactggcatcagctctttggcgtgcatgttgtggtagtttttctacaggcgacctaggccatttgtcctggagttttgcagtctggggccagctgatacatccttgtggtgtcatgcacgtgttctctgtctctgtgct

SEQ ID NO: 20329 - DNA, 114 bp, Homo sapiens
caaaaaaggtaaggtagattattctaccttaccacagggctcaacagggaactccacagggatcaagctcatctagatgccaaatctttgccagctccttcctctgccccatca

SEQ ID NO: 20330 - DNA, 146 bp, Homo sapiens
cgatcaacatttatgacctaagtcaggtaatatacctggtttacttctttagcatttttatgcagacagtctgttatgcactgtggtttcagatgtgcaataatttgtacaatggtttattcccaagtatgccttaagcagaacta

SEQ ID NO: 20331 - DNA, 265 bp, Homo sapiens
tgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctggagtgcagtggcgccgtctcggctcaccgcagcctccaccttcctggttcaggggattctcctgcctcagcctcccgggtagctgggattgcgggcatgcaccacc

SEQ ID NO: 20332 - DNA, 189 bp, Homo sapiens
  misc_feature 90: r=a or g
  misc_feature 172: w=a or t
agcctataacttacactttctatccaactatatgtttgtacctattaaccaactttctctatcccacgcacccttcccagcctctggtarctatcattctactctttacctctatgagatcaactatttcagctctcacatataagtgagaacttgcaatattagtctctcwgtgcttggcttatttca

SEQ ID NO: 20333 - DNA, 282 bp, Homo sapiens
gagaaagggaaggaggtagccaagcaccagggaaaggattgacaagtggtaccgcaagcttcttttgaaattaaaatccagaacgttttagtggcaacaatctatacatttttgtctttttaaattcaaatacctgcaatttctagtctttcctgggctataaaggaaccggattttatctagctgactgatttttggcggttcaaataacaaaactacattttgtggttagtttagttaattaatagctgcaaatagctttttacaagcaaggagggaggc

SEQ ID NO: 20334 - DNA, 150 bp, Homo sapiens
caagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccctaa

SEQ ID NO: 20335 - DNA, 280 bp, Homo sapiens
  misc_feature 66: r=a or g
  misc_feature 76: s=g or c
  misc_feature 216: m=a or c
  misc_feature 229: s=g or c
  misc_feature 230: s=g or c
  misc_feature 268: m=a or c
gcaagtcggcggaaagtttggctgcgcgggttcccccgaagttcagagtgaagacatttccacctrgacacctgascatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcmtcggcggtggctsscaggatgccggcggagtagcagcagcagcaccaatggmagcggtggcagt

SEQ ID NO: 20336 - DNA, 399 bp, Homo sapiens
  misc_feature 201: r=a or g
  misc_feature 206: r=a or g
caaaaattaaattaacagtagttatttagacttcattagatttgcatgtcgattagaaacatccagtgacttaactatggatcatccatgtaatctggaaccatagttctagcattctccagaacccatctctttggtatagttcccatgtggtcgccaggaagccatgtcccttctctcttcagtttcctcttctatgaratgtragggataccacagattcatacaggagattcctcagactcatcataggaactgcttggttataaatgagattattcatatgagaacctgcagaagtctcaaggaaatcaattctctgcaaatgcctgtgattgttgctatttattattctcctggtgagtcagtccttttcatcacccaggcatactaacttta

SEQ ID NO: 20337 - DNA, 228 bp, Homo sapiens
  misc_feature 82: w=a or t
  misc_feature 106: y=c or t
  misc_feature 199: y=c or t
  misc_feature 205: y=c or t
ctaaataaggtaaaatgtgtgtgtgtgtgtgtgtgtgtgtgtgtgtgtgcagaggttgtgtaattgtattcatcactgttgwatgtattattggtttgatttggtytcactgctcctaagttccttttgtcttatcttgcaagcatatcactgtgagctacttaaatcattaacaactcattaaaactcttgaccattytcattytctaccaagctgaagcctgggtg

SEQ ID NO: 20338 - DNA, 172 bp, Homo sapiens
  misc_feature 46: s=g or c
  misc_feature 47: s=g or c
  misc_feature 157: s=g or c
cagtaaggctccacccatttcacaggaggcctagagaccggcgctsscctttcccctcccgccggacctgccaggaggtgggctggcgcggagggagggccctgtcccctgtccctttaaggaggagggccaaacgccggcctagagtgcggcgtascccacccgccgtcat

SEQ ID NO: 20339 - DNA, 348 bp, Homo sapiens
  misc_feature 177: r=a or g
  misc_feature 293: s=g or c
  misc_feature 294: r=a or g
acatttaaacggctagatgttggataataggcagaatttgaaattaaatacagcttggcatagttatttgcattcttggtcattgtattttctagggctgcggtaacaaaatacgacaaactgggtgatttaaaacaacagatttattgtctcagttctggaggcaagatgtctgaratcaagatgtaggtatggccatgctctctcaaggttcgaggggagaatctgttccatgcctcttagcttgttgtgttactgccaatccttagcattttttggcttgcagctatgtsrctccagtctgtgactctgttatcacaacataatccctgtgtggctctgtcttca

SEQ ID NO: 20340 - DNA, 137 bp, Homo sapiens
aaaaaggacactggcccctaagaggccttccttctctctgctttgttcttatgaggggtgtcagatctcagcacaccctttgaacagaaaggctaaagtgaacaactccagcctgataggtttaggatacactcagg

SEQ ID NO: 20341 - DNA, 112 bp, Homo sapiens
ttttacgtatctcttggtgcttatatctttttcagttaaagacagaataacttaattcttagaaattcttcctatattgagaccctaccctcagctttttattgctggctca

SEQ ID NO: 20342 - DNA, 324 bp, Homo sapiens
catttttttcatgtgtttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgccag

SEQ ID NO: 20343 - DNA, 355 bp, Homo sapiens
tcagctggaaaagaatattttaattaaagtttcgggagaaggccagggttggattactatgtgactaaagatgcaaataaaaatatatcatattggccgggcgcggtggctcatgcctgtaatctcagcactttgggaggccaagaggtgggcagattacgaggtcaggatatcaagaccatcctggttaacacagtgaaaccccgtctctactaaaatacaaaaaattagccgggcttggtggcatgcacctgtaatcccagctactcggaaggctgaggcaggagaatcgcttgaaccctggaggcggatgttgcagtgagccgagattgtgccacctcactccagcctgggc

SEQ ID NO: 20344 - DNA, 309 bp, Homo sapiens
  misc_feature 198: r=a or g
  misc_feature 286: k=g or t
  misc_feature 304: y=c or t
agccagacctcgggttggccaccgccagcacggtggtgacagggattcagagggaatccccgggctgaaacagcagcccacagtcctgggacatgttggacacctccctcaacccatgaagccagagggttacgcttgagattgctgagaaggcggggaacccaggcagtccctgggcctccaaggagggaggaggargaggaggaggaggaggaggaggaggaggcctcccccaggatcgctgggccagctctgctccctgcagtctgccctccggctgcgtgtkgatgctgctcgtcctcgycctgt

SEQ ID NO: 20345 - DNA, 149 bp, Homo sapiens
ttatggcagtcattcaaatgttgaaggaggagacactacttttgtgctgcttcctgccttcaggccagacctgcaaataaggcctttggataaggaatgagtcaggtatcctggggacaaagtgcacatttcataagaaatccgagaat

SEQ ID NO: 20346 - DNA, 126 bp, Homo sapiens
aaactccatctcaaaaaaaaacaaagctgtcagtaactcaaaagtttcagccaatcagtgttgcagtctatttcctttgggttgtgggtctcctaagtatcatcccttcgtgatcgccagaaagaa

SEQ ID NO: 20347 - DNA, 130 bp, Homo sapiens
catagaatggtcaggagtgggtaactttacttatgctgtttggcataggtaacattttaataggcaaacattgcttgctcaaagtgttccagtctgagaaaatgtgcaggaggaacagcgtggaatcagc

SEQ ID NO: 20348 - DNA, 348 bp, Homo sapiens
  misc_feature 56: y=c or t
  misc_feature 64: w=a or t
  misc_feature 205: m=a or c
  misc_feature 208: m=a or c
  misc_feature 210: s=g or c
  misc_feature 229: w=a or t
  misc_feature 304: m=a or c
  misc_feature 308: y=c or t
  misc_feature 328: m=a or c
  misc_feature 344: m=a or c
ctgttttaacttctgatttgtagtggcatgctttgattcctttatctttttttttycttttttwaatttttgagatggagtctcgctctgtcgcccaggctggagtgcagtggtgccatcttggctcactgcaagctctgcctcctgggttcacgccattctcctgtctcagcctcccgagtagctgggactacaggcgcccgcmacmasgcccaactaattttttttwatttttagtagagacggggtttcaccatgtatccaggatggtctcgatctcctaacctcgtgatccacctgcctmagcytcccaaagttctgggattamaggcttgagccaccgmgcga

SEQ ID NO: 20349 - DNA, 124 bp, Homo sapiens
acgtttagaggcgtggcactaggagtgcacatctgtgagcatgacaagcttatcctcccatggtaacagaagtccaggctgaggctgattctggacgctgtcctttcagcacacgcagagccaa

SEQ ID NO: 20350 - DNA, 229 bp, Homo sapiens
ccatgcccggctaattttttgtatttttagtagaaatggggtttcaccatgttaggctgctctcgaaactcctaacctcaggtgatccacctgcctcagcctcccaaagtgctgggattacaggcaggagccaccaccacacctggcccagatggctgctttcaaatcttgacctctgtgcaatgttagggagctgtgttaggcacatgaattaaccttctgaacctgt

SEQ ID NO: 20351 - DNA, 151 bp, Homo sapiens
acttctctctctgtctctcctgccaccatgtgaagaaggtgcttgtttcccctttgccttccgccatgagtgtaagtttcctgaggtctcccagtcatactgctggttaagcctgcagaacggtgtacttgtttgaaatgtatctggccca

SEQ ID NO: 20352 - DNA, 184 bp, Homo sapiens
tgggggatcgtggtatctgactgctaggctgtgctctgatgttaactgcccatgagatagttctcaactaagcaattagaaattaaaatactttttagctctccgggagcttgggaaatcctgataaaaagatgcaaagaatcatactccttgcttatcaaaacctatttatgctagctgccct

SEQ ID NO: 20353 - DNA, 127 bp, Homo sapiens
tggcgtctggcccaaccacacacctggggaattgctggcctgacttctgacccctgactcctcatacccttcctccagagcatgacatttgaccaccaactgaaacctgacctctgaccccaggacc

SEQ ID NO: 20354 - DNA, 217 bp, Homo sapiens
  misc_feature 197: m=a or c
  misc_feature 198: r=a or g
  misc_feature 217: n=a, g, c or t
agagttcatccaccagaggaggaggctgcaggccttgggcactgctcagcaggatgaggggccactgcagttgagcatgtctagcctggagtcttctgaagaacatgattactgactttatgtataggaatggctgccaatgaagaagagaatattgaaagtcagaagcatgctatcacataactctgcatttcatmrggccgagaaagcaccgcgn

SEQ ID NO: 20355 - DNA, 149 bp, Homo sapiens
ctctgagccaggtgtgggatataatctcctggtgtgccgttttttaagcccgttggaaaagcgcagtattagggtgggagtgacccgattttccaggtgccatctgtcacccctttctttgactaggaaagggaactccccgaccccca

SEQ ID NO: 20356 - DNA, 88 bp, Homo sapiens
tttaatggtggcacattcctgcataggagatagcagtgataatgggtggataccagaacgtgcatcagcacagaagaatctcagcaac

SEQ ID NO: 20357 - DNA, 88 bp, Homo sapiens
  misc_feature 40: r=a or g
  misc_feature 58: r=a or g
  misc_feature 59: v=a or c or g
  misc_feature 69: r=a or g
attgattaaactctagcaaaactgacaaaaagagaataarattagcaaaaggaatgarvaaaggggatrccactacagactccacaaa

SEQ ID NO: 20358 - DNA, 138 bp, Homo sapiens
ttttttaaagaaattcactttgatgtatctcttgtattttaaatgcacctatttgcacaactttttaagttgttgatgtaggtattatattatatatacaaaacttatagtctagcgctgtcttcattttaccagttt

SEQ ID NO: 20359 - DNA, 304 bp, Homo sapiens
tctgcaggacagccgctgagcgggaggtcagccctctgaggggctctgactcgggcctttggctgagaaccttacctagagaaagacaagcccaactcacagtaaacttccctcgcctgtccgctgtgactgggccgacgggtccagggtggctgtgggtggagtgcagcggggtggagaaagagagaggaaactcacttttgaatcctcagttgctttccctaggctgggctgcccaggaacaacttcaatgggcaaaggagtatgtgatcgatgggaccaaggtgctgggaaacggggtcgc

SEQ ID NO: 20360 - DNA, 102 bp, Homo sapiens
ccatttattaaatagggaatcctttccccattgcttgtttttgtcaagtttgtcaaagatcagatagtttgtagatatgcggcgttatttctgagggactcg

SEQ ID NO: 20361 - DNA, 327 bp, Homo sapiens
  misc_feature 75: r=a or g
  misc_feature 221: r=a or g
  misc_feature 222: r=a or g
  misc_feature 233: r=a or g
  misc_feature 234: m=a or c
  misc_feature 259: v=a or c or g
  misc_feature 280: r=a or g
  misc_feature 281: r=a or g
tgttgcctcaaagtgaccacggaccaggcagtctctaatgaataggcaaggccacaacctcctttctcccagaaragaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcarrtatgtcagggrmctcctcccatgagtccttctatgavtccctctcagacatgcaggarrgaaagcaagaatactgacttcttcccgggcctttctgctttcctca

SEQ ID NO: 20362 - DNA, 175 bp, Homo sapiens
tttcagtgaagcatcccagtgccttgaatccagtaagcagccaggtgtctgttggcttcatggtttaacaacctaccatttgaagaatcgcagagatgaattaaaaagagccccggagaggctccccgatccagttgcacttcctgcttaagcaaagtaaagaaaaacaggaatg

SEQ ID NO: 20363 - DNA, 283 bp, Homo sapiens
  misc_feature 56: b=c or g or t
  misc_feature 65: w=a or t
  misc_feature 80: k=g or t
  misc_feature 170: k=g or t
  misc_feature 225: w=a or t
  misc_feature 257: k=g or t
cagtttttattagaaaacacacagtgtgtaattttagtcttttttaaatgattgtbtttgttgtwttgaggcaagatttkactgtcacctcgtgtgaagtgcagtggcataattttggctctctgtagcctcagcctcctgggctcaagtgatccttttacctcagtttkctgagtagctaggactacagatacgcactagatgtctgtttaatggttggtttgwttgtagtgttcggatctgactacgttgcccakgctggtcttaaacttttggcacctcg

SEQ ID NO: 20364 - DNA, 59 bp, Homo sapiens
gattaaaaatatattactataaatattttttaacaagtgcttatctgctaactagagtt

SEQ ID NO: 20365 - DNA, 177 bp, Homo sapiens
caagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagagggaagg

SEQ ID NO: 20366 - DNA, 208 bp, Homo sapiens
aaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaatgt

SEQ ID NO: 20367 - DNA, 166 bp, Homo sapiens
agagtggaatttggccttagaacatttcctaagtgcgagtttgggcacagccagccaaagaggctcggtgacttgtcactccagagaatgcctgcagtgtcctcaccctgtcacagcctcagacacattttgaatctgcaggaactagttcaacccaggaagtcga

SEQ ID NO: 20368 - DNA, 83 bp, Homo sapiens
attcaagcaattatcctgcctcagcatcctgagtagctgggattacaggtgtgcaccaccatgcccagctaatctttgtattt

SEQ ID NO: 20369 - DNA, 259 bp, Homo sapiens
ctaactcaccacttggctctgaatgggcactccccatctctgcaccttggttcccttgtctctgaggtggtgacagtgcacaggggtactggaggttctgaggtttgcgagtgtgaagtgaggcactggcagagtttgaatgaactccagccagggcaacaggaaggccttgaaggtcgagaaacaggactcatcttcccgcctgaagtgagatggaacaggattcaatcccatttgccacacctccgtgaaggagtta

SEQ ID NO: 20370 - DNA, 262 bp, Homo sapiens
  misc_feature 67: k=g or t
  misc_feature 68: k=g or t
tcttcttaactaaacaaaaccaatttgccttcttgattcacctttatccctcaatcaagagcttgtkkttttaccttcagctcttttcccttagttcaaccttagtagactcaactgtcactcctcattcccctatgctgtctttgtgccactgccgccggtcgcatagttgagaacagagttcttacctgtttactgacacataaagggccagatccttttgtttttaatttagcagatgttgagagattatgctcctttt

SEQ ID NO: 20371 - DNA, 127 bp, Homo sapiens
aaagctctcccacaagaacctctcctaaggctttcacctttggctgagtctgctcaccctggcagttcctctcattgatgagaagcttatagcctttcttgcaactgcattcgaagctgcccaccca

SEQ ID NO: 20372 - DNA, 94 bp, Homo sapiens
aagactatactttcagggatcatttctatggtgtgttactagagaagtttctctgaacgtgtagagcaccgaaaaccacgaggaagagaggtac

SEQ ID NO: 20373 - DNA, 211 bp, Homo sapiens
cctcccaggttcaagcgattctcctgcctcagcctccttagtagctggattacaggcacacgccacccgcccagctaatttttgggtttttagtagagacggagtttcaccatgttggccaggatggtctcaatttcctgacctcgtgattctcccacttcggcctctcaaagtgctcagattacaggcgtgagccaccgtgcccggccac

SEQ ID NO: 20374 - DNA, 177 bp, Homo sapiens
ctgccaacttccacctcccgggttcaagtgattctgctgcctcagcctcctgagtagctggtattatgggccatgcccagctaatttttggatttatagtagagatggggtttcactgtgttggcaaggctggtcctgaactcctgacctcaagtgatcagcccaccttggcctccc

SEQ ID NO: 20375 - DNA, 322 bp, Homo sapiens
acttcattaatggccttgaaatcctaggctcacctgatcctcccacctgagcctcacgagttgctggcactacaggccctcaccaccatgccaggctaattatttttttatttttattttttgtagagacaaagtcaccctatgttgctcaggctggtcttgaactcctggcctcaagtgatccccctatcttggcctcccacagtgttgggattataggtgtgagccgatgtgcctgggcatatatgtttattgtgcacctagcgtacacacacatgcacgtggcattagtctttgttccagtcattttctgagaaggagt

SEQ ID NO: 20376 - DNA, 186 bp, Homo sapiens
acgtgtatataaaaccaggtgtagtggcatacgcctgtagtcccagctactcaggaggctaaagcaagagaaggagttgagcccgggaatctaaggctatagtgtatcttgtctgtgaatggtcactgcactccagcctggccaacatagcttgactccatctctaaatacacacacacacatcca

SEQ ID NO: 20377 - DNA, 107 bp, Homo sapiens
taatttgccaagtaagttcttgtcataaaaaatattcatcttaatagaaaatgtttttggctgggcatggtggctcacacctgtaatcccagcactttgggaggctc

SEQ ID NO: 20378 - DNA, 107 bp, Homo sapiens
agacactcagcatatttagatagttttggtacggttatggaatcaggtggggatgaggaaagagtgccaaagttgtattgtgtgcgggtcccacttaatgtgtcatc

SEQ ID NO: 20379 - DNA, 227 bp, Homo sapiens
  misc_feature 64: s=g or c
  misc_feature 74: s=g or c
  misc_feature 77: r=a or g
  misc_feature 142: r=a or g
  misc_feature 227: m=a or c
accagtttcaaacaattctccagcctcagcctcccaagtagctgggactacaggtgcacgccascctgtctggstartctttttgtatttttagtagagacggggtttcaccatgttggccaggatggtcttgatacaggartactgaatagtgaattggtgaacatggacatgaatttcttgttgctcatcttagaaggaaggcattcagtattttactgttaggm

SEQ ID NO: 20380 - DNA, 294 bp, Homo sapiens
  misc_feature 201: y=c or t
  misc_feature 203: y=c or t
actccttttgtactagtaaaggtagaaatggactatagaaagccaaataatttgtatgggaataaaatatggtcaagagatttagagaaatatcaaaaagatgaaaacagttaaaggtgatagtaatgaagacaaggaaaaaatctaatagagttatgttggtttttttgtttgtttgttttgttttgtttgagacggagycycactctgttgccagggctggagtgcagtaggcgcgatcttggctcactgcaacctccgcctcccaggttccagcgattctcccgcccctca

SEQ ID NO: 20381 - DNA, 142 bp, Homo sapiens
gtgctaggattagaggtgtgagccaccgcacccggcccagacttttaaacaaccagatctcacatgaaccagctgagcaagaactcacttatcaccaaagggatggagctaaaccatttgtgagggatcttcccccgtgctc

SEQ ID NO: 20382 - DNA, 260 bp, Homo sapiens
aggatccctaagcctccggccccagacaaacgggactcgcagcttctgcgcctcctgctccgctcactcttctttgtctcagcctttccatctttttcgccaggactctgctgggccgctcagccatgcctgagggagcccaaggactgagcctctccaaacctagcccaagcctcgggtgtggccgaagaggtgaagtgtgtgactgtggcaccgtgtgtgagactcggacagcagctcctgcagcccccaccatgacc

SEQ ID NO: 20383 - DNA, 271 bp, Homo sapiens
catgttttcatttctcttgggtaaacagctaggattggaatggataggttatatagtaactgtatatttaatctaagaaactgccatggctgggcacagtggctgacgcctgtaatcccagcactttgggaggccgaggagggcagatcagttgaggccaggagtttgagaccagcctggccaacatggcgaaacaccgtctccactgaaaatacaaaaattagccaggtgtggtagcacatgcttgtgaccccagctgcttgggaggctt

SEQ ID NO: 20384 - DNA, 403 bp, Homo sapiens
tataactcaggaaataccttccgaggcaaaaatgtgtgtggatcagtagaggtagcagcagcagtagctgccaagtgccctgatggcctggagtcagatggctacattgcactcagttctcccatcttccatagatactggatgttatccttcaatgtttgccttgagccagatggagaggaaagaggcagagttaacttgtctttctattttcattctcccaaatacaactgattttttactctactcctggatacctttcttatatcacaactctgatgatgtaacttttctcaaccaaactttcaggggaccctctatgatctcagaatgaaaccccaactgtgttgtatacatttaacatgcattctactttccttccttccttacattttagctgcgt

SEQ ID NO: 20385 - DNA, 275 bp, Homo sapiens
cctcagcctcccaagtagctgggattataggcgcacgacaccatgcccggctaatttttatatttttagttgagatgggatttcaccatgttgtccaggctggtctcaaactcccgacctcgtgatcgcctgcctcggcctcccaaagtgctgggattacaggtgtgagccaccgtgcctggctaattttttttgttttttagcagagatggggtttctctatgttggccaggctggtctccaaccctgacctcaagtgatccacccacctcgag

SEQ ID NO: 20386 - DNA, 174 bp, Homo sapiens
tctttaattccttttagcaaagtcttatagtttttatatagaagttgtacatgccttctgttatatttgttcctaaataatttatgatattttttctgaattttagtgtccgtttattttctgccattatgaagaaatacagctggtttctgatattaacttttaccctatgac

SEQ ID NO: 20387 - DNA, 181 bp, Homo sapiens
actgagcacctactgaaatccctgatacttggctgagagcattgtaaacacggcttccaagttttacaacagctcttcagggtagtggtatctcaaattttacatctgtggaaccagggtcttagagaagctataataacatcttgtctatgatcccccagatctctgacccagagcctgt

SEQ ID NO: 20388 - DNA, 353 bp, Homo sapiens
  misc_feature 167: b=c or g or t
caaaagcacacaagaactaggcaccctttctctctccaagagtttaagtggtttccttaggttaaagaaggggacagaccagctaaaaatggttgtaccactcactgtacaacctcatggaaattctcactataagatttagaggcaatgttccctagctataagcbagggcaagaaatggcgcctctggagttggggaacattaggggaacattacaaccgggtagatgctggttccctgaagtgtggggccatgaacatgcagggacccacggtttgaatgaaacagctactgaaagctaagttcaaaccacccttgcgtaacaaaggagtacagggtacacatcaacacc

SEQ ID NO: 20389 - DNA, 134 bp, Homo sapiens
tattgcatatagagatcgcttgatttttgtatatccaccttttatctgtggccttgctaaactcactcaatagttccaggagcttttttgtgggtatggattctttggtttttttgtcttttcttttttttttt

SEQ ID NO: 20390 - DNA, 222 bp, Homo sapiens
  misc_feature 162: r=a or g
attctcatttttgtttctataaatttaaaatatgaacatgggtgggcgcggtggctcacacctgtaatcccagcactttgggaggccgaggcaggctgatcacttgaggtcaggagttcgagaccagcctggccaacatggtgaaaccctgtctccattaaraatacaaaaattagctgggtgtggtggtgggcacctgtaatcccagctactggggaggag

SEQ ID NO: 20391 - DNA, 204 bp, Homo sapiens
  misc_feature 70: r=a or g
agagagggagaggcggggagatgtcagagacggagacgaggcaaccggaccgtggaggagaaaaatagaragggagagaaaatagtcggagagacaaaaaccaggagacccatgcgtggacagaaagactaacggagacgaaaagaaagaggcagatggggagacacgtgcgagacgagacacatgtgcatttgttagggagaa

SEQ ID NO: 20392 - DNA, 148 bp, Homo sapiens
gatcaagttatttataatagcagacctgggattcaaaaccagatatgcttgtttccaaagcttttcctttctttacacttctaccctttccaccactatgcaatatttgatatctaagaagtattactaattttattttggaggcaat

SEQ ID NO: 20393 - DNA, 268 bp, Homo sapiens
tgatatattttttcaagggctgcaccaaccactgaaaaactaagtgttttttcgtgtatgcctaatgcaaatgaggaagatttgggtttttagggtaccccatatatgaggcaaagtggacagacaagatttcttcttcatcctaaagccaccacatctatacgattggtagcaacatcttgccactaatagtaaacaactgttgttttcgtctctgcagaatctgtgatccctcctctaatttatacttagagtcctcccctctcct

SEQ ID NO: 20394 - DNA, 57 bp, Homo sapiens
  misc_feature 22: m=a or c
  misc_feature 23: m=a or c
agatgatgaatctccagaagtmmctgcaagcatcagtatatggctacaatttttttt

SEQ ID NO: 20395 - DNA, 173 bp, Homo sapiens
tagctgggattacaggcatccaccaccatgcctggttaatttttgtatttttagtagagatgcggtttcaccatgttggccaggctggtctcgaagtcctgacctcaggtgatctgcccgcctggcctcccaaagtactggaattacaggtgtgagtcaccatgcccggccaa

SEQ ID NO: 20396 - DNA, 129 bp, Homo sapiens
gaatgtggtctgagtgcttttacaaggccatagtgcctcacgacccgactgcaaagagctccatggtgtatgtttttttgtttgtctgaagtgtagtttaaacaagccctttttttttttttttttttt

SEQ ID NO: 20397 - DNA, 277 bp, Homo sapiens
  misc_feature 68: k=g or t
  misc_feature 81: k=g or t
  misc_feature 121: r=a or g
  misc_feature 171: r=a or g
  misc_feature 245: w=a or t
  misc_feature 249: s=g or c
  misc_feature 256: s=g or c
  misc_feature 257: s=g or c
caatgctgcttaactctaatgcaggatgataattgtggctaattgcctaaaagcatatgaactttttktcccatcagtgtkatatgtgagagaacacacagatgccagggggtgagttaaraccttcgccattcattgttgtccatctacaagttgtagcaaatattggcrtgtagtctttaattgtgtaacattagagttgggtattgcaggagttacttgcagaacagggaagcattcatttwtgtsttctgtsstcttgcagtgactccattct

SEQ ID NO: 20398 - DNA, 356 bp, Homo sapiens
tagagggtgagtaaagcaggaggaggctggatgggaaactgaggaagggcacacacagggcaaggagatggcagaagcctagggaggagagggtttcaggcagagggagtggccaattgccaagcactgttgagacagagggaaggtaagggtctagggtcatctgtggagtttgtgacagggatgttgctggtttctttgacattgaagctctagtgagtggagggagggcctgatcaaagtggtctaaaggatggagcctgcagtagtctctggaaatgtggttggctatggaggactcaagtcgaggggtgacgtctggtgagggccttcttgctggtggggatctctgcagt

SEQ ID NO: 20399 - DNA, 383 bp, Homo sapiens
  misc_feature 58: m=a or c
  misc_feature 270: r=a or g
  misc_feature 271: w=a or t
  misc_feature 281: d=a or g or t
  misc_feature 282: h=a or c or t
  misc_feature 289: n=a, g, c or t
  misc_feature 297: v=a or c or g
  misc_feature 316: d=a or g or t
  misc_feature 327: r=a or g
  misc_feature 363: r=a or g
  misc_feature 364: d=a or g or t
cacagaattttatgaaattgacctcagtgcctacaactgactgcacatgacaaaatgmagaacacttagatttgatgaacacaaggcttgacatatttgtcaatagtaccaggaatagttttgcatactataatatttaacagccacaggagaaaggcaaaccaatataattaaggttaaatatatgtggagtaattgaataagagaggcttaatgtgtccctatttctattttaatttgttcagtcgcatgaatcaatgagctaaagcrwagatatgtadhaagagtnaatatctvaacaggatttgcttgagtdtccttaaatgrattgttagccatgcaggttaatttatcttttgagardgcatgtaattttgctgaca

SEQ ID NO: 20400 - DNA, 135 bp, Homo sapiens
cttccccaggcctccccttactgagattctcagctcccaggattagcaattcagagctgcctgaggcatacacctctggcctgctaaactattcaggttctccaaaagccactttcctgccctccctccccaccc

SEQ ID NO: 20401 - DNA, 194 bp, Homo sapiens
aagtgtgcaacagcatatgtctacaaagtgtacacaccttagtttacaaatactttattgttaacaagtgctaacagtcatctgagccttcagcaagctgcaatcttttttgtgtgtgtgataggatttcactctgtggctcaggctggagtaattgcagcctcaacctcctgctcaatcaaacccccacctcg

SEQ ID NO: 20402 - DNA, 52 bp, Homo sapiens
ctgggagcaggccctgttctgagtacctgatgctgattgacttttttttttt

SEQ ID NO: 20403 - DNA, 204 bp, Homo sapiens
atatttttgtcatcattttctttcttcaactgccagcctctctttcatcttgtgctgatgtcttgtcatcttgtctttgatctcttctttcatagaatctctgttaattgttgtatataattttcttctgtgtcctgttcctccaaaatagattttttcatgggtcgtttccatgctacatttttctgtcgtcctccacccaat

SEQ ID NO: 20404 - DNA, 69 bp, Homo sapiens
  misc_feature 58: r=a or g
catgatcacaccactgcactcctgactgagtgacaaagtgagatcctgtctaaaaaaraaaaaaaaaaa

SEQ ID NO: 20405 - DNA, 195 bp, Homo sapiens
aggtttctatttctttttgccagtaccatactgttttgattactgtagcttttggattttgtttgtttgttttattgttgttgtttgggtttttttgttttgttttgtttttttgcttttctttgtagagatggcgtttcaccatgttgccaaggctggtctcaaactcctgagctcaagcaatccacccgccac

SEQ ID NO: 20406 - DNA, 113 bp, Homo sapiens
ttgtcacaccgacctgcaccatctctcgcctgcctgtggggtttctgtcaactagtcgtggagggaaggagactctttaaagaataacatcttattgtggccatgccagggac

SEQ ID NO: 20407 - DNA, 76 bp, Homo sapiens
cagattatttcattgcccaggaatgaagtccaatacctactagttgtttgtcctaatccgcttcctctcccacccc

SEQ ID NO: 20408 - DNA, 279 bp, Homo sapiens
  misc_feature 65: r=a or g
  misc_feature 95: k=g or t
  misc_feature 100: k=g or t
  misc_feature 129: k=g or t
  misc_feature 168: r=a or g
  misc_feature 196: r=a or g
  misc_feature 213: w=a or t
  misc_feature 235: r=a or g
  misc_feature 251: r=a or g
tatcctcacattttgctaaattcacttatttgtaaattattatagattacttaggcttttcaacrtaatcatgtcatctgtgactaaagattatkttatkttatcctttccaatattttgccttttatktcttttccttgccttactattctgacaaggaccttcatrttacaatactgattagaagtggtgagaraagcacatttttctttwtcctaatcttaggaggaaagcrtttagtgtttcatgtragtataaaattagctataaattttgggt

SEQ ID NO: 20409 - DNA, 114 bp, Homo sapiens
atgtagactatactgtaaaaattcagtttgttgctttaaagaaacaaactgatacctgaattttgctgtgtttccattttttagagatttttatcatttttttctctctcggca

SEQ ID NO: 20410 - DNA, 191 bp, Homo sapiens
attattttattttatttttttatttttatttatatatatttttttattatactttaagttctagggtacatgtgcacaacgtgcaggtttgttacatatatatatatacatgtgccatgttggtgtgctgcacccattaactcatcatttacattaggtatatcccctaatgctatccctcccccctcccc

SEQ ID NO: 20411 - DNA, 133 bp, Homo sapiens
cagatcaacaagacagaaagtcaacaagtatacccaggaattgaactcagctctgcaccaagcagacctaatagacatctacagaactctccaccccaaatcaacagaatatacatttttttcagcaccacac

SEQ ID NO: 20412 - DNA, 179 bp, Homo sapiens
ctaaaaatacaaaaattagccagacaaggtggcccacacctgtaatcccagctacttgggaggctgaggtgggaggatcacttgaccctgggaggcagaggtagcagtgagccaagattgcatcactgtactccagcctgggtgacagagtgagaccttgtcccaaaacaaaaaaaaaa

SEQ ID NO: 20413 - DNA, 283 bp, Homo sapiens
  misc_feature 182: s=g or c
  misc_feature 274: b=c or g or t
gttctccttggctgctgagccaagtgaaagccttcttctttggtaatagtcattgtctcagtgattggcattctgcatggtgaacagcaggacctagactgacctttggcattggggtaacagtggctgatgctactggtggaggaaccacaccttgagaagcactgatctaggcaccttcsactcctctcagtctatagatgggaaaatggaaactcggagaggtgaggggctggctcacggtgactctgggagaaagcagaggagctggggbtagaatcac

SEQ ID NO: 20414 - DNA, 65 bp, Homo sapiens
gttttgatatatggttgttgttgttgttgttgttgttgttgttgttttaattttttttttttttt

SEQ ID NO: 20415 - DNA, 112 bp, Homo sapiens
gaacctcttgttttccaaaaaattagcaaaaagtagactctgctctggcaggaatggaactccttctgcctcttcctatttccatagaagaagagaccatagtgccccaatg

SEQ ID NO: 20416 - DNA, 341 bp, Homo sapiens
gttttcttctactgtggtctgagagagtgcttgatataatttcaattttcttaaatttattgaggctcattttatggtctaccttggagaaagctgtatgcactgttgaataatcagtgttcctgaagaagagagaaatctaaaagttcggaaaacatatttgggggagtaattgaggaaaacttccctggccttgctagagacccagacatccaaatacaagaagcacaaagaacacccaggaaattcattgcaaaaagatcatctcctaggcacattgccatgaggttatccaaagttaagatgaaggaaagaatcttaggagctgtgagacagatgca

SEQ ID NO: 20417 - DNA, 278 bp, Homo sapiens
cattttgctttcaccaattgattccttcttcttttagcccactattaaaacatttcttactgaatggttcatgtaggcttgctgaacagcacgcattacttgcttcctgaagagttcccccattcatccatttgtcccattagttgctgcggattatcaagttttgaaggaactgtacatcccaacagactgaaacattctaagtgaaatgagtataatccaagtaactggtgaactttggaggtttggagcttgaagagaatggctaagaagatttg

SEQ ID NO: 20418 - DNA, 305 bp, Homo sapiens
acacagcatagcttaaaatgaaggaggaagtactgaagaggtaatggaaggagacctaactgtctctgagagggaagagagtggttgggagggaactatattaattgaggagtgcagagaaattaatatggtccaaaggaaaaaaaggtttttttgagatggagttttgctcttatttcccaggctggagtgcaatggcatgaccttggctcactgcaacctctgcctctcaggttcaagcagttctcctgcctcagtctcccaagtagctgggattacaggcgcccaccaccacacccggcaga

SEQ ID NO: 20419 - DNA, 69 bp, Homo sapiens
catgatcacaccactgcactcctgactgagtgacaaagtgagatcctgtctaaaaaaaaaaaaaaaaaa

SEQ ID NO: 20420 - DNA, 200 bp, Homo sapiens
cctttaattcttaatttgatgagttttttccttcataaatgtgtattgacatgtgtcaaatgcttttactgcatcttttgaaatgatgatatggtttttcttctttattctgttaatggggcattccctgccctgtaggagtgatagttgaatagaaagaaaaacaaagaagtggtaatatctgttgtgattgagggcac

SEQ ID NO: 20421 - DNA, 113 bp, Homo sapiens
ttctctcttaaaccttttggtctgtgggagaggctgcctcaaaggtctctgagacatttcccccattgtcttggggattaacattcagctcctgctttttttttttttttttt

SEQ ID NO: 20422 - DNA, 165 bp, Homo sapiens
cttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccgg

SEQ ID NO: 20423 - DNA, 152 bp, Homo sapiens
agagctgtgattgcgccactgtgctctattctgagtgacagagcaagaccttgtctcaaaagaaaaacaaaaagtaaaaaaattttatatggtgaaatgttattctttcacccctgtctctgaccttcaaattaacttccttgaagacaacc

SEQ ID NO: 20424 - DNA, 154 bp, Homo sapiens
ggctaacatggtgaaacctcatctctactaaaaatacaaaaaattagctgggcgtggtggcgggcgcctgtagtcccagctacttgggaggccgaggcagaagaatcgctttaacccaggaggcggaggttgcagtgagccgagatcacgccac

SEQ ID NO: 20425 - DNA, 184 bp, Homo sapiens
aatgagccaccacgcccagcctctatatctttaaatatttatttatttatttatttatttatttttagagatatggggtcttactctgttgctgaggctagccttgaactcctggcctcatgtgatcctcctacctcagcctacctagtagctgggattacaggttcaagtcaccacacccagt

SEQ ID NO: 20426 - DNA, 80 bp, Homo sapiens
ctcaccagaaacagatgccagcttcatgcttcctgtaaagtctgcagaaccacgagcctatgaaacctcttttcttgttt

SEQ ID NO: 20427 - DNA, 149 bp, Homo sapiens
  misc_feature 113: w=a or t
  misc_feature 123: w=a or t
atcacctgaggttgggagttcgagaccaacctggctaacatggtgaaatcctgtttctcctaaaaaaaaaaaaaattataaaaaattagctgggtgtggtggcctgtgcctgwaatcccagcwactcccagcactttgggaggctgagg

SEQ ID NO: 20428 - DNA, 108 bp, Homo sapiens
ctagatgcattaattcaaggaatatttattgattaggtgccatgtgccaggatgctctaggggctggggaaaccaaatgggaaaaaaaacaaagttgctgctgtcgac

SEQ ID NO: 20429 - DNA, 140 bp, Homo sapiens
  misc_feature 2: r=a or g
aragcccgaagaaccaggcagcgggggccggggcaggcggaccccccgggctctcagcgcccacccgctcctccgcacacagcagctcgcacaggcctcccacctctgcctgttgattgatgcagggagaagcccgccct

SEQ ID NO: 20430 - DNA, 148 bp, Homo sapiens
agtaggaacgccgagtcggctgccgtggctgtgctgagggtggcggccggatagctgatgttctaatcatgtcagataaagatgatattgagactccactgctaactgaagcagcccccatccttgaagatggaaactgtggccagcc

SEQ ID NO: 20431 - DNA, 249 bp, Homo sapiens
gtggatttatttctgggatctctattctgttccattggtctgtgtgtctgttttttttccagtaccatgctgccacaaaaacagcaatggtagtagtataatttgaagtcagataatgtgattcttctagttttgttctttttgcttaggatgactttggctattctgagtcttttgtggttccgtataaattttgggattacttttttatttctgtaaagaatgtcattggcatttgatagggatgtc

SEQ ID NO: 20432 - DNA, 448 bp, Homo sapiens
tattagttcagttgttaaaatttactggaaggactgttgtgcataatggaatattgcaattccccccttaatagtagtgctactggttcctgtgaaatagcaggcatctgttgctctgcagtttgagcctgtatgtaaaggctaatgttttcagagtaagtgactgattatagtgggatgaagttagtcaggaaaggatctctgaagataaatgagtgcctttgcctaatcccaaggtaatgaagctggattgggtaaaaagtgaaatagggtatttcagtttgaggaaataacctgaataaaagcacagaggagcaagttagagacatatattatgactcctttcagttgcaagtgaataaatttattagctcaatattgaaaatctctaatgggtagtctggaatcaggacttgtatttagacatgattgtcaagaatctctctct

SEQ ID NO: 20433 - DNA, 137 bp, Homo sapiens
ttgcagagcatggttgagtggtctggggctgcccctacttacagggtggaagctttaccctgtgttgagaatactaggccctgattgcccctatccctggctcacatgtagggtggaggtttcataacaggagagac

SEQ ID NO: 20434 - DNA, 236 bp, Homo sapiens
tgttccatgtgggggcaaccaagaccagtggattcagtgtggagcagctctattcctaaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgc

SEQ ID NO: 20435 - DNA, 312 bp, Homo sapiens
  misc_feature 279: v=a or c or g
  misc_feature 280: y=c or t
gtcatgctatggacaaagggtagatttagtaggtgtaggaggaagaaaagaacagtatttgtgattcagaaaaaaaaatttagagtttgaaagttctcaggtagatctttccagattataattaggttaactatgtatattaaagtagaatagaggtaaattacagatgaaagactcttgaaggagcatggtagaacttgtggtgaataatgacaaatgggagctcaaatgattattccctactttctggcttggtaagactggtcgcgtagaagtacvytggtagaaatgtagtttagcagagtgaactat

SEQ ID NO: 20436 - DNA, 294 bp, Homo sapiens
  misc_feature 2: b=c or g or t
  misc_feature 66: n=a, g, c or t
  misc_feature 88: n=a, g, c or t
  misc_feature 110: n=a, g, c or t
tbgcccacctgcctctattaataatctcatcaaatctgtacactgcagtatcagtcacttcatcangtgggtgacagggaataaactnctcccaggatgcaccgcatttncccatattcatcctgaagcagaacctacctgggacatgtacgaatatctattcatgtcaaattaaatgatctgctcatccattttaattcctaatacgtattcactagaagataagttcccctccccgccacacacacacacacacacacacacacacacacacacacacacacacacacacac

SEQ ID NO: 20437 - DNA, 206 bp, Homo sapiens
  misc_feature 156: w=a or t
tgatccccagtgtaatagtgttgaggggtggtggggagggaagggtagtcatttaggcagatggaaaaacaagttcaaagacacaatgaaatagcatgacatgaacagggaacttcaagtggttcagtattgaaatagagtagaattttgaaagawaaaactagaaagatgaggctgtaaaaatgaggctgagaggtagcaggagg

SEQ ID NO: 20438 - DNA, 106 bp, Homo sapiens
  misc_feature 56: s=g or c
agattccggctggcggccggctggggcacgggggatcctgcagatggaagacggasccccgcgggacccggtgcccccgtccccgcctgccggcccccaccgaaga

SEQ ID NO: 20439 - DNA, 339 bp, Homo sapiens
  misc_feature 300: w=a or t
tggagcaggtggcatttgagttgggcctgttgccatgaggggtgtttggggaggtggacaaggctcttcaggcagagagcagcctgagctgtgggatatgctctgagaacagggaatggcctatctcagctgaagaggaagaagcatggggctgaagagatgagaaaggcagaaagggattctgtagtcggagtatgaaggtcttgattgaggaatttgtatgtgatctggcaggcaccggggagctagttgcagcgtgagagaggaagtgggaggggagggagagggtgagtttggtgwactcacccctggaaggaggctgggctgaggctgggggaa

SEQ ID NO: 20440 - DNA, 153 bp, Homo sapiens
aagccatgttgttgttttttccaacttttattttagatatacaaggggtacatgtgcaggtttcttacatgggtatattgccctcaggtagtgagcatagtacccagtaggtagtttttgacccattcctctttccctacctcccccctcaag

SEQ ID NO: 20441 - DNA, 135 bp, Homo sapiens
tcttgctgtcgcccaggctggagtacagtggcctgatctcggctcactacaagctctgcctctcgggttcacgccattctccctcctcagcctcccaagtagctgggactacaggcacctgccaccacacccgga

SEQ ID NO: 20442 - DNA, 107 bp, Homo sapiens
tgcactggcacacactcacagctctgaccatgtcatcaaacatacagagactgggcttccctctgctttttcttttttttctttttctttttttttttttttttttt

SEQ ID NO: 20443 - DNA, 131 bp, Homo sapiens
atcctggagctggaggagctcctgcgggcagggaagtcttcttgcagccgtgtggacgaagtttggcccaaccttttcataggagatgcggccacggcaaacaaccgctttgagctgtggaagctgggcat

SEQ ID NO: 20444 - DNA, 161 bp, Homo sapiens
tgtagtgatatgtagtcccagctgctactggggaggctgaagcaggaggattgattgagcccaggagtttgaggctgcagtgagccttaatggcaccatcacactccagcctgggcaacagagtgagaccctgtttcaaaaaaacaaagcagggccggggc

SEQ ID NO: 20445 - DNA, 176 bp, Homo sapiens
  misc_feature 141: m=a or c
aactaacatttactgagctgtgatttgttttagtcactatgttaagctgtatatatttctgcctaactatttcaatctctgtaataagttttacaataatactgtaaagtatattttaattctgctattttataacatagmagacagagtattagtgaggccaatacatgtcaaat

SEQ ID NO: 20446 - DNA, 143 bp, Homo sapiens
caggaaaaaacaaattctacaaagaatttgaaagatattatttcaggccaggtgtggtggctcatgcctgtaatcccagcactttgggaggctgaggcggatggatcatttggggtcaggagttcaagaccagatgggccaac

SEQ ID NO: 20447 - DNA, 164 bp, Homo sapiens
cttgtcaaaagtcacacagtaaaccacaacgattcacatgtagtgctaaaatttttaagtgaccctgcctgccactgtgatttttcccatcactttatctgtccagaccctcctccaatcctgcagagcctccctgtgaatatgagaaacccatcccccgccct

SEQ ID NO: 20448 - DNA, 136 bp, Homo sapiens
gaaggcggcggcctcggatggactgaaccactgtgaaagcccgaatggggggaaacaggcagtgacggccgctagggaaggactgggggtaagcgattaaagaaacttccatacatttttgtatcgcgccaggcaa

SEQ ID NO: 20449 - DNA, 251 bp, Homo sapiens
tacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatttattttcacttgtttactaattatttacaaaacacccaa

SEQ ID NO: 20450 - DNA, 147 bp, Homo sapiens
  misc_feature 17: v=a or c or g
  misc_feature 55: r=a or g
  misc_feature 98: r=a or g
  misc_feature 99: s=g or c
accctgacctgaaagavatgacagatgccaccaatgaggaggaaacagaaataaragaagacactaaggtccccagtcccaagcggaagttggaagarscagttctggagttcaggcctccccgaggagcaatcactcaaccacttc

SEQ ID NO: 20451 - DNA, 143 bp, Homo sapiens
ttatttttttatttttttatttttggagacaggatcttgctatgttgcccaggctgatctccaactactggtctcaagcaattttcctcctaggcctctaaaagcactgggattatgagtgtgacccattgcacctggcccta

SEQ ID NO: 20452 - DNA, 224 bp, Homo sapiens
  misc_feature 49: m=a or c
  misc_feature 140: r=a or g
  misc_feature 141: s=g or c
  misc_feature 196: r=a or g
  misc_feature 197: m=a or c
  misc_feature 204: r=a or g
  misc_feature 218: r=a or g
  misc_feature 219: m=a or c
  misc_feature 224: r=a or g
agaccagaggggaccgagccgggaaggcgagacagggacaggcgagagmacgctgctcccaactcgcagagggagaaagcgtgtatcccggggtgccggggagagtggaaaggcaaggactggtgaggggtttctgcgcrstcccggggaaccacggctggatgggggtggcggggagaccgggcacccatgggarmggggaarcggggaggcggcgrmgtgar

SEQ ID NO: 20453 - DNA, 302 bp, Homo sapiens
  misc_feature 187: s=g or c
  misc_feature 188: d=a or g or t
tccttgttgtgcccatataacataaaaggtgagtacctggctggacttccttcctgtggcgttgaggaaatatatgtagctggccaatggctcataccctgaggttgctacatttccttcttgaacataagttagcatccttgccctctcccaaattttatccttgccttgtgctatcttaaccccsdatcttccaggtaaatattatttttttttgtatattttacgttacttacatttctatttgatgatattctcacatgaaaaaatgtgtggtccttgtggttccccacccccgcctt

SEQ ID NO: 20454 - DNA, 279 bp, Homo sapiens
  misc_feature 235: y=c or t
tcaggatgccaatcccctgtgcagctgaaaaatctgcatttaacttttgagtcccccgaagtttaactattaatggccaactgttgaccggaagttttaccgataacataaacagtcaattaacacttgctttgtctgttatatgtattataactgtattcttacaataaggtaagctaaagaaaggaaaatgtcattaagaaaatcataaggaagagaaaatatatttactatytattaagtagaagtgaatcatcataaggagaggcaggagaggca

SEQ ID NO: 20455 - DNA, 73 bp, Homo sapiens
catcttctggagctagttacagcatatatcacccattctcatctttggaatactttctacacttttttttttt

SEQ ID NO: 20456 - DNA, 158 bp, Homo sapiens
agggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagccaga

SEQ ID NO: 20457 - DNA, 137 bp, Homo sapiens
attttatacggactggcggcgagagcagctgcagttcgcatctcaggcagtacctagaggagctgccggtgcctcctcagaacatctcctgatcgctacccaggaccaggcaccaaggacagggagtcccaggcggc

SEQ ID NO: 20458 - DNA, 211 bp, Homo sapiens
tggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcaca

SEQ ID NO: 20459 - DNA, 61 bp, Homo sapiens
tttgacttcttgaagcatcggtttgatggcaggatctccatcactcgtgtgacggcagtcc

SEQ ID NO: 20460 - DNA, 168 bp, Homo sapiens
caagaattttttttttttccttgagatggagtctcgctctgtcacccaggctggagtgcagtggtgtgatctcggctcactgcaacctctgcctcccgggttcaagctattctcctgcctcagcctccctagtagctgggactacaggcacatgccaccacgccgcac

SEQ ID NO: 20461 - DNA, 169 bp, Homo sapiens
tagctactacgttgaggtttctaccaaccagcaacagtggaccatggttgctgacagaactaaagtctcctgcaagtaagttgtgtcttttcaggaatttattcctattgaaaagacagtcttcccagtggattgggaggctcaaaagaaaattcatagaatcgccatc

SEQ ID NO: 20462 - DNA, 263 bp, Homo sapiens
  misc_feature 18: y=c or t
  misc_feature 20: h=a or c or t
aatctctccttttccttychtaatatggcgatgagctcttaggccagtgtggggaccggggctgaggtgccctggacactggaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctcc

SEQ ID NO: 20463 - DNA, 71 bp, Homo sapiens
aaagatgttttctatagattttttagatagatactttcaatcagattaagaaagttcccttgtatttcttt

SEQ ID NO: 20464 - DNA, 281 bp, Homo sapiens
  misc_feature 47: s=g or c
  misc_feature 48: s=g or c
taaattgctcctaattccaggggctgtaatttctccaactctattgssttactgtaatcagtttgttaacattctcaaattttttccatttgaaaacaccccagaaaatgaaatgcgtggagtagggatgagggtgagaagtcaggatgattaacaaaattgctagggtggggattaggatggagggtgaaggtggaagtgagggtagggtaaactttgaagggggcctggggctaatttcagatcacagcttttagctgttggtctgttttgccattttt

SEQ ID NO: 20465 - DNA, 242 bp, Homo sapiens
  misc_feature 237: k=g or t
aaattattggctgataattgttttgtttaaggaagctacagataggaccccaattccttctagcttgtagggtttctgctgagaaatctgctgttaatctgataagtttttctttataggttacctgatgctttttcctcacatctcttaagattctttccttcatcttgacttgagataatcatgttggcacatagtcatcaggttatctcaagtcaagatgaaggaaagaatctkaagag

SEQ ID NO: 20466 - DNA, 258 bp, Homo sapiens
gacatctttgctgaactctctccgttccaccttgtggtggaggcctccagtccaccaaacacagccctaggcgtgtgaaccctgccacaaacatcggtgctcttcctgcacagggcctgggaccaaccgtggccaggacatcagctgctggaagccgagagagttcatctgagtggcgattttatgatctgcagagtggaaagtaatcataatcccttgagaagtttgcagaatcgaaccgaatgttgaatgccaaag

SEQ ID NO: 20467 - DNA, 162 bp, Homo sapiens
  misc_feature 2: s=g or c
  misc_feature 31: k=g or t
cstagcctactgtagcttcataatatatttkgaaatcagacatgaatgaacatggagggcattatagggaaataagcctgtcacagagggacaaataatgcctaaattcaactcatatgaaggatgtataatgggcaaactcatagaagcaggccaagcctg

SEQ ID NO: 20468 - DNA, 168 bp, Homo sapiens
ccatgctatttctcctcagggtctgcttcagaaataacaagaaacagcagaaaaacttttaagaaagtagtattgatctgtttacaataatcttatgagaaactttacaccacagatcaactatgtttgcatttacaagaatcgggggtttctgcagacaaggcagct

SEQ ID NO: 20469 - DNA, 202 bp, Homo sapiens
ccaagttctaaaatggccctgctcccagaaggacacgggtcccagtttccataaattttcattgttatgttggggttgacggtgcatcttaacagccactcaccctccagcctctgagctctgagcaccccctcaggtatggggacctcttgcctgtccccagcttgagccccagccgccagtctccatactagaaagccct

SEQ ID NO: 20470 - DNA, 365 bp, Homo sapiens
  misc_feature 224: k=g or t
  misc_feature 230: k=g or t
  misc_feature 334: m=a or c
agaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccattcctgagtagctgggattacaggcatgcaccaccatgcctggttaattttktttatktttagtagagacagggtttctccatgttggccaggctgggtctcgaactcctgacctccagtgatctgcctgtcttggtgttccaaagtgctaggattacaggmatgagccaccacgcccaaccagcttgatagt

SEQ ID NO: 20471 - DNA, 156 bp, Homo sapiens
tgcaggttagttacatatgtatacatgtgccatgctggtgcgctgcaccactaatgtgtcatctagcattaggtatatctcccaatgctgcccctctccagctctcccagacccccccaggaccccacacagggagctagggtgccccctctccag

SEQ ID NO: 20472 - DNA, 172 bp, Homo sapiens
  misc_feature 37: k=g or t
  misc_feature 110: w=a or t
taaggtattgtttcactgtagctgctttcagattttktttctttgtttttagtttttggaagtttgaccgtgatgtgtcttggtgtggatttctttggatttattttgtwtagataaaccaagtttattagcttttttattacataggttcatgtctttagactattccttt

SEQ ID NO: 20473 - DNA, 259 bp, Homo sapiens
  misc_feature 220: m=a or c
  misc_feature 224: s=g or c
atttgctcctctattctaattttctttctcattcaattaggctaaaaaaaaccctcacttttaacactgttaacaacagctcctaatgaaagcagcagccaataattacataaatcatttattggagagctattttagattcctcatttaatgaatgttgcagaatttagctggtttcagattcatcagaataggagcttggcaaagtcatgaagatagmgcgsccctccccgcacactctgtttcgctggtgactgtc

SEQ ID NO: 20474 - DNA, 205 bp, Homo sapiens
caatggggttattgtcttgaattatttctcagatattccattatctgtatgtagaaacactactgatttctgtatgttgattttgtatcctgtaactttactgaatttatgagatctaatagttttttgatggagtctttctagatacaggatcatatcatcagcaaaaagggacaatttgagttcctctttgccagttgggttg

SEQ ID NO: 20475 - DNA, 271 bp, Homo sapiens
  misc_feature 261: s=g or c
agagtctcgctctgtcacccaggctggagtgcagtggtgcgatcttggctcactgcaagctccacctcccaggttcacaccattctcctgcctcagcctcccgagtagctgggactacaggcgcccgccaccacgcccggctaattttttgtatttttagtagagatgggttttcaccgtgttagtcagggtggtctcgatctcctgacctcgtgatctgcccgcctcggcctcccaaagtgctgggattacaggcgtgascacggcgccc

SEQ ID NO: 20476 - DNA, 113 bp, Homo sapiens
tatctttacttttttatcttttctgttttacatgagatgtgtatttaaataaccagacactgggccgggcgcggtggctcacgcctgtaatcccagcactttgggaggccctc

SEQ ID NO: 20477 - DNA, 339 bp, Homo sapiens
  misc_feature 254: r=a or g
  misc_feature 266: s=g or c
  misc_feature 291: m=a or c
catggaaggttcaggagtagcagaaggtgagatgagaggtgggggagggggaaaccttcttggtttgggattttaccatgagaggaaagctgggggaaatttaagcaacagaaagcaaggcaggccagctttgcatttagagttcatgctgctagctgtgtggctatgaagacagtagactgggaaggaataaaatgcttccccctatgtgtgcacacatgagtagaaacatggcatgcatgtacaaaagggarggttcccttcgstccttcccttgtttgtgccccccamcggtccttatcctagaccagttttaatttttattgcacatcagaatca

SEQ ID NO: 20478 - DNA, 73 bp, Homo sapiens
tcctgaattaacaaaagtgctatcacttttattgggtatgtaattttgtgaatcattcacctttttttttttt

SEQ ID NO: 20479 - DNA, 166 bp, Homo sapiens
tttagtttggtatttgatgttctattaaaaaaactatttccaggcttgagccagtttagagacctataacaccttgaatgaaggggagactgagtcttccttaagaacttcagaaaactatctaaaatctatactgtatctttcagccttcaccatagggacatcc

SEQ ID NO: 20480 - DNA, 151 bp, Homo sapiens
  misc_feature 65: k=g or t
tactcttcaagcctgcggtgatagccgactcaggctcctatttctgcactgccaagggccaggtkggctctgagcagcacagcgacattgtgaagtttgtggtcaaagactcctcaaagctactcaagaccaagactgaggcacctactcc

SEQ ID NO: 20481 - DNA, 85 bp, Homo sapiens
gcagctataaccccaatcagttttagaacactttcatcacccccaaaaaaaccctgtacccattagcagtgcactcccccatctg

SEQ ID NO: 20482 - DNA, 86 bp, Homo sapiens
gtctctggctgcagttggagctctgcgtctcgtcttcgttcttctgtgtcctctgctgctagaggtccagcctctgtggctctgtg

SEQ ID NO: 20483 - DNA, 224 bp, Homo sapiens
  misc_feature 2: h=a or c or t
  misc_feature 120: v=a or c or g
  misc_feature 160: m=a or c
  misc_feature 223: m=a or c
thagaaaaccaaacaaaaatgttaagcatctaaggacaaggtaaggagggtcactggggcccaagagtctggggaccagcttggctcaggctgagctgaaagaggccaaacaggccctcvtccctcccggctccaccccgcaagcaccatcccctccggmtaagcaggcgcaagggaggcccagcgcggacatcccctgctggccggacacccgactccagtmc

SEQ ID NO: 20484 - DNA, 148 bp, Homo sapiens
acgccattctcctgcctcagcctcccaagtagctgggactacaggcgcccgccactacgcccggctaattttttgtatttttagtagagacggggtttcaccgttttagccgggatggtctcgatctcctgacctcgtgatccgcccc

SEQ ID NO: 20485 - DNA, 263 bp, Homo sapiens
  misc_feature 76: k=g or t
aataatacaaagtaaacaagcaggcatataagaagaggatctgccagtcctggaggtgggagggaaattagtggtkatggtgagtgaagtatcccttaggataatgatgtttaaactgaaatcttaaaaatagagtcattaaccagatgggtgagatagaaaaagggagaaaatatttaagacagagagatcggtgtgtatttaatttctgaatttaaatgttcattattaatattaaagccactatacagtagtcccctcgt

SEQ ID NO: 20486 - DNA, 123 bp, Homo sapiens
atagaaaccggtgcagcactcaaaggagtgcaaatccagggtgagacctggggaaacgggacttccagtcagatcagtgaagtcattctctgtaaaagaagccccgaagtgtgtaaaagggct

SEQ ID NO: 20487 - DNA, 249 bp, Homo sapiens
taacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgac

SEQ ID NO: 20488 - DNA, 190 bp, Homo sapiens
  misc_feature 53: k=g or t
actaggatggatgacggcctgtccaggggctgaatggacacaggtgtcagcakggccacctggtaaaggtatggaggtgagccatgaacaaggttacctgcttaaggggaaggttgtggcttaaatctagatgctgctgagatattagacattaggtgcccacaggctgtgtggaggtagaaggggatca

SEQ ID NO: 20489 - DNA, 158 bp, Homo sapiens
acctccaaaatgaatcttatatttttttcattaagaagttttgtcataagtgtgaaaatattttcttttcctgtacatgcaatcctctcttttgatttctaaaggctttatatctaaaattaaatcctagctaatgttgagacttctaagctaatttt

SEQ ID NO: 20490 - DNA, 318 bp, Homo sapiens
tattaataggttgttaaatagcttgtcagtttcactgacacttttttcctatgtaaaaagttacttctagaataccactgggcattgtaatgtacacataattctgtcattatatctcacttatattacccttcaaaataagatgtgtatttaatgttcaaatagatcctgaggaaagaaacatacattaatgtctccatcacgttaggaaccaaatcattaccttttgagtcattgtcttagtatctgctggtgaaaatgtcactaccatgagcattatacttttgcataagaagtcacatttatggccggacgcgg

SEQ ID NO: 20491 - DNA, 152 bp, Homo sapiens
acctttcccggggccagctaattcctggagatggtaaccacttgcctgcaagtgtgccttccatattggaaaccagccaatccaaggtccacacccccacctgtctctatgacagaggatgaaactccgggcctctgccctaactaccccct

SEQ ID NO: 20492 - DNA, 278 bp, Homo sapiens
  misc_feature 52: r=a or g
  misc_feature 160: m=a or c
  misc_feature 197: s=g or c
  misc_feature 224: m=a or c
  misc_feature 242: w=a or t
  misc_feature 246: w=a or t
  misc_feature 248: k=g or t
ctctgccccactccattaactctaacaacattgactttctgtggttccttgractcaaactcattttcatctcaggggcttggctaccttctttattttgcttaggatgctcttcctagacctttgcacatctgtctcttctcattattcagatgtctgmttgaatgtcacctgcttatcaaggacttccttgctastctgtctacagtacaagtacatctccmccactcaaatcactttgwtctwtkcttagcacttatcattgtaagtatccccct

SEQ ID NO: 20493 - DNA, 315 bp, Homo sapiens
  misc_feature 293: r=a or g
cagtttagttttcctcctagttttctactcattattaggtattagcaaatagactcttttttcttgctgtcgaatagtctaatctagtctaatatacaatttattttcttactaagttttaaggttttacccttccagtacctcctgctattccccgacccaggccagttctgtcctgtactgtggaagagaccagcaagtttattctttttttctcaaccatctctctcttacaaactagctgctacttctggatcttccagattcagacccaatggtgagggaggaaacargaaataatatagatagaaaccg

SEQ ID NO: 20494 - DNA, 164 bp, Homo sapiens
ggagattctcctgcctcagccacttgagtagctgggactacaggtgtgcgccaccacgtccagctaatattttttgtattttttagtagagatggagtctcaccatgttggctaggatggtctcgatctcttgaccttgttatccctccacctcggccccccag

SEQ ID NO: 20495 - DNA, 186 bp, Homo sapiens
tattcttgctggctaatgtgctgatagccaggtctgaaacttgatgtgctatccagacacatatgatcagaaaagatctagagtgcaaagaggtgtctgaggagcaaaatgtggttttaatgttgtggaaagatcacttgcaagtatataagactgtataaagaagaggactgtgtgcaagtgggg

SEQ ID NO: 20496 - DNA, 254 bp, Homo sapiens
  misc_feature 217: s=g or c
  misc_feature 228: s=g or c
gagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttcsttcagcgggasaatgccagcacgctcaaggggctgca

SEQ ID NO: 20497 - DNA, 87 bp, Homo sapiens
tcagggaccgggacccgggactgagtgcttctgtggctctggtcctttcctccctgagtggagctcttttttttttttttttttttt

SEQ ID NO: 20498 - DNA, 140 bp, Homo sapiens
actcagggcagagcctggctgctgggcagaagggcacttgggccgggctgcttcagccgagagggccattcggtgtcctgcccacagagagagaaacagtgagagaccaagagagcaaaccagagagatagggaggggaa

SEQ ID NO: 20499 - DNA, 203 bp, Homo sapiens
  misc_feature 64: k=g or t
  misc_feature 66: k=g or t
  misc_feature 67: w=a or t
ctggtaccggttgtgcctttccatgtttagtgcttccttcaggagctcttttagggcaggcctkgkwggtgacaaaatctctcagcatttgcttgtcagtaaagtattttatttctccttcacttatgaagcttagtttggctggatatgaaattctgggttgaaaattcttttctttaagaatgttgaatattggcccccac

SEQ ID NO: 20500 - DNA, 271 bp, Homo sapiens
tttttgagatgaagtgtcgctttgtcactgaggctggagtgcagtggcacgatctcagctcactgcaacttccgcctcccaggttcaagcgcttctgccccagcctcctgagtagctgggactacaggcgcctgccaccacgccgggctaattttttgtatttttagtagagacagggtttcactgtgttagccagaatggtctccatctcctgacctcgtgatccacccgcatcagcctcccaaagtactgggattataagcgtgaggcc

SEQ ID NO: 20501 - DNA, 326 bp, Homo sapiens
gttacctcactggactacagagccacagaagattctcaacctacagtgctattttaaaaacaaattacaaaacacaaaacaaaataaaatcaaaccatactctagttgattttcatttaaataccctctaacctttaaattttccttcctatgaatcatctttgtttcccaagtttcagtcagtgaagtaatgagctagtaagattctgatatacaactgactccttaaaaaacttagaagttcagagctacatgaagtaacttattggaaatgaacaatttcatagcttggctttatgatgcaaggaatcagcattaggctgcca

SEQ ID NO: 20502 - DNA, 114 bp, Homo sapiens
agggtcctctgcctaggaaaaccagagacctttgttcacttgtttatctgctgaccttccctcccactattgtcctatgaccctgccaaatccccctctgcgagaaacacccct

SEQ ID NO: 20503 - DNA, 141 bp, Homo sapiens
gagatgaaactattggtgacacagtgggtgtagcagacacagccctgctcagtgggagttatggccagaaaaagagattgggtggagtttagaattggggcagaatgggactgagatcttgctgagaaggtatccaggaag

SEQ ID NO: 20504 - DNA, 372 bp, Homo sapiens
tgacagtactgactagattgagatgatgactaattttgtagagttccactataattaatgcaagttaggtggaacttttcttaaagagagcaatttgaaagatcatctttccttcatagtctatttcctcaggcagaatgtaggtctgtgtgtgtatcctgagagctgggctgtttacaggcagtggaggcagccaggctgtacctggactgaaacacctcatggtgaagcacttcccttggattaagctctatttagtcagctgctcgtgccataatggcaataggattatcagctaagtgagggaaaggctcatgggctgggatatggccatccagggggagcctgaataacagtctatcagaggggcat

SEQ ID NO: 20505 - DNA, 357 bp, Homo sapiens
  misc_feature 308: r=a or g
  misc_feature 336: w=a or t
ttaggtgggattataggcaccctccaccatgtacagttaattttttgtatgttttgtagagacggggtttcaccatgttgaccaggctggtctcaaattcctgacctcaaatgatctgactgcctcagcctcccaaagtgccaggattacaggtgtgggccatcgagcctggcctccaccaatgcatttctgccacatagtcattttcattagttgagtgggcaattttcttaagccactttaccttctgtattagttttctagggctgccataaagtaccacaaactgggtggcttatacaacatarattaatttccttacagttctggaagctwaaagtccaagatcaaggtgtt

SEQ ID NO: 20506 - DNA, 184 bp, Homo sapiens
attgtaagagaaaattaaaggtggtttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctccttctg

SEQ ID NO: 20507 - DNA, 130 bp, Homo sapiens
cctcctgagtagctgggactacagatgcctgccaccacgcctggctaattttttctattttttagtagagacagggtttcaccatgttagccaggatggttttgatctgacctcgtgatccacccgccca

SEQ ID NO: 20508 - DNA, 199 bp, Homo sapiens
ctcctgcattcgtccaattcttctgcctcagcctcccaagtagctgggattacaggcacccatcaccatgcctggctaatttttgtatttttagtagggacgagatttcgccatgttggccaggctggtcttgaactcctgacttccggtgatctacctgccttgacctcccaaagtgctgggagccatcacaccccgg

SEQ ID NO: 20509 - DNA, 343 bp, Homo sapiens
  misc_feature 259: r=a or g
  misc_feature 286: m=a or c
  misc_feature 311: r=a or g
  misc_feature 325: n=a, g, c or t
caagtagttgaagacataaagatatgacaaaactggcacatgtgcccgtgcaagtgtggcatagatttgatcctgagggcatgtttagaaaatagttcccagcgctaggaagatttaaaactcttataataagagttataatagtaataagaacctgcttattgctcccttgtttgctacctgtacttcttcaaatgataaaaagcttcatcactaccttagttgaccaaaatgtttcagcacaagtgtactgtatgartcactattgatctgtcttgcaagaagmcatgggtagtgaaaatgaaagtgaractcccactattgngtgaatgtctcaaaggga

SEQ ID NO: 20510 - DNA, 207 bp, Homo sapiens
cattcttcagttacttcaggccatctggatttatacgtacaggtttgggcccagaggcctgacaggaagggcagtaggagaggtggtcgtagatgatgggccagagggcgcagggcctagcaggccatggaaaggactctaggttttacgctaggtaaaatgaggaggcactgcagggctttgagcagcagagtaacacagtctaac

SEQ ID NO: 20511 - DNA, 138 bp, Homo sapiens
  misc_feature 110: s=g or c
cccagctactttttgtatttttagtagagatggggtttcaccatgttggccaggatggtcttgatctcttgacgttgtgatccgcccgccttggcctcccaaagtgctgsgattacaggtatgagccaccgcgccacc

SEQ ID NO: 20512 - DNA, 202 bp, Homo sapiens
ctggtaccggttgtgcctttccatgtttagtgcttccttcaggagctcttttagggcaggcctggtagtgacaaaatctctcagcatttgcttgtcagtaaagtattttatttctccttcacttatgaagcttagtttggctggatatgaaattctgggttgaaaattcttttctttaagaatgttgaatattggcccccac

SEQ ID NO: 20513 - DNA, 270 bp, Homo sapiens
acaactgcccaggactgctcctgagcagccgctgggagacagacggcaaccaggttgcccctctttgctccagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccgcccaccca

SEQ ID NO: 20514 - DNA, 234 bp, Homo sapiens
atttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagat

SEQ ID NO: 20515 - DNA, 138 bp, Homo sapiens
  misc_feature 97: s=g or c
  misc_feature 100: y=c or t
  misc_feature 101: k=g or t
  misc_feature 112: s=g or c
  misc_feature 113: k=g or t
  misc_feature 131: s=g or c
  misc_feature 132: s=g or c
tatatacctaggatagttggctcttctcgttgcattgatccctttacattatgtaatgcccctctttgtctcttctaatctttgttggtttaaagtstgykttatcagagaskagagactaggattccaassccccca

SEQ ID NO: 20516 - DNA, 88 bp, Homo sapiens
tctgtgcaattaaaatctacgccttaagcatttcagcgatgtggtttatttatagagttgtcttccggttcacgtgtactgggtccgc

SEQ ID NO: 20517 - DNA, 163 bp, Homo sapiens
ggagattctcctgcctcagccacttgagtagctgggactacaggtgtgcgccaccacgtccagctaatattttttgtattttttagtagagatggagtctcaccatgttggctaggatggtctcgatctcttgaccttgttatccctccacctcggcccccca

SEQ ID NO: 20518 - DNA, 144 bp, Homo sapiens
agaaaatggccatactgccaaaagcaatctacaaattcagtgcaattcctatcaaaataccaccatcattcttcacagaactagagaaaaacagtcctaaaattcatatggaatgaaaaaagagcctgcatagccaaagcgcct

SEQ ID NO: 20519 - DNA, 343 bp, Homo sapiens
ttcttctacatacagctacccaactagcccacaccatttattgaatacagagtagtcttttccctgttggttatttttcttaactttgttaaagatcagatatctgtaggtgtgcagctttatttctgggttttctgttccgttccattggtctatgtgtctgtttttgtaccagtaccatgctgttctggcaccagtaccatgctattttggttaccatctccatctgagaccacttcagcctggactttattgtccatatcactatcagtattttggtcagagccattcaataagtctctaggaagttccaaactaccatgtcattttttttctataaaac

SEQ ID NO: 20520 - DNA, 338 bp, Homo sapiens
gtttgaatattttgctcttataaataatgttgcattggataaccttgaatacataggtttatacatttgcaaacagccttgcaaggtaaattcctagaaattgtcttgctagggtgggtgtgatagctcatgtttgtaatcccggcactttgggaggccgaggcgggaggatcacttgggctcagcagtttgagaccagcatgagcaacatatgaaaccctgtgtttacaaaaaatacaagaattagctgggtgtggtggtgtgcacctgtagtcccagctactcgggaggatcgtttgaacctgggaggttgagggtacagtgagcctgggcaacga

SEQ ID NO: 20521 - DNA, 110 bp, Homo sapiens
acggaccagaacctcccgacgcggccaggccccggcacacccagctgcagaaaggagagaaaatcccttggctctaaaatgacatctggagaagtgaagacaagcctcaa

SEQ ID NO: 20522 - DNA, 274 bp, Homo sapiens
agttccttgctgcctcgccccgcggcctctaggagacaggggccacggggagagcacagccactcggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttccccgccacca

SEQ ID NO: 20523 - DNA, 279 bp, Homo sapiens
tttcagtatcctctccttaaactatctgtctaaactgttacttgccacagcactgagctcaaagcactcaaagaaaatattgtcattatccagttaggctttaagattcttccaatcctgcccatttttttttattttctttattatacttaaagttctgggatacatgtgcagaacatgcaggtttgttaaataggtataaacatgccatggttgtttgctgcacccatcaacttgtcatctacattaggtatttctcctaatgctatccctcccctc

SEQ ID NO: 20524 - DNA, 210 bp, Homo sapiens
ccctgagatattggaatggtgggctcttttgcatgacacaggtctctgatcaaatgtcaactctacagagaggctttccttaaccactctaaagtaatccccccacttcagcaatcctatctccttatcctgctgtactttcttaatagtagttattactacataaaatattttcacatgactatttgttaacgattgactcctacccac

SEQ ID NO: 20525 - DNA, 135 bp, Homo sapiens
gtatgggtaggggaagtgtgataaaaataatatagctagactttgtcttgggattatgttctagaactgcaacccatatgaaaggccactattttgaaacccacctcaaagttcaagagtactaacaggaccgta

SEQ ID NO: 20526 - DNA, 125 bp, Homo sapiens
atgaatccaggcttggtggctcatagctgtaatcccagtgctttggggaggccaaggcaaaaggattgcttcaggccgggagttcaagaccaggctaggcaataaattgaaaccccgtctctgct

SEQ ID NO: 20527 - DNA, 248 bp, Homo sapiens
attagctgggtatttcaggggctacggcaccctaggctttccggagcggctgtgctcctttatgtatgcgcgactcccactaggctatgagctacaggagggagggtaggtcttgctcccggagagcaccttaatcacaggcgctgaatgaaagaatgaactggttgtgcaggaaccaggatccgaacccgcctccccagccggaagaattaacctcgagtctgcacgcttttaagaacaaggcccag

SEQ ID NO: 20528 - DNA, 308 bp, Homo sapiens
  misc_feature 53: r=a or g
tacattcccaacagcagtgtatgaggattccaatttctccacatccttgccarcacatgttactctttgactttttgattttggacatctctgtggatgtgaagccgtgtcttcctgtggtttcgatttgcatttccctgatggctcatgatgttgaaaatcttttcacgtgcttggccatttgtataacttctctggaaaaatacctattcagataccttgcccattttccaattgggttgtctttttgttactgagttgtaactgttctttacatattctagatacaaggcccttatcatatatat

SEQ ID NO: 20529 - DNA, 290 bp, Homo sapiens
tacattcccaacagcagtgtatgaggattccaatttctccacatccttgccaacacatgttactctttgactttttgattttggacatctctgtggatgtgaagccgtgtcttcctgtggtttcgatttgcatttccctgatggctcatgatgttgaaaatcttttcacgtgcttggccatttgtataacttctctggaaaaatacctattcagataccttgcccattttccaattgggttgtctttttgttactgagttgtaactgttctttacatattctagatacaa

SEQ ID NO: 20530 - DNA, 218 bp, Homo sapiens
acccgcattcaacgccccgggctcagccgcggctgcgcccggaatccggggcctctccttcgtgaccccggagtgggcaagtgacgagggcacggccagaaacgcattggcgtcaaggaaaccacgacccatcttcctggaaggaaacttggggacacttatgaagagaagactaggaaggaccggagtagaagcactaaaggaggtagaggcaacac

SEQ ID NO: 20531 - DNA, 123 bp, Homo sapiens
catggtgaatgagagtttctgccaaaatcaaggatgatttttcagaaattttttttggctttggcaactagacgatggtggtgccacttgtgtagatatctaggcaaggtaggagaccagaat

SEQ ID NO: 20532 - DNA, 147 bp, Homo sapiens
ttgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctcatca

SEQ ID NO: 20533 - DNA, 199 bp, Homo sapiens
ttttacacttagagccactctcagttcagactagctatgtatggctggcagctgccccactggacagggcagggccagaccttcttgctaaattgctctgctgggagtgaaccgagatcacgccactgcactccggcctgggtgacagagcgagactctgtctcaaaaataaaataaataaattgctctgctgggtgga

SEQ ID NO: 20534 - DNA, 221 bp, Homo sapiens
  misc_feature 214: m=a or c
gagtcttgctctgttgctcaggctgtggtgcagtggcgcgatcttggctcactgcaacctctgcctcccgggttcaagcagttctcctgcctcagcctcccgagtagctgggagtacaggtgcgcaccaccatccccagctactcgggaggctgaggcaggagaatggcgtgaacccggaaggcagagcttgcagtgagccgagatcgcgccamtgcactg

SEQ ID NO: 20535 - DNA, 237 bp, Homo sapiens
aaaaaagaagaagaatgattggatgacagacaatttaggattatgcttgctttctcatcacaatcaatgtggacgattgagggggccttgaaaattagatggatgagaatgtcgctattcttttatgaagataactaatatttttacatagatgaaggtttatccactttacatgagtatgaagagcaacccaaaaaatcacctaaagcagacttttctactttgaagcagcgttta

SEQ ID NO: 20536 - DNA, 85 bp, Homo sapiens
ttggaataatttcagaaggaatggtaccagctcctccttgtactgctagaggcaataatttttaatactcaggattccctgctct

SEQ ID NO: 20537 - DNA, 392 bp, Homo sapiens
  misc_feature 57: s=g or c
  misc_feature 58: n=a, g, c or t
  misc_feature 316: n=a, g, c or t
tgcccagacagggccaccagagggctccttggtctagcggtaacgccagtgtctggsnagacacccgttgccaagcggaccgtggtctagcggtaacgaaaagtgtcaagaaacaccacccgctacttagcagaccggaaaagggagtctccctttccccaggggagtttagagaagactgtactcctccacctcttgtggaggacctgacatcagtcaggctcgcccgcagttatccggaggcctaaccgtctccctgtgatgctgtgcttcagtggtcacgctcctactccgccttcatgttccatcctgtatntcctggctctgcttctagatagcagtagcaaaattagtgaaagtactaaaagtctctaataagcagaaataatggc

SEQ ID NO: 20538 - DNA, 215 bp, Homo sapiens
ttggtggagacggggtttctctatgttggttaggctggtctcgagctcctgacctcaggtgatctaccttcctcagcctcttaaagtgctgggatcacaggcatgagccattgctcctggcctaatttttgtatttttagtagagagggggtttcactatattggccaggctggtctcgaattcctgacctcaagttatctgcctgcctcggcat

SEQ ID NO: 20539 - DNA, 164 bp, Homo sapiens
acttctgggtggaggcctcaggactggttgagtggagagtcaagggtccaggtagggccatccagttgtcagaaatgcaaaactctgaaaagacatcttaaaaggcctgtcaggcccaaaaccctaaattcttttttatctttttttttttttttttttttttt

SEQ ID NO: 20540 - DNA, 210 bp, Homo sapiens
attcatttatcagatctgtgttattgggagaagtcccactcaattttctgttttgcctataactagtgtagatggaaaactttctgtctgtaatcacttcgtgtttttatcattatttcaggaaaagtctgatcagtgagaaatgattttttttgtttactgccttctcagattgggctcttgattattttaaactttaaggaacagctt

SEQ ID NO: 20541 - DNA, 136 bp, Homo sapiens
aggaatattgttatgttttaatttcatcctgtcattatgatgttagctggttattttgcttgttaattgatgcggtttcttcatagtttcgatggtctttaccatttggcatgtttttgcagtggctggtaccgta

SEQ ID NO: 20542 - DNA, 140 bp, Homo sapiens
gctcatctcatctccaccactatcagccttctgttctcaaaaatagttagaggtacatttggcaatttctttctctttcttcccaacaaagttttgtagtttcttctgttcctaatttgccacttgcaactcccctggcg

SEQ ID NO: 20543 - DNA, 83 bp, Homo sapiens
ataagatgggaaggcttaatggtttgcccaaggtcatcttattagtaaatggcagaaccatgattcttttttttttttttttt

SEQ ID NO: 20544 - DNA, 344 bp, Homo sapiens
tctgcctcccaggttcaaaaaattctcgtgcctcagcctcccaggtagctgggattacaggtgtgagtcccgtgcctggctaattattttgtatttttagtagagatggggtttcaccaggttggccaggctgttctcgaactcccgggctcaagtgacccgcccgcctcagcctcccaaagtgctgggattacaggagtgagccatgtcttgctttaaataaacgcccggccttgtcatgtttaaataaactttaggctgctgggcactggtttatgcctataatcccaacattttggaaggccgaggcaggaggattgctcgaggccaggagtttgagagca

SEQ ID NO: 20545 - DNA, 86 bp, Homo sapiens
tggttaaaaatttcctccattttattgaatttatacctttgttaaaaatcattttgaaataggaaaatttcctgatccccctccgc

SEQ ID NO: 20546 - DNA, 236 bp, Homo sapiens
tcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggaaga

SEQ ID NO: 20547 - DNA, 160 bp, Homo sapiens
tgatgcaaaaaagtgtttaattttcatgaggtccaatatatctattttttcttttgttgcctgtgccttgggtgttatattcaagaaatcattgacaaatccaatgatatgctcttctacactcttaaaaattatagacaaccccaaataactaagaatt

SEQ ID NO: 20548 - DNA, 329 bp, Homo sapiens
tacatttatagttttaaatttttgtgtaggcattatattagctgcatctcacaaattatgtagtatttttgttattcagttcaaaacattttctaatttctcttttgattcctgctttgacacaggggttctatagaagtatattctttaatttctaaatgtatgctacaaagaagggcattattggtagctgacagttaagagaaacatatgggggttctggaatcattcagtgaattgctgtggggaggaattaggtgatgggtcctgaagactctcttctactaaggcatataaagtttgtcctgtcaatactggagagcagtgat

SEQ ID NO: 20549 - DNA, 209 bp, Homo sapiens
tgactaatgattttgagcatcttttcatgtgtttattttccctttgtacatcatctttaaagaaatgaagtgtctattcaagtcccagctacttgggaggctgaggtaggagaatcacttgaatccaggaggcagaggttgcagtgagccaagattgcaccactgcactctagcctgggtgacagagttagactctgttccccccacat

SEQ ID NO: 20550 - DNA, 337 bp, Homo sapiens
atattgtccccaaaaaaactctgtcttgaaaagaccaataacgctttatgtagcacatactttaacgcagaaataattacttacctctcataccaaagaaacaacaacaacaaaatcttcaattaggttaatattgaaaatagaaaagtgatagcttgactaaaaatttcctacttaatttcttcctcaaaaccccaaagtaataaatgctatcttatacactgagcaggactctaaggtagaaatcgccaacagataacaccctattggtagtttcccgtatgatgtagaaacacggttttcaacaaaaggaaaggaaaaatggttcaatatagaa

SEQ ID NO: 20551 - DNA, 389 bp, Homo sapiens
atgagaaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagatggaaacagaaatgtgaggaaacgcatgctgagcttgaggcctcccagaaggaggccgttcctt

SEQ ID NO: 20552 - DNA, 135 bp, Homo sapiens
gcatagttttcaaaacgtagaaaacatgtctaaaaaaaaatctgcatatgaatgccaaactctcatttgctgtagcaccattgaaaagtcaaccctcaggccaggcatggtggctcatgcctgtaatcccagcat

SEQ ID NO: 20553 - DNA, 184 bp, Homo sapiens
  misc_feature 182: k=g or t
cttacaaaccagtatgcatcccctacatacatgttctttccccattttaaaatgtaaatagtagcacactgtacctactgctctgtatcttttttctattaaatagtatatactaaagatttttccataacaagactatgagaacttctttagcccttggaaatgtggcttatataattttktt

SEQ ID NO: 20554 - DNA, 130 bp, Homo sapiens
gttcaataaaattgaacatcaatatctaaagatttttaaaggtttatttttaagttttacagtaaaacttctgctactcaaaagattaaaggttaaacttcaattctctttttttttttttttttttttt

SEQ ID NO: 20555 - DNA, 95 bp, Homo sapiens
cacacccaggagtccagaccccagctcctcctctctcacacccaggagtccagacccaggagtccaggcccccagcccctcctccctcacaccca

SEQ ID NO: 20556 - DNA, 259 bp, Homo sapiens
  misc_feature 51: d=a or g or t
tgtagaagtaaaggattatgagccattattcccaaggtcaaaatatttgcdacttccccagttactcttgcagatagcatcactattgtagaacttaagattggtcttttggatgtccttccagacgtttgcatttctgatgaccaatagctccactcagactcttaacaggtcctgtggcccccacccagaagcagagtcagggtaaaaggaccgatttccatgcccctatgactgcatccatagccagtcagcagca

SEQ ID NO: 20557 - DNA, 84 bp, Homo sapiens
gtatttgaacagaagcaatgaccatccctaaattttatatcagtttcttctttgttttcttttcttttcttttttttttttttt

SEQ ID NO: 20558 - DNA, 306 bp, Homo sapiens
  misc_feature 200: r=a or g
  misc_feature 234: r=a or g
acatatactttaacacaggtatgtccctattgtgagacacggcatttttcatagtataaaggtggaaagcgaacttcatgttataataaaaaataaagtaaattttatacaaacactaagaagtgatcatctaaatctacagtttagaatctgaaacctattcctatgttgacatcttccatggccctactccttaattrataaattctgacttacagaaggctattttctgartcctttcatagctgacattgtggtgggtgctgttagccatcccttgatactgacagcacaatggccatccct

SEQ ID NO: 20559 - DNA, 246 bp, Homo sapiens
tcttctcagtttttcttggttaatgtagctggcagtctaccaattttatttatcttttcaaagcaataatttctcattttgttgatcttttatatatatatttttggtcacaattctgtttagttctgtactgatatttgtaattttttttttcttctgctacctttgggtttggtttcttcttgcttttctggttccttaaggtacaatgttaagttgttaatttgagttttttttttttttttt

SEQ ID NO: 20560 - DNA, 318 bp, Homo sapiens
tgataatagctaactgccggagcacagaaggagagcaagactaattctgtctgggtgagctggtagggaaaggcttctcttccatcagcagttatcaagatgttctgaactcaagatttgctgatttggggaaaggaaaacctgaatgaataggggtccaactggtcctttcagcacaagcacagaaacaaaaattatatggcaggctgggcacagtggctcacacctgtaatcccagcactttgaaaggctgaggtgggcgggatcacctgaggtcacgagttcgagaccagcctggccaacgtggcgaaaccccaa

SEQ ID NO: 20561 - DNA, 241 bp, Homo sapiens
ttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctctca

SEQ ID NO: 20562 - DNA, 237 bp, Homo sapiens
gtaggccgaggcagacagatcacttgagatcaggattttgagaccagcctggccaacacagtgaaatcctgcctctactaaaaatacaaaaattagccagatgtagtggtgcgtgcctgtagtcccagctacttaggaggctgaggcacaagaattttgcttgaacctgggaggtgaaggttgcagtgacccgagatcacgttgcactctagccttggcgatggagccagactccac

SEQ ID NO: 20563 - DNA, 287 bp, Homo sapiens
tctcctgcctcagcctccccagtagctgggattacaggcacacgccaccacacccagctaatttttgtatctttagtacagacggggtttcggcatgttggtcaggctggtcttgaacttgtgaccttgtgatccgcccaccttggcctcccaaagtgctgggtttacaggcgtgagccaccgcgtctggcccctggctagtctcaaacacctgagctcaagtaatctgcctgctttggcctcccaaaatgttgagactacaagcataagccaccacacccggccaa

SEQ ID NO: 20564 - DNA, 319 bp, Homo sapiens
ttcccttccactgcttcatgatcttttctgtaaatgaagaactttttttggtggggcgtggtggttcacgcctgtagtcccatcactttgggaggccgaggcgggcggatcgcctgaggtcaggagtttgagaccggcctggccaacatggagaaaccctgtctctacttaagatgcaaaattagctgggtgtggtggtgcatgcctgtggtcccggctactcagagggctggggcaggagagtcacttgagcccgggaggtggaggttgcggtgagccgagatcacaggcctgcacccaccacccccaagaagcctgc

SEQ ID NO: 20565 - DNA, 339 bp, Homo sapiens
taggctatttcttaattttccttctaggattcttatagtttgaagttttacatttagatcgtcaatccatcttgagttcatttttgtatatgatgaaaagtaggggtctgattttattcttctgcataagaccagttatcccagaaccgtttgttgaataggaagttcttttctcattgcttgtttgtggggactttgtcaaagatcaaatagttataggtgtgtggctgtatttcagggtttctttattccatttcactgatctatgggtctgtttttgtgctgctctttactgatattctgtctggttgttctaatcataactgaactgggctatgg

SEQ ID NO: 20566 - DNA, 277 bp, Homo sapiens
  misc_feature 151: h=a or c or t
  misc_feature 152: b=c or g or t
tgacctttttcttgcggcgacggaccagtaagggaaaatcaccccaagtgagcatgcgcacaaccttagtaaacacactgcgcatgcggcccctcccaagtgctggcaggccattgcgcatgcagggagggcgcagagcccaccgaaggghbgaatcaaggaggagaagaaaccccagaaccaagccagtgtataaaagccccgagccaaaggttgagcggggcacttgatctctcagttgtactttgcttctttcaataaacctttgcctctgctc

SEQ ID NO: 20567 - DNA, 60 bp, Homo sapiens
  misc_feature 4: r=a or g
  misc_feature 18: y=c or t
  misc_feature 19: y=c or t
tggrgtacatgtagtatyytgatagaagcatacaatgtgtgatgatcaaatcagggccct

SEQ ID NO: 20568 - DNA, 305 bp, Homo sapiens
tcgagaccagcctggccaacatggtgaaaccctgtctgtactaaaaatacaaaaattagccaggcccgctggtgcccacctgtaatcccagctacttgggaggctgaggcaggagaatcacttgagcccaggaggcggaggttgcagtgagctgaaatcacgccactgcactccagcctgggcgacagagtgagactccgtctcaaaaaaaagaaaaccaggaagttaacattgataaactactactaactaatctacggacattcaaattttgccagttttcccgatgatgtcctttgtctggt

SEQ ID NO: 20569 - DNA, 240 bp, Homo sapiens
aacaagatggcagtgagataccacaatgcaggcaaggaagacgggatgggccccaatcgggaagcacgcgccaccagctctggagagaaccgtctgaggagacgcgggggagagtttgggtcacaggagcaggaaggaactggcaggtgtctgtcaccttatcatcccggacaccatgtttacattgtaattggcttctttacagagagggagggaccaggttcccagtgtgagtgatgt

SEQ ID NO: 20570 - DNA, 128 bp, Homo sapiens
aaagaactaaaaatatctagcaaaagactagaacagctggaaaaagaaaataaatcattagagcaagagacttctcaactggaaaaggataagaaacaattggagaaggaaaataagagactccgacc

SEQ ID NO: 20571 - DNA, 79 bp, Homo sapiens
ctcctctgtttatcttaggctatctcagatgagaggtgattttttttctttttgcataaattagactcctttttttttt

SEQ ID NO: 20572 - DNA, 331 bp, Homo sapiens
  misc_feature 210: s=g or c
cccaaaaagtgatgtagccctgggtctacgctttgagtactctatcacctgcatcacttttaccaacccacaatatgcagagaatggtgaagtaatattgttaagaacatcactaatcaaattagaccatccagttcaaatcctggctgtgccacttaggggctgtgtgaccttgggcaagtgacttaacctctctgggcttcactttcstgatctgcaaaatgaacctgataataacacctaccttttaaagttattgtaaagtgttaggcacagagcaggtgctacatatgctagccacctgatacggtttggatttgtgtccccacct

SEQ ID NO: 20573 - DNA, 241 bp, Homo sapiens
aatttttttgtatttttagtagagatggggtttcaccgtgttagccaggatggtctcgatctcctgaccttgtgatccacctgcctcggcctcccaaagtgctgggattacaggggtgagccaccgtgcccggcctggcaccattctttaagaaagaagtacaagggaatattagatttttattgtgtggtttcacatcagtgtaattagaatataggaaatttgtttaaaataataggcc

SEQ ID NO: 20574 - DNA, 289 bp, Homo sapiens
  misc_feature 247: s=g or c
  misc_feature 248: s=g or c
gaatgagattgccgggtcagatggtaattctatgtttaattaattgaggagctgccaaaatgtttttgtgggtaagttgtcagtaactcctttcctgctcaatccactccatagaatcccccttccctttgaagactcaagggcaggacctggaaattggcgaaaaaaaaaactaagatttgccctgattttttgtgaggaacccttggattttgccctaatagttctgcttttgggtgggaaagasscagattatgccaatctgtatgtggttcaggttcccattgca

SEQ ID NO: 20575 - DNA, 275 bp, Homo sapiens
agaaaacattgagagccttgtttacatagttaagttaacaaaatggaggaagttttgtttacagtaatttcacttgattatttgacctctcttgaggtataagccaaaaataaatatctaacaacaaaattttaaatgatctattaattgaaacttaaattatcattcaactccacagaaagtaaaaagctggcaaaataatccattacctacttattcagtctttggctatacaatttctgagaattatgcctgcagataaaccaagtgtttat

SEQ ID NO: 20576 - DNA, 173 bp, Homo sapiens
gagttgtttttgttttgaagacaaaacattggacttgcagcctacagaaagtgatcaagaatcccacaatgtccaggttcatggagttcaatgttgggaatgacaccagagtagttacaatccttgaggggccaggagagattttctgccttccaccctgtactctgttccca

SEQ ID NO: 20577 - DNA, 148 bp, Homo sapiens
  misc_feature 18: s=g or c
  misc_feature 19: v=a or c or g
  misc_feature 40: m=a or c
  misc_feature 41: m=a or c
  misc_feature 50: r=a or g
  misc_feature 51: w=a or t
ctgggaagtttttaaaasvatggaaaataaacctaaaggmmattaaagarwacaaaatgataagatcggaaattaggaaatctaaaatgtctcagtccattagagcaaatctcatgtcccccacctccccctctccactccccactgc

SEQ ID NO: 20578 - DNA, 167 bp, Homo sapiens
acctcccaggttcacgccattctcctgcctcagcctcacgagtagctgggactacaggcgcccgccactacgcctggctaatttttttgtatttttagtagagacagggcttcaccatgttagccaggatggtctcgatctcgtgacctcatgatccacccggcctt

SEQ ID NO: 20579 - DNA, 90 bp, Homo sapiens
gaggttgcagtgagccgagatcgtgccactgcactccagcctggggcgacagagcgagactctgtctccaaaaaaaaaaaaaaaaaaaaa

SEQ ID NO: 20580 - DNA, 256 bp, Homo sapiens
  misc_feature 136: b=c or g or t
  misc_feature 166: w=a or t
atatctatctatttgaggaaactgaggacctcggaatctctagcaagggctcaacttcgaaaatggcaacaacagagatgcaaaaagctaaaaagacaccccccccctttaaatggttttctttttgaggcaagtbggatgaacagagaagggaagagaggaagawcgagaggaagagaagggaaggaagtgtttgtgtagaagagagagaaagacgaatagagttaggaaaaggaagacaagcaggtgggcggtg

SEQ ID NO: 20581 - DNA, 347 bp, Homo sapiens
  misc_feature 269: w=a or t
  misc_feature 270: r=a or g
  misc_feature 337: w=a or t
tggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaawraacaaatctcttctgctgtccttttgcatttggagacagctttatttcaccatatccaaggagtatwactagtgctg

SEQ ID NO: 20582 - DNA, 329 bp, Homo sapiens
  misc_feature 199: r=a or g
  misc_feature 200: r=a or g
  misc_feature 229: k=g or t
  misc_feature 236: r=a or g
tctcttgctatctagagcttcatctcaccacccaacccttatctatcacaagtctgggttgcaacgcgcaggcaagcaaggaagaaaatgccagcccagagaaacatttgctccaacaagtgagcaaaggagaatgcaaattccttctcaggaacttgcttccacaggcaaatatctacacctgcactgactggttatrracatgctaattccccgggtgatttcaatkcattgartcctgggcttggctctctctgcctacttagtcctcaagtgtctccagagtcagtggttcccccacaattggatgtttcacaaatctgcagttt

SEQ ID NO: 20583 - DNA, 322 bp, Homo sapiens
tcagatagtgaacagtgccatcaggataaggtaagagtggttggaggaggggagggggtagtcagaaaatatatgtttattaacccattctcacgctgctgataaagacatacccgagactgggtaatttataaaggaaaggggcttaattgattcatagttcagcatggctggggagacctcaggaaacttacaatcatggtggagggggaagcaaacccttccttcttcacattgtggcaggaagagaagtgagtgctgagcgaagggggaagccccttagaaaaccatcagatctcctgaaaactcacgcactatcact

SEQ ID NO: 20584 - DNA, 341 bp, Homo sapiens
tttggtaatttataagatattaatctcaaagataaaaaaaatgttcttagaagtgtttttaagagactgggtctcactctgttgcccgggctggagtgcagtggcacaatcatagttcactacagcctcaaactcctgggcttaagcaatgctcccgcctaagcctcctgagttgttgggactacaggcttgagccacagcctttagtagcaaaacaaattggaaaccacatgatggattatttatgtaactttaagtgacaaatatatggctaatgattctttttttttgagacagagttttgcacttgttgcccaggctggagtgcaatggctcgatct

SEQ ID NO: 20585 - DNA, 118 bp, Homo sapiens
gaagtgtttatcttgtccaaattgcattgcaaactctttgaaatgttggtctctcttctgtagtgctgagcataatagatacacagtgaatgttgaatgttgaataaatgaaaagata

SEQ ID NO: 20586 - DNA, 93 bp, Homo sapiens
tgaggatgctctccggactctcattgatcagcataaagtgagtaatatataaatgctatgtaaagctaaattagaaaatcaaagcagggaagc

SEQ ID NO: 20587 - DNA, 267 bp, Homo sapiens
aggattggcaagaggttataatgctgagatttctctatgtttcacagtttgacggtctctgtaccagggatggaaaaagccttacaccagtacacgttggagccttcagaaaaaccgtttgacatgaaatcaattcctcttgctatggctcctgtctttgaacagaaagcaggttcactctattcgtttttctgtgtataagtagttttgcaaaactaaaaaatattagcatattttctctaatactcatttaattgtcactctttt

SEQ ID NO: 20588 - DNA, 154 bp, Homo sapiens
atttaggtaaaaggatacttctctcatgaactgttttctggacttagtgttccagcaaatctaccttttatggaacctgtcattcggccttaagatcattctcatatttgtcttttccttctaatgtcgccctcgctaccctagtcccagcaca

SEQ ID NO: 20589 - DNA, 174 bp, Homo sapiens
  misc_feature 60: m=a or c
  misc_feature 68: m=a or c
acaagaaggtatatttcttttttttttaattttttttttatactttaagttttagggtamatgtgcamattgtgcaggttagttacatatgtatacatgtgccatgctggtgcgctgcacccactaactcgtcatctagcattaggtgtatctcccaatgctatccctcccccc

SEQ ID NO: 20590 - DNA, 106 bp, Homo sapiens
gtactttgaagcattaatattaggtgtatatacatttatgattattatgtcctcttgatgaattggtgattttacctttatgaaatgtcccttagtaatctttttt

SEQ ID NO: 20591 - DNA, 192 bp, Homo sapiens
  misc_feature 7: n=a, g, c or t
gtttgcnttgtttaatataagaatgctttgggctgtaatcccagcactttgggaggctgaggcgggccgaacacctgaggttgggagttggagaccagcctgaccaacatggagaaaccccgtctctactaaaagtacaaaattagctgggcatggtgatgcatgcctgtaatcccaactactcgggaggct

SEQ ID NO: 20592 - DNA, 181 bp, Homo sapiens
  misc_feature 47: r=a or g
agtgttacttgagagaggttttagttcagacagctcgatcgtttaaragagcaatactgcttgaacccttaaaagagcaatactgtttgaacccgggaggtggaggttgcagtgagccgagatcatgccactgcactcgcctggcgacagagcaagactccgtctcaaaaaaaaaaaaaaa

SEQ ID NO: 20593 - DNA, 175 bp, Homo sapiens
ttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaaat

SEQ ID NO: 20594 - DNA, 238 bp, Homo sapiens
  misc_feature 216: r=a or g
tagtagaagctacatcaaccaaccagactgcattcctgctgtcatggtgcagtcagccaaaaaaacaaaacaaaaaggcaaaaatcaaaacaaccccaaattcagcaagggctataaggaggggaggagacagggtggtcagtaggtataaaatcagtaagcatatggtcaaactcaacactaccatcaatcaactggatatcattaacatctacrgacaatgttatccaccagcacc

SEQ ID NO: 20595 - DNA, 153 bp, Homo sapiens
cacatgtaacaatgatccagcaggaattaggatattgatgggagaggcacagataatgtgctgtgggcattcaggggaagaagcagcgcacatttatttactgtaggggattcaggaaagagttttgggggattaaatgattatgctgggcac

SEQ ID NO: 20596 - DNA, 402 bp, Homo sapiens
catttctacgtacttgcactgaggggaatgttggctcataactgggtacgtggctgagcccaagagatacccgacagcaccccaccaggaggaagcagaagccagggatctgggagggtaacagccatttgtgaagaaggaacttagccatggatgataccatttcatatctttcagaactttcatacacattgttggcccccctgtgaaggagggagccatttttaaaaactagggctctgaggttttttgggaataagttcccagatgttttccaggtcctgagcagccctggccttcaggctccccgaggctgccagttcagtcaacttcatgctgccttcactacctggctccaggtcctacaggatgaagtgccacgacagtgtgcatccccaggct

SEQ ID NO: 20597 - DNA, 360 bp, Homo sapiens
atgtagatattcccgtttccaacgaaatcctcaaagctatccaaatatcaacttgcagattctacaaaaggaatgtttccaaaatgctgtatccaaacaaaggttcaactctgtgaattgagggcatacatcacaaagaagattctgagaatgcttctgtctaaattttatatgaaaatattcccgtttccaacgaaatcctcaaagctatccaaatatccacttgcaaatgccacaaaaagtgtgtttccaaactgctctgtgaaaaggaaggttcaactcggttagttgagtacacacatcacaaagaggtttctgagaatgctgctgactagtttttatttgaagatatttcccttt

SEQ ID NO: 20598 - DNA, 357 bp, Homo sapiens
ccgaattagaacaacattttcttcagactcacccaaacaaaataaaagcttctctcccctcctctgaggttgcaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccg

SEQ ID NO: 20599 - DNA, 189 bp, Homo sapiens
  misc_feature 181: m=a or c
caaagaggagagaaagaagaaatcaaaagaccggccctcaaaattagagaagaagaatgatttaaaagaggacaaaatttcaaaagagaaggagaagatttttaaagaagaaatcaaaagaccggccctcaaaattagagaagaagaatgatttaaaagaggacaaaatttcaaaagagamggagaagc

SEQ ID NO: 20600 - DNA, 150 bp, Homo sapiens
agataaaatatcaccaagaaaaatgaacatgtgacagttttgttagaaaacagtattgttagaaaacaatacttaaaagaggcttcatctgagcttcatcagtgacaagtatttaaaaaaaaaacaaaaacaaaaacaagcagacgaatt

SEQ ID NO: 20601 - DNA, 267 bp, Homo sapiens
actgttacaggtctgagcattggcctcagaactcctctggtgctgggagtgaggagtttcaaggtgactgctttttagctccaggggagaaaggagggcacagtgcccaaggccatgccagggcaaggacgggccactggcccccgccggccgagtcaaccagaggcaaagccagattgagggttcccaggctgacaaatgtctgctgcctctgccacaggagagagaaggggaaagagggcaaaagaaacaaagacatcacgcgca

SEQ ID NO: 20602 - DNA, 324 bp, Homo sapiens
  misc_feature 81: r=a or g
  misc_feature 226: k=g or t
aaatgaaagagagaaagcaacaagggtagagaggaagagtttaacatcattgttattttcagtggtagcacagatgcagtrgagcaaaaggaaagacaaagagggaaagggttggacctaagaactattagattgctgcaaaagtaaatggggtttttgccattgaaagtaatggtaaagaccgcaattacttttgcactaaactaactgttctttgtactgttcktattctgtgtgtttggatcaaatgggtaaattttaggagttaatggcataggcaaggttttaagaagttacattcccacaaatgtcttctgtctgtct

SEQ ID NO: 20603 - DNA, 105 bp, Homo sapiens
agttctagatccctgaggaattgccacactgacttccacaatggttgaactagtttacattcccaccaacagtgtaaaagtgttcctatttctccacatccgaga

SEQ ID NO: 20604 - DNA, 168 bp, Homo sapiens
caagatattttgcagaagtcaatttcttctctcaataggtacaaaataaatacttcaaagaggtaaaagtaacttgttttcttgagtgggataaatatttcccttgggatcttgtttacaaactcaaatattttgtaagcaaataatgctaagagaaactctagccct

SEQ ID NO: 20605 - DNA, 254 bp, Homo sapiens
acaggctgttccactgtgcccaggaagcccaggagtccgagatgagcctgggcaacacagtgagactcccatctctatttttttttttaaagatggtatggtgttatgatacatattggttttcgtccacagctcctggctcatgactctcatagtccttgttagtcttttgttataatattgagtgtgttagccctcaggggcagtatctgaccttctcctgcactcctttcactctaaccttcctggacctt

SEQ ID NO: 20606 - DNA, 136 bp, Homo sapiens
tggatttgtggcccggaagcagggcagtgccacggataatgtgtgccacctgtttgcagagcatgaccctgagcagcctgccagtgccattgtcaacttcgtatcaaaggtcatgattggttccccaaagaaggcc

SEQ ID NO: 20607 - DNA, 261 bp, Homo sapiens
  misc_feature 174: k=g or t
tttttcaaattgtattttaaacacagttggtacatatgcaggttttgttgtaattggaatattgcatgatgctggaggtttggagtatggtgttatgagcatagtacccaaaaggtagtttttcaacccatgttcctccctttctcatccttctagtagtctgcagtgtttatkattctcatatttatgtccacgtgtgatcaatgttcagctcccactcaaacgatttatgtaatgaaccactgtcaaatagtggctatt

SEQ ID NO: 20608 - DNA, 184 bp, Homo sapiens
acaacataaaagatttataatttgtggttgcacctaagaaagaattttctttgagagaagaaaacaagtcatgggattggcttaacaggggattttctctatatgattaaaaataatggcttagtgtctaattggtctcagttaaaacaaagtacagaagctaaggatttttcttttttttttt

SEQ ID NO: 20609 - DNA, 93 bp, Homo sapiens
attatttaatttacttttattttgaatttttaaaagcactgtattggtatatcccacaggtactaatatgcagagcttgctcttttttttttt

SEQ ID NO: 20610 - DNA, 171 bp, Homo sapiens
ataacatattctttccacaatcatttacgttctaggcagtggggatccaaagtacaaaagagctaactttctaggtgaggagacagtaaataagtatataaagttatttcagatagtaactaatgttgtggagttagtaagaaataagcaatgaaatgagggtgacagcac

SEQ ID NO: 20611 - DNA, 139 bp, Homo sapiens
ctgttttgctaaattgtaaatagccagtagtggttttcttactataaatccagtataagtatctcttacaaaaagataatagacataaacaaaaggaaaaaattaaagaatcctatgattccattaactatagctaact

SEQ ID NO: 20612 - DNA, 156 bp, Homo sapiens
tggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcaggc

SEQ ID NO: 20613 - DNA, 129 bp, Homo sapiens
ggttagccaggcgtggtggctcatgcctgtggtcccagctgcttgggaggctgagacaggagaatcgtcagaatctgggaggtagaggtcgcagtgagccgagatcgtgccattacactccagccagat

SEQ ID NO: 20614 - DNA, 246 bp, Homo sapiens
cagataaagaacattttcaggctgggcatggtggcttatacctgtaatctcaatactttggaaggctgaggcaggaggattgcttgggcccaggagttcaagaccagcctgggcaacatagcaagaccctgtctacaaaaaattaaaaaattagctgggcctggtggtgtgcatctgtaaccccagctactttaagagactgaactgggtggattgcttgagctggggaggtcagggctgcagtga

SEQ ID NO: 20615 - DNA, 84 bp, Homo sapiens
acgtgaagcaggaataggcacgtcatatggcaagagagcaagagagaagtgtggaggtcccaaactcttttttttttttttttt

SEQ ID NO: 20616 - DNA, 174 bp, Homo sapiens
agacggggtttcaccatgttggccaggatggtctcgatcttctgacctcctgatccgcccgcctcggcctcccaaagggctgggattacgggcgtgagccaccacacccggccacctacctcttactcttagtgttgggatctctttatgtaacttgctcaaagcccaggagat

SEQ ID NO: 20617 - DNA, 54 bp, Homo sapiens
tctgtgtgtgtgtgtgtgtgtgtgtgtgtgtcttcttttttttttttttttttt

SEQ ID NO: 20618 - DNA, 241 bp, Homo sapiens
ctcaaccttaggattgcataacaacccatgaacaaataaatccccagaaacttcttttttcagaaatcagataagaagcaggacccagtagaaagaaatctgctggagtttgatccagtgtcctatctcaagattgctatcctttgcaagtgtgtcttcttcaccttcctgtgaagtcccctctactcctgaagctgtggctcagagagaacaagaccaaactccctgcacagaatgccat

SEQ ID NO: 20619 - DNA, 171 bp, Homo sapiens
  misc_feature 119: s=g or c
  misc_feature 120: s=g or c
gtgagtcgtgaacggcccgggtctccgccatggcctctctactcgccaaggacgcctacctgcagagcctggccaagaagatctgctcccattcggccccggaacagcaggcgcgcacssggctggcaaaactcaaggctcagaaactgcagggcccccaaaaaagaaacg

SEQ ID NO: 20620 - DNA, 214 bp, Homo sapiens
gtttaattggtaacattttgtctgtatgtgtccatcaatacctcactgatttgaagtttaaactttatggtgatgagatacacaaaattgggaaattttctgaatgttgtattctattacactgattatgtctattcatttccaatgccatacctctgtaattatataggttttaaaatatgttttaatatctgacagcacttacccggcttca

SEQ ID NO: 20621 - DNA, 240 bp, Homo sapiens
tttttttcctgagacagagttttgctctgtcacccgggctggagtgcaatggtgcaatctcagctcactgcaacctccacctcccaggttcaagcgattctcctgtctcagcctcccgagtagctggcatacaccaccatgcccgactaatttttgtatttttagtagagatggggttttgccatattggccaggctggtctcgaactcctgaatctcaagtgatccacccaccccggct

SEQ ID NO: 20622 - DNA, 148 bp, Homo sapiens
  misc_feature 71: r=a or g
agatttcttatcggcttccacactgcggagctgcagccctcagaagtaagcaaggtttcctgccgggagaraaggatttgaagcattccagccaaaatgacggacagaagccccttcgaaaccgacatgctcaccctgacccgcttga

SEQ ID NO: 20623 - DNA, 269 bp, Homo sapiens
  misc_feature 111: k=g or t
  misc_feature 113: k=g or t
  misc_feature 240: r=a or g
ttagttggcttacaataatgatctccagctccattcatgttgctgcaaagggcatgctttctttttgttttcagtttttatggtattccatgggtatatgtaccatatttkckttactctgtccacattaatgggcattttggtgggttccatgtctttgctattgtgaatagtgctgtaataaacatatatgtgcatgtgtctttctgggtgtattagtctgttctcacactgctataraaaactacctgaaactgggtaatttttga

SEQ ID NO: 20624 - DNA, 131 bp, Homo sapiens
ctggtttttgtgtttttggtagagacggggtttcaccatcttggccaggctggtcttgaactccagacctcgtgatccacctgcctcagcctcccaaagtgttgggattacaggcttgagccaccaggccc

SEQ ID NO: 20625 - DNA, 124 bp, Homo sapiens
aataatcaactttgcttcctgaaagtgtcaacttcgttctctgatctagtctgccttccagaatgcctgcatagttattttcttaaacattagtaatatgattgttactccttaccatctccta

SEQ ID NO: 20626 - DNA, 214 bp, Homo sapiens
  misc_feature 183: r=a or g
aaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggrcacccaagagataactacaatcacccctaag

SEQ ID NO: 20627 - DNA, 380 bp, Homo sapiens
  misc_feature 329: w=a or t
tattggttattctagttatacattagtctaaatttttttcaaagttttcaacttctttgcctttggtttgaatttcctcctgtagcttggagtagtttgatcatctgaagctttcttctctcaactcatcaaagtcattctccatccagctttgttccattgctggtgaggaactgtgttccttcggaggaggagaggtgctctgcttttttgagtttccagtttttctgctctgttttttccccatctttgtggttttatctacttttggtctttgatgctggtgatgtacagatgggtttttggtgtggatgtcctttctgtttgtwagttttccttctaacagacaggaccctcagctgcaggtctgttggagttgc

SEQ ID NO: 20628 - DNA, 143 bp, Homo sapiens
tattttctgactttttgataatagccatcttgaaaagtgtgaggtcatgtatcattgtgattacagtttgactttctctgatgattagtgatgtcgagcaccttttcaaatacctcttgactgtttatattagttagatgccc

SEQ ID NO: 20629 - DNA, 187 bp, Homo sapiens
  misc_feature 49: r=a or g
ttttcctttcgtaatttctgttttgtaatccttttctgctatatgataragtagtgccatgcctgaacacattttttcattgggttgttccagtttctcttattgatatggaaacgctttgttatatattagagatggttactgttaatttattggggatgcttcattttccccaaaatttgccttt

SEQ ID NO: 20630 - DNA, 185 bp, Homo sapiens
gcatgtgtctttagagtagcatgatttataatcttttgggtatatacccagtaatgggatcgctggttcaaatggtatttccagttctagatccttgagggatcgccacactgtctttcacaatggttgaactaatttacgctcccaccaacagtgtaaaagcattcctatttctccacatccaa

SEQ ID NO: 20631 - DNA, 146 bp, Homo sapiens
atatgaatcttaaaagagtttggaactgtgggattgattaaagttgttgagtttggagttctgtgaatgtgccttccagattgctgagattatcagcacatagtgttacagtcgtccctcagtttccaggacccctacagatgcct

SEQ ID NO: 20632 - DNA, 353 bp, Homo sapiens
ttaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagactgtgttcgtggccgacctggcctctcctggcctgtttcttaagatgcggagtcacatttcaatggtaggaaaagtggcttcgtaaaatagaagagcagtcactgtggaactaccaaatggcgagatgctcggtgcacattggggtgctttgggataaaagatttatgagccaactattctctggca

SEQ ID NO: 20633 - DNA, 141 bp, Homo sapiens
  misc_feature 122: s=g or c
cagtactttgttcttgttaatatcagtgtatcaatgagcctggttttttgccttttattattattattaacatagtgagcacaggcgtttcgtactctgcgtctgattttccagcagcgaasctctgccatccgccccagc

SEQ ID NO: 20634 - DNA, 163 bp, Homo sapiens
  misc_feature 41: n=a, g, c or t
ctgccacagtgcctgaagtcccacaagaaattgtgccaganaagaaaacactggtgcttcctaaaaagccagaagttccacctgttacagtgccagaggctcccaaagaagttgtccttgaaaagaaagtgccctcggctcctcctaaaaagcctgaagtccc

SEQ ID NO: 20635 - DNA, 320 bp, Homo sapiens
  misc_feature 44: n=a, g, c or t
  misc_feature 46: r=a or g
  misc_feature 106: s=g or c
gtgaccggagcgcggctcaggggccccagtggccgccgcggagnargttgcctggagagagcgcctgggcgcagaagggttaacgggccaccgggggctcgcagasaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctc

SEQ ID NO: 20636 - DNA, 80 bp, Homo sapiens
  misc_feature 69: y=c or t
tttttttcttttttttttccccaggttggtccgctgaggaggcggggtcgtttctgcgggattattttyccggagccagt

SEQ ID NO: 20637 - DNA, 306 bp, Homo sapiens
ttgggcagggaaaaatggatgggaatgaacttatgttctgtataggaaaatttctccaaggagcaccttgatattcactaatgccagctaaaaggcagtaaagatgagtctctgtataactaaggaaggtcattccaacttttctcttcagcaagagcatgagagcttctcttcaattcttggcaaagcccaagataaatctcttcatttactgtctcatttgggcttcatattgtcttattgaacagtggcataatacatgtcaattcacatgatttacactggaaattcattcttttatataat

SEQ ID NO: 20638 - DNA, 283 bp, Homo sapiens
gtatctattttgtgagaggaactcgtagagtaggcatagattttaactgaatgagctaaatcaaagataagtcagaagatttttggcctgagcaactaggcagctgtgatgctatttactgaaatggagaatccaaggaaggaactatttaaggggccgtggagaaaggatccaggaattgtgtcttgccttttagccaaccagtcagcttggtaaagaaggcatttagatacacgagtacagagctgaggtcaggagtggagatacataaatttggagagtc

SEQ ID NO: 20639 - DNA, 183 bp, Homo sapiens
agagttactataaatagaaaggaacgtctaggttgatacaaggtttgttggagaccaaggttttatcatgcagatgaagccttcaggtagcaggcttcagagaaaatagactgtaaatgcttcttattaagagtgtgttctatcagtaatttcaaaagggaggagaagtataatgaggcatga

SEQ ID NO: 20640 - DNA, 393 bp, Homo sapiens
  misc_feature 86: b=c or g or t
tgctacctaccgtatagcacgctgtgtgagtccaacattctgaaaagccaaaaaccctggagacagaagaaagatcaggggttgcbaggacttagggggagggagggaggaacaggcagagcacacggaggatttttccagcagggaaactcttctgtacgacactgcaaagatggatcactgtcactctatgttggtcaaaagccgcagaatacacaagtgcaagaatgaacgggccaggtctttgtcatgctgggattatggtgagagagatttgaaagcacttttagtaattgctgttccttcctgtagctgaagcttcaaggggagcaaactacttgccacacttgaggctgcatgactattcagagaagggaggagcacttctgaatt

SEQ ID NO: 20641 - DNA, 61 bp, Homo sapiens
agaagagtgaacaactttaagaagaggcaccagaatgttactttttttttttttttttttt

SEQ ID NO: 20642 - DNA, 260 bp, Homo sapiens
  misc_feature 68: k=g or t
  misc_feature 72: r=a or g
  misc_feature 236: r=a or g
  misc_feature 237: k=g or t
agaatgtatattctgtggttgttgaatgaagatctgtgcatgtctattaggtccaattggtcaattgktgartttaagtcaataatttctttgttatttctctgtcttaatgatttgtctaacattgtcagtggagtgttgatatcccccactcttattctgtagccaactctttttgtaggtctagaagtagttgttttatgaatccaggttcttcagtgctgggtgtgcatatrkttaagatagttaacacttactgt

SEQ ID NO: 20643 - DNA, 140 bp, Homo sapiens
ttaaatcaactttttgactacatataggctgggtgcggtggcgcaagcctgtaatcccagcactttgggaggccgaggctggtggatcacttgaggtcaagagttcgaaaccatcctggccaacatggcaaaaccccgat

SEQ ID NO: 20644 - DNA, 110 bp, Homo sapiens
ccctgagttttagatttggttgtttttttctgttacttgggatttattggagatcaatagtgaagagaagtgtctttattttaccagtctaacttacccttggccgaatc

SEQ ID NO: 20645 - DNA, 190 bp, Homo sapiens
caagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccgta

SEQ ID NO: 20646 - DNA, 256 bp, Homo sapiens
tgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatccgc

SEQ ID NO: 20647 - DNA, 234 bp, Homo sapiens
aggtcgggagttcgagaccagcctgaccaacatagagaaaccccgtctctactaaaaatacaaaattaagccaggcgtggtggtgcatgcctgtaatcccagctacttgggaggccgaggcaggagaatcgcttgaacccaggaggcagaggttgcggttagccaggattgcattgcactccagtctgggcaacaagaacaaaactctgtctcaaaaaaaaaaaaaaaaaaaaa

SEQ ID NO: 20648 - DNA, 151 bp, Homo sapiens
  misc_feature 73: k=g or t
tgatggtggagtttcactctcaggacatattcagaacttcccacactcttccctaaatttccctttccttttkatctctgatactcggaatagaagataagctcctttgagagcagagcatgtacttcatttactcttagattccccccct

SEQ ID NO: 20649 - DNA, 103 bp, Homo sapiens
agcacgctggcctggggcacggccgttcctcctgcccagccacgttggggtacagggtgaagaagggctggggccagcccaggacagaggaaggcgaggcaaa

SEQ ID NO: 20650 - DNA, 109 bp, Homo sapiens
tccttagagtatagttcataggccagcagcataagcctcacccagaagcttgttagagatgcagaatctcaggtcccagccagacctcctgaatcacagtagtgtgtat

SEQ ID NO: 20651 - DNA, 162 bp, Homo sapiens
ttaattcttccttcacaagcctgcctgtgactgcccaggtctgttctctgcttctaccaaggggtaggcaagactagaatctgacttgagagcagtttcagatctttgtctgtgagggatgctggggggtttctggcatggtgacttgcctcctgggaccag

SEQ ID NO: 20652 - DNA, 160 bp, Homo sapiens
tgagccaggcatggtggtacatgcctgtggtcccagctactcgagaggctgagatgggaggatccggtccgcccatgaggtcaaggttgcagtgagccatgattgtgttaccgcaccccagcctggacaacaaagcaagactctgtctcaaagcaaaaaa

SEQ ID NO: 20653 - DNA, 295 bp, Homo sapiens
  misc_feature 273: r=a or g
agaggggctacatgaaatgcagccaggccctatccctgcttgtcctcagagtgtatggtagccccacccctgttctcaggtagaagaatgagtttttcttggaaaaactgttccgttaaaatattaaatagctgggccacgcgtggtggctgacgcctgtaatcccagcattttgcgaggccaaagtgggaggattgagtgaggccaagagatggaggctgcagtgagagcctaggtgacagagtgagacactgtctctaaaataaataaatraataaataaatacccgggctca

SEQ ID NO: 20654 - DNA, 130 bp, Homo sapiens
ggctttttgtctgagggcctcattaggcccagactgctgctgctggtaccagtctcctgagacactgcctccctggagcccatgcatgcccagctgttcttactgcttagtagccttgaagcagcaccat

SEQ ID NO: 20655 - DNA, 134 bp, Homo sapiens
tactgtataagggtcagttaacgggttgggaacaatgacattgtcttggagaattggcctctgcagctgacctgcagcagtccaccaggatgcttgtttaaacagtgaacgcagaagaagtgatgaccggcttc

SEQ ID NO: 20656 - DNA, 147 bp, Homo sapiens
cccagtcccacaccgggggagataattaaaggagagcctccttatggtatcatcctctaggtccctgcttcagaactgcattctcagcaaagcaatgttgtaaccaagtccctatggcaattccagcactcagcatccccaccctga

SEQ ID NO: 20657 - DNA, 345 bp, Homo sapiens
  misc_feature 284: m=a or c
  misc_feature 303: k=g or t
cactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggmtgcagtgagctctgatggkaccactgcactccagcctgggtgacagagcgagaccctgtct

SEQ ID NO: 20658 - DNA, 223 bp, Homo sapiens
acggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtg

SEQ ID NO: 20659 - DNA, 243 bp, Homo sapiens
  misc_feature 56: k=g or t
  misc_feature 101: k=g or t
  misc_feature 176: s=g or c
  misc_feature 224: r=a or g
  misc_feature 225: k=g or t
  misc_feature 226: k=g or t
tattcagtcagatatggcaaaaagtctcaaggtgttaatgtgaatgattaaggtcktggggggggtgtcccctatcagactacaggtgtttagaggcacakaaaaaggtgcagttgggttcttaatgtgaaatgatgagaagcacaactccagtgtgtctctttgtgtagaatgtsagcagacaccccctgctagatgtgctggatcatgggaaagcatttccrkktgttactagattgttca

SEQ ID NO: 20660 - DNA, 133 bp, Homo sapiens
ttgataatatatttcacctttgccacgtctaataccagagcctacgaggaaaccattcggaagctccagaacccaggccctaatcacaacgcccctatccagcaggaagcagccagatgatcaacgacgccca

SEQ ID NO: 20661 - DNA, 215 bp, Homo sapiens
  misc_feature 14: m=a or c
  misc_feature 15: s=g or c
actgggtcagggamstggactggggagcccttgaatgctctgcctgcactgctgtgtcctctcttttgcagcctaactcactccttctgcaaagtcttcttgtgcacagcatcaagcttctagctgtgcaagaactgcttgacagagaggccttggaaaaggtaaatattttactcttccttccacattcacaaaccaagaacggagggccacac

SEQ ID NO: 20662 - DNA, 304 bp, Homo sapiens
  misc_feature 147: s=g or c
  misc_feature 163: s=g or c
  misc_feature 182: r=a or g
  misc_feature 187: r=a or g
  misc_feature 191: k=g or t
  misc_feature 216: m=a or c
  misc_feature 232: s=g or c
  misc_feature 240: r=a or g
  misc_feature 248: s=g or c
  misc_feature 262: s=g or c
  misc_feature 277: s=g or c
acaattgattacttttaaatgggttgtctttttcttagtttatgaaagcttttgtagattatatcttttaagaataacatttctgcatcataactgttaacatacacacacacacacacacacacacacacgcacgcacacactcastgttccccagtctgtsaatttgccatttgactttrcggtrtgtktttcaatctataatttgccaactamgctatcttttcctttstggttttrtgatctcstgcttaaactcctscctccccattttccstacccagatacatgacatgcagacacg

SEQ ID NO: 20663 - DNA, 143 bp, Homo sapiens
ttaagttttagggtacatgtgcacaatgtgcaggttagttacatatgtatacatgtgccatgctggtgtgctgcacccattaactcgtcatttaacattaggtatatctcctaatgctatccttctaccttccccccacccct

SEQ ID NO: 20664 - DNA, 209 bp, Homo sapiens
ggtcgcgttttggcctcagtgtgccgtgaaggagggtgttgggccgcctggagcccctccggaaaaggtggtgcaaaggatcaaggctgtggaggggcagactcggctgctggtggtggaccaggagacagatgaggagctccgccggcggcagctgacctgtaccgaggagatggcccagcgagggctcccacccgcccacgacgaga

SEQ ID NO: 20665 - DNA, 178 bp, Homo sapiens
caacaagaggatgtccgggaaattacggcttgtccggaaagcacttggtcctgatgcgttctggcagctacggaagacaggaagagagagagcagctggggaaggagaggagggacctcgtaagttaccttgcttccagttcgtcatcttccatcttccgctgctgggcctgtgctct

SEQ ID NO: 20666 - DNA, 177 bp, Homo sapiens
  misc_feature 63: d=a or g or t
cacttatcaatatatgctgaacttatttcatattagctcatagagctatcctttattctttadttacaaatgcatagcattccattgtgtgtatgcatcagaatttacttgatcaatcttttatatatagatatttaggtcacttccaatattttgcatttataaataaggctgcaa

SEQ ID NO: 20667 - DNA, 202 bp, Homo sapiens
ttactcttgtgtgcataaaactttcagattcaagaatgtaaaataatgcttttcttgattactcaagatgttcatgcaagaagaaataacggagattgaccaccaggctgaacctgaagactgtaaaagtctcacaacttaacacttttgttttacatatcttcctttatacagaaacatgcccaagatattcataacccac

SEQ ID NO: 20668 - DNA, 87 bp, Homo sapiens
  misc_feature 59: r=a or g
caacctctgccgcctgggctcaagtgatccgcctatctcagcctctgaaagtgctaggrttacaggcatgagccactgttcctggcc

SEQ ID NO: 20669 - DNA, 98 bp, Homo sapiens
tgttacatatgtatacatgtgccatgttggtgtgctgcgcccattaactcttcatttaacattaggtgtatctcctaatgctatccctcccccctcct

SEQ ID NO: 20670 - DNA, 291 bp, Homo sapiens
  misc_feature 71: r=a or g
  misc_feature 159: r=a or g
  misc_feature 248: r=a or g
cacaaataaagtctgtgaacttgaaataaccatggagaatgaaatgttctgattcaggatcatcggtgggrtttcactgggaaatctcccactgggcaagagtagatgatggaggaggagaaacagtcactagaaaaaggtgatactttgtatcaagaracaattaaagaattagatcacatcctgaaacgttaagcatatgctcctttgtgaggcttgcctggctgaacttgaactggattgagtgrataatttcttaaaaacaatcaaaatcacagatttattctattt

SEQ ID NO: 20671 - DNA, 162 bp, Homo sapiens
agtcggagctaatgaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggactat

SEQ ID NO: 20672 - DNA, 160 bp, Homo sapiens
cacggggtttcaccatgttggccaggatggtctcgatttcttgacctcgtgaactgctcgcctcagcctcccaaagtgttgggattacaggcgtgagccaccgtgtctggccccatctatcttctttggtgaagtgtctattcaaatattttgctctttt

SEQ ID NO: 20673 - DNA, 103 bp, Homo sapiens
attaactatagtcactatttagtacaatagatatagttattccttctatctaactacagttttgtattctttaacaaacatctgctcaaccaccaccccaaca

SEQ ID NO: 20674 - DNA, 294 bp, Homo sapiens
cttccattaaggagacacataggcgagcctgggccactttgttcagccaggggcccaggtcaagtctctttcaagctgtgtagtgtgactcccagtccttccccaagtgtggccttcggtggcctttgattacctgaaggactagatcagggaatatgttttagccccagttactgaagaaagcacctctgaggacacaccttcctgtggagggagggatgaggaaggggtgagtatgccctctctgtctaaggacagcaggtgcttcatgcgtacagccagccactctcactt

SEQ ID NO: 20675 - DNA, 55 bp, Homo sapiens
tcttttcctgtgaaatgccccattgagttcttcggcctattttctttttcttttt

SEQ ID NO: 20676 - DNA, 417 bp, Homo sapiens
  misc_feature 275: k=g or t
ggccaggcgtggtggctcccgcctgtaattccagcaaacccaatccattgttatggcggcttcatccactgtgtcctttcctgcctataccctctctctacctccactcccacctcagccttctccaagaaaaacaatatacgcatcatttagtcttttggattatccgtcttttgatagtagaaaactcaccagttttctgacagtggttgtcactggagagagaaaggggaatagaacagggacctgagcttttacagcccttcatatttatkaggtagagtgaatagggaggaagggataactgtcggtcagctatttgatttaacacaggcccacatgattcctttctttgttcaacaggttctggatgttcctgtggataacctcaaggagcacgggacctgggacatgact

SEQ ID NO: 20677 - DNA, 299 bp, Homo sapiens
gctttgggttttgtttgttcttgtttttcaggttccttgaggttcaacattaaattttatttgagatctttctgtcaagatgtaggcatttcacactataaactgtgtcttagtactgcttttgctgtattccagagagttggtatgttgtgtctctatttgcattcgttttgaaaatttttttgatttctgctttaatttcattgtttgtccaaagatcattcaggaacaagttgtttggttcccatgtactttgtggctttttagagttccttttggtattgactttcttctctctt

SEQ ID NO: 20678 - DNA, 268 bp, Homo sapiens
ccaggctggtctcgaactcctgacctcaggaaatctgcccgcctcagattcccaaagtgcgagattacaggcgtgagccactgcgcccagccaaataagactgttttttaacttttaagttcagagatacaagtttgtttgtttgcaggtttgttacataggttagcttgtgtcatgggggtttgttgtgcagattatttcatcacccatgtattaagcctagtactcattagttatttttcctgattctttccctcctcccacccac

SEQ ID NO: 20679 - DNA, 99 bp, Homo sapiens
atccgcgcgggagtgcgccacgcggggccggagcgcctattagccgccaggacctcggagcgccccgaccacccctgagcccctctggcttcggagcca

SEQ ID NO: 20680 - DNA, 275 bp, Homo sapiens
ccttgtgtttggagcagttctgctagaggaggaaacagcacaaagggcactcttatgctgctgtaaaccagtgccaggatttttaaaatgtgagacacctgttaccctagagtgtgaagaggaggagaaaggctgaagaggaggagaaaggctaagatcttttccaatgcaaaattaggaaaaaatatactacagatttatgaaaaaataagaagtgaaagtattctctgactgcaagtatgaccacctgtctttctatatcagaacccaagctg

SEQ ID NO: 20681 - DNA, 142 bp, Homo sapiens
tatatttgccatagacatgagaatgggaattatggtgggactgttcccagatagtatccatcctgctgtttctaggacatgtttatgcatataaattattctttatgatttttagttgagagtcttttataaggatggaagc

SEQ ID NO: 20682 - DNA, 329 bp, Homo sapiens
tgtttgatgtgtcactacactaatttctatgcatctggtggaacaattgcctctttgaattttatgaagtaggtttcatagggaaagacttattggccagagtaacagacccatggctccaaccctagtgatccagaccccaggttagctgacatgtcatgtgcatgcatgtgcccccaacttgagaggcagtccggcaagtctatacctggcaaagccatggcattaccaccacacgctctcatagcttaggccactgaaacacttgcaaaattcacgagtatggattccagttggaacaaactacatggagactacactactgcatc

SEQ ID NO: 20683 - DNA, 153 bp, Homo sapiens
  misc_feature 142: y=c or t
cataaaaaggagggcacgatctcatgcccattgtgctctgacccagataagcagcaaaacacgagcctctcggacattgggacaactaaggtctaaggcgggcctgccccaggtgaagtgcaaggcgccaccttggacactycctgctcatct

SEQ ID NO: 20684 - DNA, 185 bp, Homo sapiens
  misc_feature 101: m=a or c
cggaaagaatgctgtggcatatggaaagggaacctattttgctgtcaatgccaattattctgccaatgatacgtactccagaccagatgcaaatgggagamagcatgtgtattatgtgcgagtacttactggaatctatacacatggaaatcattcattaattgtgcctccttcaaagaaccctc

SEQ ID NO: 20685 - DNA, 115 bp, Homo sapiens
tggaagaagagtgtgatcctcagaaggttacttaattatgcatagtgttcctattgcttgctgccttatcagtgattatgttcctctgtgtactttggagtaatctaccaccaat

SEQ ID NO: 20686 - DNA, 118 bp, Homo sapiens
cagagttgcaaatatctttttcctttttttctttgcatatgttttagagattcaaatatggtgagcatattttgtttctttttgttgttgcatagtattccatagtattgtcttacca

SEQ ID NO: 20687 - DNA, 338 bp, Homo sapiens
  misc_feature 276: k=g or t
actattctggatatttcctataagttgaatcatataatatgtgaccttttatgactggcttctttcacttagcaaattttcaagtcatctgtattgagcatggatcagtgcttcatttatttacagacagggtctcactctctcacccagacttcagtgccatggtgccatcatagctcactgcagcctcaaactcgcagagtcaagtgatcctcctgtctcagcctcccaagcagctaggactgtaggcacatgtaaccatgcctggttaatttkttatttccttttttttttagagatgggttctcactatgttgcccaggctggtcttgaactcc

SEQ ID NO: 20688 - DNA, 190 bp, Homo sapiens
  misc_feature 58: v=a or c or g
agtgttttaaatgttttcaatggattgagaaaaacctcagaagaaacctttgccagavaaagttaaagtgcccgttgcttcagcccctgactctgtggtcctaaatacgcggctcctcagtggggcccacagcttaagaccaacgcttcacaggctcacagcccctgtcagaacccatctcctgccctta

SEQ ID NO: 20689 - DNA, 312 bp, Homo sapiens
  misc_feature 169: m=a or c
  misc_feature 179: y=c or t
  misc_feature 189: w=a or t
  misc_feature 236: m=a or c
  misc_feature 242: m=a or c
  misc_feature 243: y=c or t
  misc_feature 271: s=g or c
  misc_feature 292: r=a or g
caaaaattagccaggcgtggtggtacgtgcctgtaatcccagctactcaggaggctgaggcaggagaatcacttgaacccaggaggcagagggtgcagtgagccgagatcgcaccactgcactccagcgtgggtgacagagcgagactccgcctcaaaaaaaaaaacamcaaaaaaaaytgaaaaagawtggaaatcagtttcctcccagttctatctccctctttctctcctaamaaaggmytgggactccctaacagcacctgtggagsgtgacatcctgatagcccacrgggtctactttgggatccta

SEQ ID NO: 20690 - DNA, 200 bp, Homo sapiens
gcgcaatctcagctcactgcactctccacctcccaggtttaagcaattctcctgcctcagcctcctgagtagctgggattacaggcatgcaccaccacacctggctaattttgtgttaatagagacggggcttctccatgttggtcaggctggtctccaactctcgacctcaggtgatccacctacctcggcctcccacg

SEQ ID NO: 20691 - DNA, 166 bp, Homo sapiens
acaggtgtgagccactgtacctggccagtttactcactctttaatgggggaatatagacgcatataaaaatacgatgaattgagctgagcaccagtagcagttttatttagtctttatactcttgaaaaggtatttcacatttcgttagcttcccccgaccccatt

SEQ ID NO: 20692 - DNA, 154 bp, Homo sapiens
agagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgga

SEQ ID NO: 20693 - DNA, 199 bp, Homo sapiens
atcaagtaatccaccgtcagccttgcagcgtgctgggattataggtgtgagctactgcccccccggccaaccacgtttttattttaaaaagtgtctagggacagtgccagagtgattctttcagcacatttctgattagccaggtagtgaaggtatttttgtgtttcttaaaaaaaccttaacttcttgtaggaccgct

SEQ ID NO: 20694 - DNA, 160 bp, Homo sapiens
  misc_feature 81: s=g or c
tcccgaagtctccatactaagctacccatctacactctaccagccctcagcggcatccatggctgcagtggcccagcggasatgcccctgcagacaggaacagcccagatttgtgcccggcctgacccgttccagcaagctctcatcgtgtgtcccccgc

SEQ ID NO: 20695 - DNA, 130 bp, Homo sapiens
tatgtttttgagatagggtctcactctggttgcccaggctggagtgcagtggcgcaaccactgcttactgcaaccttgacctcctgggctcaagtgatccaccatcgtgcctggctgatttttttttttt

SEQ ID NO: 20696 - DNA, 103 bp, Homo sapiens
gtgagccagggaggcagagcttgcagtgagtggagatggcgccactgccctccagcctgggcgacagagcaagacttcgtctcaaaaaaaaaaaaaaaaaaaa

SEQ ID NO: 20697 - DNA, 360 bp, Homo sapiens
tattaggattcaagagtgaaagggcaggaatactgaacccagtgattggggaggccgtttggcagtagtgttcactcattcagcagatgtttattgagctcctgctaggtgccaagcactcttccgtgctgggaatataaaaagtgaaggaacaaaatccctgttctaggccgggggcgatggctgagacttgtgatcccaagcactttgggaggccaaggagggtggattgcttgagtgcaggagttcaagaccagcctgggcaacatggcgaaactctgcttctaccaaaaaatgatttcaaataaataaatcactgtcctcgtggaacttataaatatgtagtgtgtgatgatgata

SEQ ID NO: 20698 - DNA, 181 bp, Homo sapiens
gtgggtgttggtgctagcgcggcttcccggcgctcgtggaatcttctggagcccttttctccactcagcgagcctgagagtgcggaagtctccggctggtggggcatggcccaggagcactgcaatcacaccatcacgggaaactccaaggttgggaatatacctgaaaagtggaaagaat

SEQ ID NO: 20699 - DNA, 151 bp, Homo sapiens
ctgctgcagcattagattctcataggagcacgaactctattgtgaactgtgcatgctagggacctaggatgcgtgcttcttatgagaatccaactaatacctgatgatttgagatggaacagtgtcatcccaaaaccatcctccacacccc

SEQ ID NO: 20700 - DNA, 362 bp, Homo sapiens
  misc_feature 229: r=a or g
  misc_feature 297: k=g or t
gcccagctaatttttgcatttttagtagagatggggttttactgtgttggccaggctggtcttgaactccgagcctcaagtgatccaccacatcagcctcccaagtactgcgattacaggcatgagccaccgttcccagcctcaatttttattttagattcagggtgtacatgtgcaggtttgttacctgggtacattgtgtgatgccgaggttcagggcacgattgarcccatctcccaggtagtgaacatagtacctggtaggtagtttttccgtccgtgctctcctccctctckactctctctagcagccccagtgtcctatgcagcaacatggatgactggaggccattatcctaagc

SEQ ID NO: 20701 - DNA, 88 bp, Homo sapiens
agtctggtaagtggcaggtgcccagtgcagaggggctgaggcaggaaagagtcactgctctgggttcaggccattccattgctttttt

SEQ ID NO: 20702 - DNA, 232 bp, Homo sapiens
  misc_feature 104: s=g or c
cttgtaagggtccatctctttgatgacagtctctcctgggtgtgaagtggcctcttgtgctttggtacacttgcctggctcttggctcccgcccacatgcgaasgccctgtctcccctgggcagggactgggccctgtgtttcctggccctggttctctcatttccttcctcttttaatagaggaccttttgagagtgttctctttccctgaaatataaatgaagtgcagat

SEQ ID NO: 20703 - DNA, 375 bp, Homo sapiens
  misc_feature 143: r=a or g
  misc_feature 156: r=a or g
  misc_feature 242: r=a or g
  misc_feature 243: r=a or g
  misc_feature 259: r=a or g
  misc_feature 260: k=g or t
  misc_feature 290: r=a or g
  misc_feature 293: r=a or g
  misc_feature 298: r=a or g
  misc_feature 312: r=a or g
  misc_feature 326: r=a or g
  misc_feature 329: r=a or g
  misc_feature 334: d=a or g or t
  misc_feature 343: w=a or t
  misc_feature 344: r=a or g
aattggaccaaatggatataatagacctgtacagaactctccaccccaaaacaagagaatatacattcttctcatagccacgtggcacatactctaaaattaaccacacaatcagacatacgacaatccttagcaaatgcaarttaatggaactcrtaccaaacacactcttggaccatcacacagtaaaaatagacatcaagactttaaaaaattgctgaaaaccatgcaattacatgtarrttaacctgctcctgarkgacttttgggtaaataataagttaaagcartaragtaragaagttctttgaractaatgagaacaracrcacadcataccagwrtccctgggacacagctaaggcagtgttaaga

SEQ ID NO: 20704 - DNA, 253 bp, Homo sapiens
ccaggaagtaaatgatcaacagtgcggatgctgctaataagtcaaacaagacgaggacatatattgaccattgggtttacgaacaaggggtcattggtcacctcagtgagagaagtttccatagagtgttgggagaaaaaggctgaggatagtaagtttaagagagaataaaaggagaggaattgcaggcagagaatagaagcgtttttcatggagtctgtttgcaaataggaccaaagaaatgaggaggccg

SEQ ID NO: 20705 - DNA, 249 bp, Homo sapiens
agttaaagagatcaggaagttagatggactactccaattaccgtattttatagatcaggaaattaagacacccaaagttattaagtgacctattcaagaacatccttttggatagtagcacaatcaggaccagtcagaacttgaagctttgtcccagcttagttttaggcaacagaagatttgtcataaacaatctggagggcagtctatgtgaataacaggaatgcaacagataactgtagaaccatc

SEQ ID NO: 20706 - DNA, 216 bp, Homo sapiens
caaatcctaattctgtttcctgccaacatgtggccttggatatatcacttgccctttctgagcttctggagaacatcttgccttcatgatagtgttgttatgaggactaaatttaaggactaggattcttgagtgctgccctgtggttcagaatgtacctagaactctctcatttaatccttaaaccaacactgagagaggttctattgttacctt

SEQ ID NO: 20707 - DNA, 172 bp, Homo sapiens
ctagtaagtgtgtgtgtgtgtgtgtgtgtctgtgtgtctttctatgtgtaaatgtccatccccagggattaagaagtctggatttgggttaaacttaatcatttctaagaatctgaggttttcagtgcgcgcacacacacacacacacacacacacacacacacacacacac

SEQ ID NO: 20708 - DNA, 395 bp, Homo sapiens
  misc_feature 42: r=a or g
  misc_feature 43: r=a or g
  misc_feature 364: r=a or g
tttttaaccagctttatcaagatataatccacatactgtatrrttcacccaaagtgtacaactcaacggtatttaatatattcacagatatgcgctacctcacagttttagaatattttcatcatctcaaaatgaaatcctattagctatcacccctttcaatcccctctcccctcaaccctaagcaacagctaatctgctttctgtatctatagattttcctgtctggattctcatgtggatgaaatgatatgatatgtggacttctgtgcctggcttccttcacttagtgtaatattttcaaagtttatccaagttgtatacatactggtacctcattccaacagatttagcattgaatcaragatcaccttcacctatgcaagtggcctttt

SEQ ID NO: 20709 - DNA, 229 bp, Homo sapiens
taagttagtttttgagcctctttaggatgcttaattttcaagctcaaaatgtgtaaaggtcaattttaaatgattgtcatcttttgaagaaggacattggcaactgagtaaataatccacaaatcactgattagtaatgtgttgtaggatgactcctatagcagattttatttcctaactatattaccagttaacagaaattagtttgcaaaacttgaatgcaccagaa

SEQ ID NO: 20710 - DNA, 205 bp, Homo sapiens
tgcaatgtcatgtgtgttgtgtgcagtgtgcatggtgtgtgttgtgtatatgtggtgtgcctggtgtcgtgtgttttgtgtgtcgtgtgtcctgtgtgttgggttatgtgttgtgtgtggtgcatctgtgtgtgtgtgtggtgtgtctgttgtatgtgttgtgtgttgtcatgtgttgtgtcacatgggttgtgtggtgtgtcat

SEQ ID NO: 20711 - DNA, 114 bp, Homo sapiens
  misc_feature 42: k=g or t
  misc_feature 72: n=a, g, c or t
  misc_feature 74: s=g or c
  misc_feature 93: s=g or c
atgttactctttgaggagagactgaaactctgcaagtctgtkcactgagatttcctgggcacactcaaggcngsagagatgaccaagagtcasccctgccacagaagctcacgt

SEQ ID NO: 20712 - DNA, 310 bp, Homo sapiens
gcccagctaatttttgcatttttagtagagatggggttttactgtgttggccaggctggtcttgaactccgagcctcaagtgatccaccacatcagcctcccaagtactgcgattacaggcatgagccaccgttcccagcctcaatttttattttagattcagggtgtacatgtgcaggtttgttacctgggtacattgtgtgatgccgaggttcagggcacgattgaacccatctcccaggtagtgaacatagtacctggtaggtagtttttccgtccgtgctctcctccctctctactctctctagca

SEQ ID NO: 20713 - DNA, 273 bp, Homo sapiens
tattggaaggtgaaagtaatacagaaaaacaacaggagataagggagctttgggaatgtctcaagagtgtaattttacagtaagtgagtaggagagttgtaatattaaagtgggtgattaagtatcagctttattgagctgatatttgagcaaagttttaagggagttggaagttaaccatgtagttatctgggggaagaacattccaggcagaggaaacaactagtacaaagaccttatggctgaagtgtctttcatatttgaggaatagaa

SEQ ID NO: 20714 - DNA, 236 bp, Homo sapiens
tttagagacagagtattgctgtgttgttcaggctgaagtgtaggggccttatgatagctcactgcagccttgaacttctgggctcaagagatccttctgctttatcctccagagtggctaggactgcagacatgtgccactatgcccagctaatttttacatttttgtagagacatggtctcactatattgcccaggctggtctcaaactactgacttcaagtgatccccttgcag

SEQ ID NO: 20715 - DNA, 134 bp, Homo sapiens
gaatccagataatttcactatcaaagcataaatttattaaatcaaactgccatcgaataaacctgagttaaataaacttttggccattgtccttcttaaagtatgtgcaatagacattcaaagacagggaaata

SEQ ID NO: 20716 - DNA, 168 bp, Homo sapiens
tttgccttttattgtagttcaatgtttataatgccttcggtgttccttcctagtgcctgggccaagagcctggcacagaataaatgaccagtgaatgttcatataaaatctcagaggtggccatgaggccagcattcgcccagtcctgtgattctaatgtgctgaatt

SEQ ID NO: 20717 - DNA, 362 bp, Homo sapiens
agagagctttgcctcagccactcatttcaggtatcagtgtaaaccctgatttatagcccatcggttagaagcttgggaggctggactcgtgattggcatctgtattagtccattttcacactggcgataaagacatacctgagactgggcaatttacaaaagaaagaagtttaatggactcacagttctacctggctggggaggcctcacaatcatggtggaaggtgaaaggcacatctcacatggtggcagacaagataagagaacttgtgcagggaaactcccattcataaaatcatcagatctcgtgagacttattcactatcatgagaacagcacaggaaacacccacccccgcgata

SEQ ID NO: 20718 - DNA, 316 bp, Homo sapiens
tttagttaatgttatatttatataatgtatcatttataatttacttgtgcatgcatagtcaaccagattaactgccagttttctctggaacctcaacatgtagtaatcattttttatatgacatttccttcttggcctactgcacaggagtgtaggtagatattgttaacttcattttgtagaagagtacatttaagtcatagagttcctagatggccctacgggacacacttacttaaaagtagccgggtcagaatggagcatgcccagctttcctcttccatccataatgcctcttcacaggccagcacccaca

SEQ ID NO: 20719 - DNA, 222 bp, Homo sapiens
  misc_feature 26: s=g or c
tgcacgtgtctgtgaagggggcgcasacggttgaggcggatcacgaggtcaggagatcgagaccatcctggctgacacggtgaaaccctgtctctactaaaaacacaaaatattagccgggcatggtagcgggcacctgtggtcccagctactcaggaggctgaggcaggagaatggtgtgaacccagaaggtggggttgcagtgagctgagatcgcaccac

SEQ ID NO: 20720 - DNA, 122 bp, Homo sapiens
ggtatcattcccaagcctaagaaaattagcaataattctgtaatatcacctaatacccagtccttattcagatttccccaacagtttgtgttatggactgacctgtgtatgcctcgccccct

SEQ ID NO: 20721 - DNA, 191 bp, Homo sapiens
  misc_feature 27: k=g or t
caacaataagtttgatcagcacgcagktcctctccaggcaggcgcacccaggagggccaggagaagcaacactgtttagcaagggtcagcaacctctcaaggcctcaatgccacagctgcctccttaggggagggatgaaagaaggaagaggaagagagagggatagcgttctaggggtaaaagggccgat

SEQ ID NO: 20722 - DNA, 119 bp, Homo sapiens
  misc_feature 94: b=c or g or t
agacttggtacacaggatctggggagtgagaggtggcttagtgaggactgaaaataaatatgaaatcatcaactttttaaaaatgacttaagcbattttgaaataaaagaggaagcaag

SEQ ID NO: 20723 - DNA, 196 bp, Homo sapiens
tattttgctctaatggagcttattgcttttatcatgaagcaaacaggtctgtttgtattggtgggtacaggaaggccacttacaggttatcttttgggagaaagaggagactggactgttgaaaactctgacaataaatattctagttaaaaatatgggctatggcacagtggcccatgcctgtaatcctaacacc

SEQ ID NO: 20724 - DNA, 134 bp, Homo sapiens
caattaggatggcgttttagttcactgaaaaagattcctgtgggagaaacaggatccaaaagagaacagagaagtttaaaaaatatgtagtttgaatgtcagcttttaattaagctgatgaccatagagctcga

SEQ ID NO: 20725 - DNA, 344 bp, Homo sapiens
  misc_feature 174: v=a or c or g
  misc_feature 270: w=a or t
  misc_feature 271: r=a or g
  misc_feature 272: m=a or c
taacaaacagcagcatctctcaccatttgctttatgctggttgaggtacaggcctttataaaacttgcaagttgaattatcacctttgcaaacgccacaagcatctgaaactgctttagagcctagttcatgatcacatcccactagctgtgacaaaaacaaaaaacgtgagavaataaaagatcagagaagccagaggctgggaataattaagaggtatatggttctctgtatttacagaacattagggaagcagtacagcttatggtwrmaatcacagcctcaagttggactcacttggggttcaaatccctcccctgacattattagatgactgggcaagt

SEQ ID NO: 20726 - DNA, 361 bp, Homo sapiens
tagtgttgatggtctttacagtttggtatgtttttgcagttgctgggaccaattgttcctttccatgtttagtgcttccttcaggagctcttgtaagtcaggcctggtgatgacaaaatctcttagcatttgcttgtgtgtaaaggattttatttctccttcgcttatgaagcttagtttggttggatatgaaattctgggttgaaaagtcttctctttaagaatgttgaatattggtccccactcttttctggcttgtagggtttctgcagagagatctgctgttagtctgatgggcttcctcttgtgggtaacctgaccttttgtgatcctccaaaggagatctttctctctggctgcc

SEQ ID NO: 20727 - DNA, 128 bp, Homo sapiens
tatatgtaaggcaaatgcattaattggcttttgagtcagaacagtttctttacgaattacacattagctgcaattcaaattaatccatatgcctcaattttatttgagagcagaaaatgccaggccat

SEQ ID NO: 20728 - DNA, 153 bp, Homo sapiens
  misc_feature 102: s=g or c
  misc_feature 110: s=g or c
caacgtgcaggtttgttacatatgtatacatgtgccatgttggtttgctgcacccggtaactcgtcatttaacattaggtatatcaccaaatgccatacctscccactcscccgaccccacaacagtccccagagtgtgatgttccccttcca

SEQ ID NO: 20729 - DNA, 88 bp, Homo sapiens
tgtgctttgctgacttaatatagtcagagtgaggaggaaatgagacctcaaatttgatatcactgagaagcagttttttttttttttt

SEQ ID NO: 20730 - DNA, 124 bp, Homo sapiens
attttttgtagagatggggtcccactatattgtccaggctggtctcaaactcctgggcttaagtgatcctcctggcctcccaaagtcctgagattacaggtgtgagccaccgcgccggccccgc

SEQ ID NO: 20731 - DNA, 213 bp, Homo sapiens
ttactagaatgattatcttaaactgttttttctgtctcaggttctcaagcagttaccccccaagaaagatcgaattgagttgtgtgcaatgtcggagaagcaggagcaactctatttgggtcttttcaacagattgaaaaaatctatcaataacttgggtataatctgatttttactcttttatgtgaaaaagaatcttgtactggggaggca

SEQ ID NO: 20732 - DNA, 373 bp, Homo sapiens
  misc_feature 319: r=a or g
aaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacgatgaaaccacatctctactaaaartacaaaaatttactgggcatggtggtgggcgcctgtagtccccgctactcagga

SEQ ID NO: 20733 - DNA, 384 bp, Homo sapiens
  misc_feature 109: k=g or t
  misc_feature 150: d=a or g or t
  misc_feature 254: k=g or t
  misc_feature 269: k=g or t
  misc_feature 336: s=g or c
  misc_feature 337: s=g or c
  misc_feature 338: k=g or t
  misc_feature 380: w=a or t
ctgttctactcatttcgtgttcatgcttggctgagctcgtcttttacatcttctaagaagcttttctagacttcgatttttctcatttctcttatattttatttatatkgtttataggtgggtccttctattctttcaagcatgtaagtdcttgttagataatattttccattaaggtttttttctttatcttccacagtaccttatatactactttcaacaaaaattagttaatgtttgtttgcatttgagtkggaatgtcatgtgcktgatagaatgaaccttagtcttagttccttagtctaacctctggtttcttagtcttagttccttagsskaaacctctggtttgagtctcaggaatatatttacatccaggwccgg

SEQ ID NO: 20734 - DNA, 120 bp, Homo sapiens
tacaaataataagtcagtaggagagataaaacaaagtaataacaaatggtcaatggacccaagagaaggcagaaaaaggaaaaagaagcagaatagatgggtcaaatacaaaacacgacc

SEQ ID NO: 20735 - DNA, 334 bp, Homo sapiens
acccatgcagcagtagctcctatgattgaaaggggtaagtgggagctgtggcaacaccaggtccctgtgaatatcgtcattcaaaagcaaccccacaccctgtggaattacagagcagtccacgttggacttgagagatgcaagggtcatgactttcactacctccccatttaattctgcagtttgtttgatgtggaagaatgttctttgggagttacaatgtattatgataagcccaatcagctgatgattcagtcacagccactgtttcacaaacttcctcacaggactgaagatcacctgggaggcagcagttcagctgggcagtggggca

SEQ ID NO: 20736 - DNA, 112 bp, Homo sapiens
gcagtttgagagtcctgctagcataggcttcccgcttcacagattgaattccatgttccacccaggaagggaaggggccaggctccccgcaccatgaacttcccaaggcccc

SEQ ID NO: 20737 - DNA, 413 bp, Homo sapiens
taaagagagaagacaagacaactaagccttgtggaagtctcacgtgtaaagatttggcagtggtcagagaagtaggaggaaaaccaactcttggtcccctacatggtgtacgatctactatccttagcaccatgcttaaaataggaaagcattcctgaatagagatagggtacaatacagagacatttagcttttctatgaggcaccaaaacaatgtggctcagtttactcaattctgtgcacttgcgttgtcccctttctaaaggtcagtttctcagctcattgcaagttaattattttttttgaagcccaggtctacatgggggaaaaaatgaaaaaggcaatggaatgaatataagctggtgcaaagcaatggagacagctgcttggattaaccttttgcttttgtcaca

SEQ ID NO: 20738 - DNA, 295 bp, Homo sapiens
  misc_feature 243: k=g or t
attctaaatgttctcagatgactttcatttcactcacatcctgagattatgctgtggcattaatcaattactactttttataattttttttcagtagatctactagaaagaaagaaaagatctactagaagtcaagaaaatgaatgctcagttaagtgaggggagaaggaaagtatttattgttattactattttttataacgtcagagacctaatagtgaagaatgactagtcatttttgtktgattggttttttatcttatacaacctccttggtctactggaatgcaggccg

SEQ ID NO: 20739 - DNA, 324 bp, Homo sapiens
  misc_feature 73: n=a, g, c or t
  misc_feature 205: k=g or t
cctctcctgtagctttaatccaaaggccttctggacttccctggtggactgtcaccattggcaggtgacagtnacctctgcataaacattgtagggggggatctgggcacttggttcattcccctcctggccagagagcctctggatggaggcagggcatccagccccaatcagggcacgcctgccctgaagctatcaaacactkcttagtgaactggaagattcctcccagactcccgccaaaggagacagacctcaaaatgttggccacatgaaaggcttgtgtgtaaaaataattcagttcaacaaatatttccgctatat

SEQ ID NO: 20740 - DNA, 424 bp, Homo sapiens
  misc_feature 31: w=a or t
  misc_feature 32: n=a, g, c or t
agagatttgttgatacatttgctaggcacgwnttctggtcatttagaaagctattttgtggcttcatcaataaggtattccccagctgtgttactccttcgcattgttatctctttccctggaattgaaggcttcctggtctgaggcaaggacaattattccctcactgtcaaccctgatctctggctgcagtaatgagtagaggaaatgaagaaataagaatggaagcataatcatttgtccgaggtcacagagggagatgattacacagctggaataaactctcctccttcaatacctgactacttgcaccatccagcagatatcctctactaccaagtctcaacagatggttcagctggtctttaatgaacaaaaggcatttgtgtaatggactcttattgctcaagaagaattcttcctt

SEQ ID NO: 20741 - DNA, 260 bp, Homo sapiens
gtaaaaggccgcggcaggcgaagagagaagagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaatt

SEQ ID NO: 20742 - DNA, 134 bp, Homo sapiens
taaccatcttaagtgtacattggtacagtggcattggttacgttcacaatgttgtacaactgtcatccctatctatttccaaagctttttcatcacccaaacagctctatacccactaaacaacaactccaaac

SEQ ID NO: 20743 - DNA, 75 bp, Homo sapiens
aagactatactttcagggatcatttctatagtgtgttactagagaggtttctctgaacgtgtagagcgccgaatt

SEQ ID NO: 20744 - DNA, 420 bp, Homo sapiens
agagctgcgcgccgcggcggcggaagatggctgcggccgaggtggcggacactcagctgatgcttggagtcgggctgatcgctctcaccaaggaccgaggggccgtgggaaacgtctgacgcccacttcacggaggagcaaatggaggcccaggccgtcattgtgcacggacacaccataggccgtacagagccgggagtgggaccctcgcagtgtagcccagagcccccaacccccaccagtggagagctcctgcatcatgtgatcgagcttgtgcataaataaagcaggagtttctacacaatcctgtgtggtggaatctcggttagctctgaggaatgtaattatcttccataattaaaaaatatcacacggggatctttgggcagcctcgtgcagtatttaggggatggaaccgtt

SEQ ID NO: 20745 - DNA, 101 bp, Homo sapiens
agtctgctctccccgcccgcggcccgtgcagtaagactttgaccccgacgcaggcttcagtgattgccgcggatcagaagcctgagcactttggctcacac

SEQ ID NO: 20746 - DNA, 167 bp, Homo sapiens
ccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgccac

SEQ ID NO: 20747 - DNA, 387 bp, Homo sapiens
cattgtggttttgatttgcatttctctgatggccagtgatgatgagcattttttcgtgtgtctgttggctgcataaatgtcttcttttgagaagtgtctgttcatatccttcgcccactttgtgatggggttgtttgtttttttcttgtaaatttgtttgagttctttgtagattctggatattaaccctttgtcagttgagcagatcacttgaggtcagaagtttgagaccagcctggccaacgtggcaaaacaccatctttactaaaaataaaattaaaagaaaggccgggcgtggtggcttacatctgtaatcccagcactttgggaggctgaggcagggggatcacaaggtcaggagattgagaccatcctggcctacatgat

SEQ ID NO: 20748 - DNA, 80 bp, Homo sapiens
aagactatactttcagggatcatttctatagtgtgttactagagaggtttctctgaacgtgtagagcaccgaaaacccac

SEQ ID NO: 20749 - DNA, 324 bp, Homo sapiens
aagttggacaggacattccaggcaggcacttggtctagaggtgggctgatcatttctaaatggcagaaccctgacaaacgtgagactgagagtccacagaggggcacgtggggctgagctgagaggcccccagggccagcatcctggcccatgccttatggaaggccagactagaagccctgggccagccccaggaaataggaagtttccaggccgtggacctcctgtgcccctcagggtgggggccatggaagagctcctctttgttgcagggaggggaagtctgtaccccaaaaaggtcttcccataatcctggagctggga

SEQ ID NO: 20750 - DNA, 221 bp, Homo sapiens
ttgaaaatttaaaaataataccatttacaatagcattaaaatataaaattcttgggaataaacccgacaaactatgtggattatctgtacactgataactaaaaagcattgctaagaaaaattaagacctaagtaaatatcttgttgataggttgagagactcaacattgttgatgttaattctttcccatattaatctatagatataatgcagtcccccg

SEQ ID NO: 20751 - DNA, 255 bp, Homo sapiens
actttgctaacattagggcatagaaaaacagcaagataccgagagagaaaggcttcagaaattttaataacagacaaaactgcctgattaaagtactgcacaaaccaaaccaaaccaaaacaaaacatataaggggatgctgtcacttaatcccagaggagaaaaattaaacaggacagtcctttaacaatgattgataaagattaattcttaatctgatttacattttaaaacagtactataccgaaaaattaa

SEQ ID NO: 20752 - DNA, 450 bp, Homo sapiens
agggctcttataggtctgggttgaggacggttttttcacagataattttatgtccttttgctggccaaaagggatgctactatactggaataacttctaggcttggtgtttttcagccatgctggttgagtaaatttaaatcccagtttcttctaaaggagatctctggaaacaaatttttgggtttggggtgcagtagagattcctactattattattaattcatgtccttctgcagctttggtgaagaaaagtttccttgtaggcttgctctaatggctgatagattttgtttctggcctatttttcactgacaatgtagcaccttgaagagagccagatgtacctgattatctcaagtacagcttctttatttgcctaggcccaacgattaggatttcatttccaacttccaaaactctacgttactggcatgaatatcttcacact

SEQ ID NO: 20753 - DNA, 163 bp, Homo sapiens
aattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaa

SEQ ID NO: 20754 - DNA, 267 bp, Homo sapiens
tagatttcagtcttgttttgacacttgattattttttccttagcaaaagaatacatgcttattttaataacttacatgatacagacatatataaagaaaaaagtatagttccctttgctccctacctatcccccaacagttcagtgtagattctttgataccttttgatctactaagtctcttttgtataccttttggctttgtgtatagaatattgtataacacaagttttaaattttcatgtggtcagatcttttctcccccaac

SEQ ID NO: 20755 - DNA, 182 bp, Homo sapiens
gaaggcctctaagtggtcaaaatatccacgtgcagactttacaaacagagtgtttccaaaccgctgaatgaaaagaaaagttaaactctgagagttgaacgcacacatcacgcagcagtttctgagaatgattctgtctagtttttatacgaagatatttccttttctgcctttggccccaa

SEQ ID NO: 20756 - DNA, 272 bp, Homo sapiens
tataaatataagatagtatactaaggattacataatgggatgagtggcatatagtgggagcatagggaaaattgagacttctgcttccaagtgaaaggaagtcacaaatatcaacactttgtcagtcttatttcagtaaccctacattgctttttttgtgtgtggtcttggggagtgactaggagttgtccaggtggaataaaaggacattctaggtagaattctctctcattctagaaagagagagatctgtgtatgtaaagtggaccgac

SEQ ID NO: 20757 - DNA, 186 bp, Homo sapiens
gttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttca

SEQ ID NO: 20758 - DNA, 323 bp, Homo sapiens
cacatggttaaaatatacatgccagcagccccccaaacatcaaagttttcattactgttaaggaactacagtcaagtggtaccatagttccactgtggtggtaaaggtatcattcattcaagtatttcagggaaggaaatgataaacttgtttgggtgaagtgctcagccctagatgaataagccatagcatgagagaggggaaagggatgaataatttcataaatgaacatggcagctccattagggatgggaaagggtagttattgcccaacaggaaattctcaacaatcccacagagctccactgtaaggccccacccct

SEQ ID NO: 20759 - DNA, 279 bp, Homo sapiens
ttggtgccatggacccaacagagttagagtctgcaccctcactcctccatccccatcctccaagggtatcttaggattagagcagtagttcttcccatcaattagctttctccatcccctactggccagctctctgtacatttcagcctgggacaggctgtgtctaaacgtttcatttgcattccagctattcacagggccagtccagcctcagtttcacttcacagctccctttggcctaacttgcccccatccccaggctgtggggttcgcctcccc

SEQ ID NO: 20760 - DNA, 281 bp, Homo sapiens
tctctagggttccttctaactcggaccctctgggatgccgggcatcatcactgtggggtgcttcccaggtaggacagctgctctcaactactcttgtcaatttgttttcatcattgttgttgttgttgttacagctaaaagttatagagtgctttctaggtgccagacactgttttgaccatattcatgtataaattcatttactttgtcaccaactctggaagattttacagatgaagaatctgaagtacagagagcttaaggaatcacccagttaggtc

SEQ ID NO: 20761 - DNA, 147 bp, Homo sapiens
  misc_feature 32: k=g or t
tgtgcctgtagtcccagctactcgggaggctkaggcgggagaatcacttgaacctgggacatggaggttgcggtgggccgagatcatgccactgcagtctagcctggaggaaagagaaatattccatctcaaaaaaaaaaaaaaaaa

SEQ ID NO: 20762 - DNA, 372 bp, Homo sapiens
  misc_feature 335: s=g or c
ctccactccacttcactccaatccactccactccattccattccatcccattccatttcactccatttctctccactccactcacctccactccattacttccactccatcccattccattccactcctttctattccattccactccactgcactccactccattccatttcattccattccattccatttcactccattccgttccattcctctcgagaggatctcactctgtcacccaggctggagtgcagtggcagtatctcagctcacatttcatttcaccattccattcgattgcattccattccattccattgcattccattgcattscattccattgcaatgcattcaattccattccatccct

SEQ ID NO: 20763 - DNA, 144 bp, Homo sapiens
  misc_feature 44: s=g or c
  misc_feature 45: m=a or c
  misc_feature 119: h=a or c or t
aaacaaaatgctatggtagcatttttcaccttcatagcatactsmttccccctcaggtgatactatgaccatgagtagcatcagccagaacatgagagggagaactaactcaagacaghactcagcagagagcatcccgtgtgg

SEQ ID NO: 20764 - DNA, 346 bp, Homo sapiens
  misc_feature 9: r=a or g
  misc_feature 10: k=g or t
  misc_feature 271: s=g or c
  misc_feature 309: k=g or t
ttctttcarktcttactactcatccttcatttatctcctggatcattgcccagagaatgaaagaaattgccagtcaagccagccaggtaggttaaatctatcctggcagtcctggagactgctgcagactgactgcctgatgtccgtgcccactggggtttttcccttttcagaaaggatttctccctgatctctccccacaaactctggctttgctttttcatttcctaagagcaactcaatatgcatttccccatccaagctaccttcsactattcccctactgattctctctgtcatttatatttktcactcttctcttcctttctctgctctacccctgccc

SEQ ID NO: 20765 - DNA, 137 bp, Homo sapiens
  misc_feature 11: k=g or t
  misc_feature 33: w=a or t
  misc_feature 34: k=g or t
caaatttgggkaagatttattgagccttagggwkacatggacagttaagcttaagtaaactgtatattgattatcaaacacaagctgtaattggaaaagttgagaggaaaagcatgagatcacaaattagggggagc

SEQ ID NO: 20766 - DNA, 97 bp, Homo sapiens
aaatgaggctgctgcggacggcctgaggatggaccccaagccctggacctgccgagcgtggcactgaggcagcggctgacgctactgtgagggtttg

SEQ ID NO: 20767 - DNA, 155 bp, Homo sapiens
  misc_feature 32: k=g or t
  misc_feature 34: w=a or t
  misc_feature 119: b=c or g or t
  misc_feature 120: m=a or c
attacaggtttgggccaccatgcctggccagktwttctgagtttcagcactattgacattactttgctgtgggagcctgtcctgtacattgtaaggtgtttagcagcattcttgatctbmacccactagatgccagaagcaacaccccaccaccg

SEQ ID NO: 20768 - DNA, 166 bp, Homo sapiens
  misc_feature 9: k=g or t
  misc_feature 10: r=a or g
  misc_feature 11: d=a or g or t
  misc_feature 12: w=a or t
  misc_feature 32: k=g or t
taaaaagckrdwgtgtaaggcaatggatgggkgacaaatccagaatcagaaccatagggttgaatgcctacaaattgtaaaaccatttgaagtttaaactgaaataatagcagtgatattattggtattcatcttgccagggcttccaccaaatgcctgccacaga

SEQ ID NO: 20769 - DNA, 90 bp, Homo sapiens
ccattccattgcactcgggttgattccattccattccattccatttcattccattccattccattacattcggattgattctattcaatt

SEQ ID NO: 20770 - DNA, 146 bp, Homo sapiens
  misc_feature 23: n=a, g, c or t
atttccggcgccggcatggccgngtgagctgtaggcttccttatttaagaccgggaatttagtcagcctggtgagccgactctgaggagatggagtatcgctgaggtgatgagagagaatgtggttgttagcaacatggagagagc

SEQ ID NO: 20771 - DNA, 183 bp, Homo sapiens
  misc_feature 9: r=a or g
  misc_feature 10: r=a or g
  misc_feature 32: r=a or g
  misc_feature 33: k=g or t
tttcagtcrrgcagccagtatttgagccagcrkgtataaaacactgtgttagaacccaattattgagagaaaatatttgtaaatcatatattggattaggtgctaatgtgcaaaatatacaaggaacaaaatatacaaatactcaatgaaacacccctatttttaaaatgagtaaaggacgtt

SEQ ID NO: 20772 - DNA, 383 bp, Homo sapiens
  misc_feature 9: m=a or c
  misc_feature 10: s=g or c
  misc_feature 11: h=a or c or t
  misc_feature 12: d=a or g or t
  misc_feature 32: k=g or t
  misc_feature 268: m=a or c
  misc_feature 324: k=g or t
acacttccmshdcttctgcagcagacggactkagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggmaggagaaagaggaggagagagaaaaagggcacaaaataccataaaacagatcccakatttctgcttcccctcacttttagaagttaattgatggctgacttctgaaagtcacttt

SEQ ID NO: 20773 - DNA, 104 bp, Homo sapiens
  misc_feature 32: k=g or t
  misc_feature 33: w=a or t
cgttgattctctaatagtcatgaaacagacakwgtatgtaaaagaatatgtaaaagggaggaatgcccgtgatacgaaaacaaaagttgatattggaaccccgc

SEQ ID NO: 20774 - DNA, 150 bp, Homo sapiens
  misc_feature 10: k=g or t
  misc_feature 32: b=c or g or t
  misc_feature 33: d=a or g or t
  misc_feature 34: r=a or g
  misc_feature 80: k=g or t
ctgttgtcckcttggcaattgttcaggcctcbdrtgttgttactgatttttgtatgtatatatatatatatatatgtctkgtttttccaactagattgtgagctccttaagggcagagccatgaattatacctctttgtatccccagtgc

SEQ ID NO: 20775 - DNA, 170 bp, Homo sapiens
cacttggttattatttattgtcatctgacaatcctgtgaggttggttggtatctcagttttgcagatgagcaaacctggggttaggggaggtggttcttcatataaccagtgagaggcagagccaggattcgacccagtctgtctccagtctttctgactccccaccatt

SEQ ID NO: 20776 - DNA, 209 bp, Homo sapiens
  misc_feature 32: s=g or c
  misc_feature 170: k=g or t
cagttgaagcgcgcacattgagtcggcttttstactgcttcggctagggtaccttgtgaccatgtcttccaagaagaatagaaagcggttgaaccaaagcgcggaaaatggttcgtccttgccctctgctgcttcctcttgtgcggaggcacgggctccttctgctggakcagacttcgcggcaacctccgggactctgacggtgacac

SEQ ID NO: 20777 - DNA, 308 bp, Homo sapiens
  misc_feature 35: w=a or t
  misc_feature 258: k=g or t
  misc_feature 273: h=a or c or t
  misc_feature 274: m=a or c
  misc_feature 275: h=a or c or t
  misc_feature 292: d=a or g or t
  misc_feature 293: d=a or g or t
ctagttgatgctaattgatttaatgtgttggaatwtccgagagttcaaaagtagcttcgaataagctgctttgtggttgtaacccagtttcatcacttaccagatgggaaattttgggaaggttgcttagtccctctgagcctcaatctcctcatcagcaaaatgagggtagagctattgtgagctttccataaattattacatttaaggtacctgaaagtatacctagaacatcacactcactcattaatgccagckattagttaaatatthmhgcaaaataatttaagcddggaaatctcttcata

SEQ ID NO: 20778 - DNA, 144 bp, Homo sapiens
acttgtagggttttaatacaagctacaaaaggcaaacctcagctagcaaacgaatggctttaggctagattcttttgaatagttatcagcatattatttgctgtgtgttgcatatgcatgttgaagcatatttaaggaaccact

SEQ ID NO: 20779 - DNA, 159 bp, Homo sapiens
  misc_feature 7: n=a, g, c or t
  misc_feature 30: n=a, g, c or t
  misc_feature 36: s=g or c
  misc_feature 49: s=g or c
  misc_feature 61: s=g or c
  misc_feature 62: s=g or c
  misc_feature 79: d=a or g or t
  misc_feature 94: k=g or t
  misc_feature 121: y=c or t
  misc_feature 159: s=g or c
aacttgntccggcctcctcgctcctgcctnagttcsgggcctggtctgsgcttcgtcctgssgctgggaagtttctgcdctccccgctgtccaktctgcatctccgcgcctcccgccgggyccccgcggtcccctcccgcccgcttcccccgcgtaggs

SEQ ID NO: 20780 - DNA, 173 bp, Homo sapiens
  misc_feature 32: d=a or g or t
  misc_feature 144: s=g or c
  misc_feature 149: s=g or c
attccagtctcctcaattctttcactgtattdagacggcctgccctctggcacgttttctggaacgaaagcggcttgggacagacagactcccttcgccagggagccccgaccccgagggcgcgccctgagcgtctgagcgcascccgstgcgtccccagttgtatccccgca

SEQ ID NO: 20781 - DNA, 177 bp, Homo sapiens
aaccaagttctgctcccttctagaaacaacatagacaaagaaagcaaaaggaaagaaatgctgacagagacccacaaaggccgctgtgatttggtaaagcaccaagcctgccagcacgtcctatggaaagtgagggcagacacaaccacagttggcagggagaacagccaagccgca

SEQ ID NO: 20782 - DNA, 461 bp, Homo sapiens
  misc_feature 9: k=g or t
  misc_feature 10: r=a or g
  misc_feature 11: k=g or t
  misc_feature 32: d=a or g or t
  misc_feature 33: k=g or t
  misc_feature 138: r=a or g
  misc_feature 382: d=a or g or t
tttccagtkrktgcccattcagtaccctaaadkttaaagtataataataaaaaataaataaataaataaataaataaataaaaagggaacttatgctgggctgtaagtaaatgtatagacatgtggaggatattccargaaaaggaaacaatgaatgagagtgttacaggtaattaaacaggcatgactggggaaggaaagggctcttcccctacccaacaggaatatcaggtgatagttgggtaattaccacattgaaaggggagagttctctgacccccttgcaccacttgtgacaggggtgtgactcatttgctgccgctgctgatcaaaccctttatgggagggggagcaggcagaaaagcaggtgcaggagccaggdcgagcctttttggctccagacctatggcggcatctaggggtgtgttacaactaatgttcttttagcagttgccatccac

SEQ ID NO: 20783 - DNA, 172 bp, Homo sapiens
  misc_feature 149: w=a or t
  misc_feature 161: w=a or t
ccgagaaatttacatataattaattgaagtgggactattggattatcatgtaagatgatccagttttggtttttttttttataaggctgccctgtttctctgtaatatgtctgtctgggttttgtgttggcatcctctgggctgcattwatcttgtttatwacccttcattt

SEQ ID NO: 20784 - DNA, 110 bp, Homo sapiens
aatctaggagccattcttgaacgcctggcctcagctccttctgtgccaggacaacaggactgagccacagcacctctcgagccattctcaattatccacttcccctgtca

SEQ ID NO: 20785 - DNA, 129 bp, Homo sapiens
tctaggttgcctttaattctgcctctccattgaaaatagtctcttccttttgcttctggaattgctctccccttggtctgattggatactgtcatcctgagggccaaaccagtgcacacctctgcccca

SEQ ID NO: 20786 - DNA, 280 bp, Homo sapiens
ctgcaacctccacctcccgggttcaagtgattctcctgcctcagcctcctgagtagctgggactacaggcgcctgccaccacgcccagctaattttttgtatttttagtagagacggggtttcactgtgttagccaggatggtctcgatctcctgctgatctctactgagtacagtgcttcagcatatcagcagatctgagttcagtttctcactctactccttcaatttggatgtctttatataagttatttactctctgagtttcatctgtcacaaga

SEQ ID NO: 20787 - DNA, 157 bp, Homo sapiens
ctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgaccac

SEQ ID NO: 20788 - DNA, 288 bp, Homo sapiens
  misc_feature 78: k=g or t
  misc_feature 231: k=g or t
  misc_feature 268: k=g or t
ttaatatttgtctattacttatttttatattgtgagtttctattacttattttatatagtgagtatttattgcctgtkttgagattccactcttctctggtgcattagatgtcctattgcagccccgtgctctcttaaaaacagagatggttactatgcacataaaatggctgttggttgtctttaccacttgtgctttggagctcaggaggttgacttgtcacttaaatktttttttttaataagttgtcagtaggtttttagtatktctatttagttgtcctcttt

SEQ ID NO: 20789 - DNA, 93 bp, Homo sapiens
ccctgagggcgctggtcaaggagcagggcgaccgcatctgccgcctggaggagcagctgggccgcatggagaacggggatgcgtagggccgcc

SEQ ID NO: 20790 - DNA, 122 bp, Homo sapiens
actggactccaggaaaggggtcggggaacgtgcaggggttttggcgccagacacaccacgttccggccaagtggctccttactggctgtgaacgtgggccagtcactgtctccaagccgcct

SEQ ID NO: 20791 - DNA, 103 bp, Homo sapiens
aaaaagcttatccaccatgatcaagtgggcttcatccctgggatgcaaggctggttcaatatatgcaaatcaataaatgtaatccagcataaaaacagaacca

SEQ ID NO: 20792 - DNA, 249 bp, Homo sapiens
catctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaaca

SEQ ID NO: 20793 - DNA, 125 bp, Homo sapiens
  misc_feature 10: r=a or g
gcctagactrtacaaacagtgtggtttatgctgaacacctgccttcctttggggggtctggaattttggtacacgctaggcagagggtgccttatgtgactagaccctagtaaaactttggatgt

SEQ ID NO: 20794 - DNA, 197 bp, Homo sapiens
  misc_feature 9: k=g or t
  misc_feature 10: d=a or g or t
atagttttkdgactttttaataatagccattcggactggtgtgagatggtatctcattgtggttttgatttgtattcctctaatgatcagcgatattgagctattctacatgtggttgttggccacacacacgtcttcttttgagaagtatctgttcatgtcctttgcccactttttaaggcggcgggggtgggggg

SEQ ID NO: 20795 - DNA, 74 bp, Homo sapiens
agatcgaggctgcctccccctctcagccggcagcacattccgtcgccttgccgccgcccggccccacagtcgga

SEQ ID NO: 20796 - DNA, 127 bp, Homo sapiens
  misc_feature 114: s=g or c
tatattttcagtacagacggggtttcaccgtgtttgccaggatgggcttgatctcctgacctcgtgatccgcccgcctcggcctcccaaagtgctgggattacaggcgtgagcsactgcacccggcg

SEQ ID NO: 20797 - DNA, 78 bp, Homo sapiens
  misc_feature 22: d=a or g or t
gaatctggtccgagcgcgggadacggcgggtccccgagcccagggttacaaaataaatgccatttgaacagtgcccca

SEQ ID NO: 20798 - DNA, 230 bp, Homo sapiens
acactaaagctacaatatctgaacgcatggtaaggacacacattttcaagtttctctttgggtcacaggtgtgctgctttctacatcaatttgtcaggaagacaaatcttttagtgtcgggaagaaaagcagcaagatgaaaaagaaaaaaaaaagaagatatttcaagatcagattcttcatcctacttttctgacttgccagaagctaacgacatctttcccagctac

SEQ ID NO: 20799 - DNA, 153 bp, Homo sapiens
atgtggatataccactttatttttatttatttatttatttattttttgagttggagtttcactcttgttgcccaggctggagtgcaatggcgcgatctcggctcactgcaacctccgcctccagggttcaagcaattctcctgcctcagccta

SEQ ID NO: 20800 - DNA, 135 bp, Homo sapiens
ttgcctcttaaaaggccacacttcttaatactatcaaattggctattaagtttcaacaaatgaatttggggggacattcagatcatagcacttttcttttctttctttttttttctgttttttgttttttttttt

SEQ ID NO: 20801 - DNA, 191 bp, Homo sapiens
gtagatttggtcttttcacatagtcccatatttcttggaggctttgctcatttctttttattcttttttctctaaacttcccttctcgcttcatttcattcatttcatcttccaatgctgataccctttcttccagttgatcgcatcggctcctgaggcttctgcattcttcacgtagttctcgagccttg

SEQ ID NO: 20802 - DNA, 69 bp, Homo sapiens
ttaaaaatcaaaagacaaaggacagatggaggattttttttgtaattcaacttacagaaaaggggcccc

SEQ ID NO: 20803 - DNA, 138 bp, Homo sapiens
tagcaaggtactgtagttttctttgatcagcacctgaaagatactgtgccacttcttctgatccccatggtttctgatgagaaatctgctgtttttctcctgtagtcctattttgtaacggattatgatccaaccaaa

SEQ ID NO: 20804 - DNA, 253 bp, Homo sapiens
  misc_feature 31: d=a or g or t
  misc_feature 32: k=g or t
  misc_feature 33: k=g or t
tttctcggttctgtgggccacatgtgttggdkkctgttggagggttgcaagcagaggagctgacttgtgttttagccaagggagagccctttggagccactgcagccgtccagtgcagaggcgacgagggcttggaccaggctggaggcagcagggatggagaatgtggtggacaccttagagatgtattttgcaggtggaatcatgacaacctgctaaatggactgtgtgagtccttaatcggctccagggc

SEQ ID NO: 20805 - DNA, 165 bp, Homo sapiens
tgctttggcattcagaagagagagagtgcccctatgggaaggggaagtcaggatggattttatgaaaaggtttacacttgagaggaatcatgaagaatgggtgaagttttgacaggcagaggtaggtataaggagtgggatcaaggtattaacaataaggcaata

SEQ ID NO: 20806 - DNA, 442 bp, Homo sapiens
  misc_feature 10: k=g or t
  misc_feature 34: n=a, g, c or t
  misc_feature 91: k=g or t
  misc_feature 93: k=g or t
  misc_feature 133: k=g or t
  misc_feature 171: k=g or t
  misc_feature 341: k=g or t
  misc_feature 417: y=c or t
ttaatatttkcttagtcatcaaataatggctttntgggggctaattctccccagtgaacaaatatatctaccatcactgtaattatatttktkttttatcttgtaactgggccatagttgcttcaatgctgtkgtactacctttttattatttatgctctgtgtgcatatkctattcctttgagagaggaaaacagatatactgtcttatttttattactgaactccttagtctggaattaactggtctttcctcttttagagctggtaagaacttgacaactggaggtaatatttaatttcaagtgttagaaatatttttttcagaatttttttactatkggttgtttcatcaatagagactttaagatgaacatgacagtttcaggatcagggtaggggtcactgagttaaggcycatattttaatgtggcatagaataa

SEQ ID NO: 20807 - DNA, 135 bp, Homo sapiens
  misc_feature 49: w=a or t
agattgttacaacatttgacgggacacctatttgtaacttttttttttwacttcactgggaaggagggagacacccatttttatcttaatgcagtccatgaaagtgcctgtaaggcttatatgggttcaggccgg

SEQ ID NO: 20808 - DNA, 140 bp, Homo sapiens
atgaacaaaattttaagtgtagaataccacattgctaattccaggggcaatgttgtacagcagatctctggatctcttccctcttgcataattgagactttatgtctgcttcttactaattccccattcccctctcccct

SEQ ID NO: 20809 - DNA, 175 bp, Homo sapiens
agtattcagtaatgtgtatctttagaccactagtatttgtttcattttttttaaatgttttaccaaaattgcctttgcttttcagttatttgtttgttttggtaggctgatagtctaaaaaactgaatacaaaaagcatataatgaagagtaagcctcttcctagtctgcctcgg

SEQ ID NO: 20810 - DNA, 445 bp, Homo sapiens
  misc_feature 31: w=a or t
  misc_feature 33: w=a or t
  misc_feature 423: d=a or g or t
gatttcctccctgatcactcagcagtacccwgwtccctagctccctgcccaccaaattgtccattaaaaaccctaatctctgagccttcaaggaaactgacttgaggagtaacaccgtcttctgtgtgcctggccttgtgtcaaatttttctctactgcaatgctgaggtctcagtaaatcgatttttgtctgtgcagtgggctggaaggagtcaacagggacaaggtgtcaccatgttgcccaggctggtcttgaactcctgggatcaaggaatcctcctgcctcagcctcccaaagtgctagaattagagacgtgaggcaccacaccacctacctttatatttaagcaacagtttgactgcatacaaaattcctgggtcacatctctttgctggaggattttattggtatgtatacataadgtcttctaagaacaaatgctgt

SEQ ID NO: 20811 - DNA, 209 bp, Homo sapiens
  misc_feature 3: k=g or t
  misc_feature 4: w=a or t
gtkwccacccactatggcttcctagtgtcagagccagctgtgtagtggctcggtgtgatttgttagctctttgaggcagggtaccctcctcaggatttcgatatgcaaaaaatcaaatctctcatgacccgacaggtctgaaaagccctcaagaaagcctcagtgatcttggtgccacagagagtctccgggtccctggaaaggaagaa

SEQ ID NO: 20812 - DNA, 135 bp, Homo sapiens
  misc_feature 32: d=a or g or t
  misc_feature 33: r=a or g
ttggaagttctggccagggcaatcaggcaggdraaggaaataaagggcattcaattaggaaaagagaaagtcaaattgtccctgtttgcagatgacatgattgtatatctagaaaaccccatcgtctcagcccca

SEQ ID NO: 20813 - DNA, 157 bp, Homo sapiens
gggagagagagacagatatatctggcgctgctccgtctctggtagctttgaggcccagggccaggtctgaggcaccctcagctttgttctcgagagaatccagggctcttgcttctgaaaagaacacgccacatcccaggctctaagggccccatct

SEQ ID NO: 20814 - DNA, 157 bp, Homo sapiens
gctgggatatctctgtcatcgtgggcttgagtacctggagagagtagatcctgaagaactttttcagtctgctgaagagcttggaagactggagacagaaggcagagtctcaggctctgaaggtataaggagtgtgagttcctgtgagaaacactcg

SEQ ID NO: 20815 - DNA, 94 bp, Homo sapiens
ttttatacccatggctgtcactgttatagaaactgtgtccctcatgctgcagtatctcagaaacagaggcagaatttaatcatctcatcctctc

SEQ ID NO: 20816 - DNA, 255 bp, Homo sapiens
ttataagattactgaattggtagtactggaactaaccagctgctcctaaaatagtgcattttggtttgaaaaacagattgggtttctaggaaatggagtaagtttgttaatgtactaagattaagcactttctgataaccatattagctatatatagtatccacttcagcttaccattaataaattagaccatgcacttaaaagaaccaaaataaaatcagtttattaactattgagtctttacattagagccaa

SEQ ID NO: 20817 - DNA, 372 bp, Homo sapiens
  misc_feature 266: n=a, g, c or t
  misc_feature 371: r=a or g
cttttatctgagtctgctctcccattgcccaaggctgcctggtggggatgcggtgtgggggttgctggatgcagcctgccaagtgtgacccagagactgtaagctctgaggaactttatttggtgtttcctgaatgttttactgagaagcctttgtcaagtaaagccactcagtgaatcctgtgactgaatagccaactggtgaaatgagaaactgtcaacgtttttactttttactgaaggaggccaattctgtgagcgtatgtntgattcaaataagaggtttggatttgtttaaatccaccccgtcaagggtatttctagatttcatcacggaaatatagtggagctctgcgtggtggccatggcgarc

SEQ ID NO: 20818 - DNA, 255 bp, Homo sapiens
tctatttgtaaccaataaaagtaactctgcactaagtcaaaaaagacaacactgcagtttctacaaatttactaggatgttcactgttgaagccctgagttgtcacgtaagaagatagctatgctgcaaggaagcccaagccacatggagaggcttcagttgagagcctcagctgaggccccagccaatagttcacatcaattgccagatgtgtgaataaagagacatccagatgactctagtccccagccatac

SEQ ID NO: 20819 - DNA, 180 bp, Homo sapiens
attacaggcaggagctaccacgcccggcttaaactctgtgtctttggtgtgaatcctcacttcagggaatgtttaccccttcttcctcctccctgtcttttaattttacactaagaaaattatttgcttatctgaaatgtgaattttgatctggcaaccctaggcagaaaaatcccaaac

SEQ ID NO: 20820 - DNA, 105 bp, Homo sapiens
aaagtcaaatcccccattcttaggccacactggtgtcacaagctcctgtcagggagctggggtttgggaatgtgctttgtgaactctgctttaaagtgaggggcc

SEQ ID NO: 20821 - DNA, 112 bp, Homo sapiens
tttccgcctgtgcagctcgccggctcaatactccgggggtctgggtggggggctcaaacgcagggctctgggacgcaggcactgctccaggtgatagtgcgggaacatggca

SEQ ID NO: 20822 - DNA, 233 bp, Homo sapiens
attttaccttctgaaatgatggaggaagttctgctgaggatggggtcagggtaacagcagacttctgaataactctgcacccccagaaacctgcaaaggacacaggccctcttggtggtctcctcctggatgccttgctttctcctggaagagtcctcccttccaccccggatatcactgtgaacctgattccccaggatcaaccatctgagcagataccttggaacgtcccc

SEQ ID NO: 20823 - DNA, 280 bp, Homo sapiens
ccattctgaaaatcttagggcccttaagaattatgctacatctactcttcctgtgctctataaatggaataacaaagcctggatcacagtacatctgtttatagcacggtttattgaatattttaagcacactgttgagacctactgctcagaaaaaaagattatttataatactactgttattgacaatgtacctggtcacctacaagctctagcagagaagtacaaggaaatgaatgttgttttcatgcctactaacaccacatccattctgcagccc

SEQ ID NO: 20824 - DNA, 133 bp, Homo sapiens
  misc_feature 46: s=g or c
cttctagaaataatctgcagtggctgcctaagatgttttctgagtscaacccaaataaaaatgtaataatttaaattagaattttctacaatcatgtgttgctcatgtctgcattatggatacccaggtcaca

SEQ ID NO: 20825 - DNA, 463 bp, Homo sapiens
  misc_feature 334: w=a or t
gtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgcwagagcatctcccaggtgagccttattgcagatctttttgatatagtcacccataagcatggtgagctcctgctctcataaggtcagccaaagccccttaagaggtacacagcacatctgcagtcattca

SEQ ID NO: 20826 - DNA, 91 bp, Homo sapiens
cgtacccaaaatgtacgaaaaaggaaagtctactaatatgaatagcatgcaagttaaggttattgtagtaaagctctaaatttgggaggcg

SEQ ID NO: 20827 - DNA, 148 bp, Homo sapiens
tattttatatttgactggacattgttcagaagtgtgctttaagggacacttgttggttgtctgcccagcatctctcaagaatatccctcctgtcctccacatggttgtgcagggccatgtgtgaagacagcatgagtcttaacccccc

SEQ ID NO: 20828 - DNA, 165 bp, Homo sapiens
gagaatcacttgaacctgggaggtggaggttgcagtgagccgagatcatgcaactgcaccccagcctgggcaacaagagcgaaactctgtcccaaaaataaataaataaacataaacaaataaatagttcaatgacagctagctggataagatgtccgccttcca

SEQ ID NO: 20829 - DNA, 362 bp, Homo sapiens
gctgagcaggcctgccacctatctctgtaaacggtgttttattggcacacgtctaacccattggctcccacattgtctgtggctgcttccatgccgcaactcagttgagtggtcgtgacagaaaccatgaggcccacaaagtctaaaatgtctgcccctttatagaaaaagcttgcctgcccttgctttaaatgaccacccttcaaattttgaaaagctctgccccgtcctccacccatagcctctgagccatctcatcgcaggctgaacattccaggcttcattacccctcccatcaagtgccctgggcatcctggtgtctaaccgtgagcacacccaggtttgccaggaccccctctgaa

SEQ ID NO: 20830 - DNA, 199 bp, Homo sapiens
aattatcataccttctgggaattctctcactataaacttaggacccattaagctatttttaaaatttagagtagcattattattattattcgtattagagacagatttcgccatgttggccaggctgatctcaaactcctgacctcaaatgatctgcccaccttggccttccaaagtgctgggattacagatgccagcc

SEQ ID NO: 20831 - DNA, 288 bp, Homo sapiens
gtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggacag

SEQ ID NO: 20832 - DNA, 111 bp, Homo sapiens
ctttttatcgagacagagtctcaccctgtcgcccaggctggagtgcagtggcgagatctcgactcactacaacctctgcctcctgggatcaagcgattctcctgcctcagc

SEQ ID NO: 20833 - DNA, 415 bp, Homo sapiens
  misc_feature 9: s=g or c
  misc_feature 10: n=a, g, c or t
  misc_feature 11: n=a, g, c or t
  misc_feature 12: h=a or c or t
  misc_feature 33: y=c or t
ctcttcctsnnhtccgaacccgttccctaggtygtactatgactttcagttgctcgtgaccactgggtttggatttgcaacacaggcctcttacaggagtggcaggctcccaccaactgcccacttcacagctgcccttggctcaaggatcgtctcaaaattcctagatccaaaaatagagttctggagccaacgtgccattttctacttctacatggtagtactttaagccaaaaaaattttgagttgtccttggcttctctttttctctcacatgtgacaatcaacccatcggccaattcttcaaactatgtctagaatccaaccatttttcaccacctccagcataacctcaccaggaatactgcagtggcctcactgggctctgcttcccctgtgcccctctatcatcttt

SEQ ID NO: 20834 - DNA, 112 bp, Homo sapiens
ctttacgcgtaactttcttcacttctttcttccccctttttctcttctcttgggtggttacctcaagtacttctcacctttttcttttctgcctgactcttccacttccccc

SEQ ID NO: 20835 - DNA, 142 bp, Homo sapiens
gtctggggagagcggggcgttgggaggggtgggatagaagaggagagaaatcctggtaatggaatacagttggctatgagaaaaaaattccctaggaaacagttcctctagtttaacaactcagattttttttttttttttt

SEQ ID NO: 20836 - DNA, 349 bp, Homo sapiens
  misc_feature 9: d=a or g or t
  misc_feature 262: y=c or t
tagcaagadgctcgctcttggaaatggatcttggaacatgaaagatagaaagcactgtattgctaacatgctattattctctcttgctctagctctgtaacaacgaaggtaacaaggtaacaacaaaaatatcatctaacagtgtgtaacacttgtcaatttcaaagtggtttaaaaagactgcaggattatttggggacagagtcctagaaaagtgaagataagtaccttcattccaaagcgagtgtcaggtttatcagtyccataggtggccagcacctcagcaaaagtcatagtaggaaaaggaacaaccacaggatctttgtcattgggccaggaatactggagc

SEQ ID NO: 20837 - DNA, 174 bp, Homo sapiens
  misc_feature 55: y=c or t
agtgttctgtggaacattaattctgtgagatgtttctagaaaagagatctgtgtyaaaaaaaagtgcagtatacatcttttttatttttggtggttaggttctaaaataattgtggaaggtaaaaattatgtatatacaaaatagcccttgaaaattcctttgctgcccataaa

SEQ ID NO: 20838 - DNA, 208 bp, Homo sapiens
  misc_feature 133: w=a or t
  misc_feature 189: b=c or g or t
aactaagtaactaatcctcaattttaggattattggtagaattgaatttcagattctgatttttagcttcatttaacctcttcgtttgtaatatgcttgtccacccgcttctcaagaatagtttgtttctgtwtttgattttcttccttctgaagtatgaattttcaccccaggcaaaagatgagagtbaatagactaatagggccgt

SEQ ID NO: 20839 - DNA, 177 bp, Homo sapiens
cttggtccccgggacactgtctgcatgcagtggcgctcggctcacacctgctgactggggggcaggcccgcaggcagcagaatagaaacacccaccctctgggcatgcacgctcgctcggggagaatcctcccgcttaagcctcttgaggcaggcattgcccactactctgcggcca

SEQ ID NO: 20840 - DNA, 146 bp, Homo sapiens
gagaaaatcatcagagactggtccacataaaaggaaattgtgggaaagagaaggtactgtttctaagactctacttacttcaagggatccgaaactatcacagtggaaatgatgtagaggcttatgagtatcttaacaaggcaatt

SEQ ID NO: 20841 - DNA, 168 bp, Homo sapiens
  misc_feature 10: d=a or g or t
tttttagtgdagacaggtcaggcccaggtctgctgattcccattctagtccaatttgctttcagtgatgctacagttcttgatcaataaaccgaaagcctgcattctcagtgcagtgcagttcttcaagcctcccctacaaaatcaacaaaaatgtattaaggcaatt

SEQ ID NO: 20842 - DNA, 454 bp, Homo sapiens
aaagcattaaggaaatggaggaaaaggcatcgaccgagcctggacattctccagcatcaaacgtgtgttctgcaggtgactttacctccaccgtgttcatctacatattccaaatgttctgtaataaacctgattgcttcatctcatccaaaagctattacagataatatttcaatcaccctaattaaaacaatcacatgcctttaaaggccaaagttgggcaagaatttaactggccactaattgctgctggggccagggagggctcagccctttgggaaagtgacctggcaggacccaccagtgtctccttccctgtctgagcctggacatctccctgatgtccgacctgaggctccaggtggccctgacctctacacctggctgggacgggtgtagactggattcgtctcctcatctcctggggtctcttgaagaaggaggataatgcagc

SEQ ID NO: 20843 - DNA, 386 bp, Homo sapiens
  misc_feature 12: r=a or g
  misc_feature 13: k=g or t
  misc_feature 32: s=g or c
  misc_feature 33: m=a or c
  misc_feature 34: d=a or g or t
  misc_feature 35: k=g or t
  misc_feature 58: k=g or t
  misc_feature 218: k=g or t
  misc_feature 321: k=g or t
gagactccgtarkgcgtaggaccctacgagcsmdkgtgtgggatgtaatctcatggtkagccatttttttaagccggtctgaaaagcgcaatattcgggtgggagtgacctgattttccagagctggtatacgatgcctctccagaatcaccttgttctttctggatctattcagaatctgaaactcctagaaaagaaaaatgcaagatgcatgagtkgagacaggatctcactatgttgccttgcatggactggaactccttggctcaagaaatcttcttgcctcagcctcccaaatagctaggactatatgcacatgckactacacctagtggaaaatgaagcacagagaagttcagtgatggacctcagatactaccagcaga

SEQ ID NO: 20844 - DNA, 212 bp, Homo sapiens
ctgggattacaggcatgagccaccggcacccggcaaactgtcaatcttggaggccttcctggaactgggattaatcagaagccagcatggtgaattagcctccaagatggagctgctttggcctccacatccaccaagtgctccctgtgcgccaaggccagctccaggtatcaaggtgttaagtaacaaaacggatggaccccctcccctgt

SEQ ID NO: 20845 - DNA, 169 bp, Homo sapiens
  misc_feature 29: s=g or c
  misc_feature 34: w=a or t
aactttcaaaaatacctgcatccaggaastctcwtgctagcaggatgaggtaatgactatttcccatactcgtgtcaactttgagcaatgctaggaatttccatatgtccaaacaactgtttatcaggaaatgcaacaaggtacttttgacactgagcgtgaaaggaac

SEQ ID NO: 20846 - DNA, 93 bp, Homo sapiens
  misc_feature 10: k=g or t
  misc_feature 32: r=a or g
ctgttttgtkttgtttttctgttttgtttgcraaatggtaagggggtgtcgggggggatggggtgtattttgttgcaagtttgtgagggggat

SEQ ID NO: 20847 - DNA, 181 bp, Homo sapiens
attacaacaaattagctgggcgtggtggcacgtagcttgtaatcccagcaactcgggaggctaaggcaggagaatcacttgcacccaggagggggaggttgtggtgagccgagatcgcgccactgcactccagcctggcgacagagcaagactccgcctcaaaaaaaaaacaaaaaaaaaa

SEQ ID NO: 20848 - DNA, 138 bp, Homo sapiens
agtctgttttttcttttttaattttgtagagatgaggtttcaccatgttgcccaggctggtcttgaactcctgggctcaagcaatcctccctcctcacttcccaaagtgttggagttacaggtttgaaccaccacaac

SEQ ID NO: 20849 - DNA, 199 bp, Homo sapiens
attccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccccg

SEQ ID NO: 20850 - DNA, 102 bp, Homo sapiens
agaagggatttgcccaactccacaggcaacttggaaaggcgttaagatcatactgtgcccagagaagcctcacaaaataaatgctccacccaccccctagcc

SEQ ID NO: 20851 - DNA, 254 bp, Homo sapiens
  misc_feature 31: y=c or t
  misc_feature 32: w=a or t
agtattagaacaggaaacaaacctgaaagaywggcttttctttcctattgttctcatattttcatgtgatttatttcctgagttttccttcttctgcttgctcaagctaaaaggattaacaaaataccttgcctctgcctcaccctgcgtgagtctctgcagaggcggggtgtggctcacgtgtgcttgcttagtgagtgagccccacagttggaagatttatgctggaaaataaagacctcaaggggtggtgc

SEQ ID NO: 20852 - DNA, 172 bp, Homo sapiens
caagaagatcagacacgtacactgaaaaagaacccacgttacagagcagtgttgttgaggatgaaacaaaacacagatccatatctgtgtcatataagcttgctcgatgtaactcaacaatttccaaatccacttcctggcagaaccatctttcctggttcctcaaccccca

SEQ ID NO: 20853 - DNA, 127 bp, Homo sapiens
  misc_feature 2: n=a, g, c or t
  misc_feature 10: b=c or g or t
  misc_feature 12: k=g or t
  misc_feature 32: d=a or g or t
tnccgcttcbtkccagtaaggagtcggggtcdtccccagttttctcagccaggcggcggcggcgactggcaatgtttggcctcaaaagaaacgcggtaatcggactcaacctctactgcgggggggt

SEQ ID NO: 20854 - DNA, 173 bp, Homo sapiens
ctgaaagttaagcgcctcttataccccagcacctattacataaattgttctacaattaaagttctatttattttctgtctaaaatatataattcagtgatgggctccatgggcctttgctgagcctattagacgtggttgaatgaatgtttccattcacaccccagccccaca

SEQ ID NO: 20855 - DNA, 107 bp, Homo sapiens
atggtatccttggcctcagcagatggggcccctaaggttgtactttttggcgtggctctgccagagattatatgagctccaagttctggagctcccttccagcccct

SEQ ID NO: 20856 - DNA, 158 bp, Homo sapiens
tatgaacatttttgtgtcctataaatattcttgagctttgttctgggactcagtcaagttaggaaataatttgatccttttgaagcttgcttctaagctatcagagttggccaagaacagtcatagtcaaaggctaatttagtctccctaccgaagcc

SEQ ID NO: 20857 - DNA, 204 bp, Homo sapiens
  misc_feature 89: k=g or t
ttgtatacctttcacagcaagttgttttctgccctcccctccccagccaccctcttccgactccacgtgttttgacactgatgagtgtkttctttttctccaatgaggggtaaggactagaaagattgttaaaaaaataagcattagccaagctagttcctgtgactagaagcaaatgtgatgcttgaactgacctttgtgttc

SEQ ID NO: 20858 - DNA, 150 bp, Homo sapiens
  misc_feature 10: s=g or c
  misc_feature 11: v=a or c or g
cttttcaccsvaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaa

SEQ ID NO: 20859 - DNA, 145 bp, Homo sapiens
  misc_feature 10: k=g or t
  misc_feature 32: k=g or t
  misc_feature 61: w=a or t
  misc_feature 117: s=g or c
  misc_feature 142: k=g or t
atcctggagktggcccagttgtgaactaggakagctttgggacctctgtcccaagcaagtwagaactttagccttaggagatgtaaataaagtagtatttgaagaagcacaggagasatgaatggagagtatagaggcagakaat

SEQ ID NO: 20860 - DNA, 154 bp, Homo sapiens
  misc_feature 85: s=g or c
atcaccctctcaatgaaaggcagatgtccctttaaggtttgcttctacagcccgtggactttagcctaaacacggacccgcgaastggctttatttgtccatgtctcggacagagcctgggaagctgccagtgagatttcagagaccaagagcg

SEQ ID NO: 20861 - DNA, 87 bp, Homo sapiens
tcaaactatactacaaggctacagtaaccaaaacagcatggtactggtaccaaaacagagatatagatcaatggaacagaacagatc

SEQ ID NO: 20862 - DNA, 117 bp, Homo sapiens
  misc_feature 10: y=c or t
tacactgtgyagtatttcatatatgggcaaaagaaatggctgaataaatcagaatgcagaaatatcaatagaacctactgtgatctttctgctgaaacttctgactacgaacaccac

SEQ ID NO: 20863 - DNA, 77 bp, Homo sapiens
caagcttttctaagatgaggaagtaaagtcactaacattaactagatatgttctaggtactcagtttcttttttttt

SEQ ID NO: 20864 - DNA, 84 bp, Homo sapiens
ctcctgcctggagtgctcttttcctcagatctttgcatgactgatctctcctcaggaaagtctcagcttaaatgccgccccctt

SEQ ID NO: 20865 - DNA, 343 bp, Homo sapiens
  misc_feature 76: s=g or c
agatgccgactttagaggaggcggagtttcggccttcgcctgctggaaaagcagtaggatcggccagtggcgacasaggagctgagcctaagccctggcggggctttgggctgtagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggtaaggagctgggattgttcaaatggttttgttacctagggcagagacat

SEQ ID NO: 20866 - DNA, 294 bp, Homo sapiens
tatggtgagcttataaatgttctttggtgcaataaattgtcacacagttggtggcttagcacgacatttattctttcacagttctagatgacagaactctgaagtcacatagaggtgctactgggcctatctccttctcaaggtcctgggggagtgtctcctccttcctcttctagcttctggtgggtgctgcccttgactggcttgtggccacatccctgactccttccaatctatgtccccatcttcacatcaccttttcctcttctgtacacgtctgatctccctctgctc

SEQ ID NO: 20867 - DNA, 177 bp, Homo sapiens
aaatggctgtagattggggtcttctattccaacttgtgggttctcaaaaatggatgcaaaagtccaccatgctttgagatatggataattctaggcattgtaaatgggtttagtttaactggtgaagattataattatgatgtgcatttaattcttaatgattaaaagacagaccaa

SEQ ID NO: 20868 - DNA, 234 bp, Homo sapiens
  misc_feature 20: r=a or g
  misc_feature 21: m=a or c
  misc_feature 111: r=a or g
ctcttccccaactctccccrmccctggtgctctccgccccgcttgcctcccgttcttccccgcccgctccatccgggtcgctgacggctgtctctggactggacagcagtrgcgtccgcttttctctaaggaacccgataagaactccattttctgttgatgtggagacatagggtacctccaactttccggggtttcagaagagaattttttattgaaactggaagaccagaa

SEQ ID NO: 20869 - DNA, 189 bp, Homo sapiens
  misc_feature 19: s=g or c
  misc_feature 20: r=a or g
  misc_feature 21: r=a or g
tagtaatatactgaaagasrrtcgggccctggaatcttcgggagagtgtcttgggatgtgggaaatattgtgcaactccagtcagtgaaagttggcacagatgtagttggaggtagatggtgtgagcagcagaggagcactctgtgtgtgagggaaggaccagaatggtctggagattgcagtagggag

SEQ ID NO: 20870 - DNA, 160 bp, Homo sapiens
  misc_feature 21: s=g or c
gaagtcccctccaagccagtsaaagtctctgaggtccttttgctggttcttttcttgacctagtccatgtccatctccatggatcacatcctgggaagcttcctatgctccattttaattatttcatgatcattatttttttctcctccatgacccccac

SEQ ID NO: 20871 - DNA, 119 bp, Homo sapiens
tcgtttgtcctcggtttgacaggggcagagttggaactaaagtctgtctgaatccatagtctaggatttttttgtttgtttgtttgtttgagacagagtcttgctctgtcacccgggcc

SEQ ID NO: 20872 - DNA, 308 bp, Homo sapiens
  misc_feature 106: s=g or c
  misc_feature 291: s=g or c
catccaaaggatgtgattgagctctgtgtctccacccaaatctcatctcaaattgcaatccccatatgtcaagggagggacctgtaattcccacatgtcgagggasggaggtgattggatcatgggggtgggcggttccctccatgctgttctcatgatagtgagttctcatgagatctgatggttttataagtgtttgaccgttcctccttcatactcattcactctccctctcacctgctgccgcgtaaaatgtgcttgtttttccttctaccatgattataagtttcstgaggcctccccagccg

SEQ ID NO: 20873 - DNA, 257 bp, Homo sapiens
  misc_feature 32: w=a or t
aagtttgaatttcgtggaggctcgggttgtgwgggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacact

SEQ ID NO: 20874 - DNA, 410 bp, Homo sapiens
tttgctatggccaaattatagaaaaccagggcttaggttggccatctgttctgaagtaaaagtaagtgtagagtttgaattaatggagaggcttttctaatctacctgataggaaatagtattatgtagtgaagtgctccttgatttctatttgaaagccgctatctcgggtattttttctgttcacatttacttcctgtgcacttaatgcctttatgggtgattctgaacaggctggaacttgatcactgcagtagacactgtctttcctgttctttgaggatagcagtgatgtacacttgcagtccactgtttcctgtatatccattcatcactgtgactcagccatcgactccactaactaccttaatgatgtcttggataatgcatcagaggaaaaggtgactttt

SEQ ID NO: 20875 - DNA, 217 bp, Homo sapiens
ctgtttagtgtcctttcacatcagcctgatggacttcttttagtgtttcttgcaggttaagcatgctaccaacaaacattttgtttttacctaggaatgtctcaatttctcttttatttttgaagtcggctggatatagacttcctggttgagagttttctccccttctctgtctctccttccctcagaactttgagtatgtcatcccactgcctcc

SEQ ID NO: 20876 - DNA, 147 bp, Homo sapiens
tgcccctctattgtttcaggaggtctcagggcaaataagtttctccactcctgacaccagagaaagcaaaaggagagataaaagaggccggatgaggcttcatttatcatggtgcagatccagtgggagccacttcctgtcctgccc

SEQ ID NO: 20877 - DNA, 385 bp, Homo sapiens
  misc_feature 11: m=a or c
  misc_feature 172: r=a or g
  misc_feature 281: k=g or t
  misc_feature 335: n=a, g, c or t
tggggcagatmaacagatgacagactctcagaaccggacaagataaattcaagtggccccccagagggccataggctctgcagccagacagatctagctgatgatgttagcaaaaatagcagaagggccgagcgtggtagtgcacatctgtagtcccagctactccgcaggrgattacctgagcccaagagtcagaggctgtagtgtgccatgatcacacaggtgaatagccactgcactccagcctgggcaacatagcaagatcctatctctcttttgtkttgttttgtttttgagacggagtcttgctctgtcgcccaggctggagtgcagtngcgtgaccttggctcactgcaagctccgcctcccgggttcacgccattct

SEQ ID NO: 20878 - DNA, 221 bp, Homo sapiens
cctctctgaacctcactttcttcatctgtaaaatggagatgttaatacctacctcgaagggttggccaggtgcggtggctcacgcctgtaatcccagcactttgggaggtcaaggtgggcagatcacttgaggtcaggagttcaagaccagcctggccaacatggcaaaaccctgtctctactaaaaatataaaaattacccaggtgtagtggtgcgcgcc

SEQ ID NO: 20879 - DNA, 270 bp, Homo sapiens
attttaagaaaagagtaaggtctttgaagtcagactgtctgattctctacttggctttgtgatcgtgggcaagttacttactctctctgagtcatagtttcttcatctattaaataggggtgataatagtgcctacatagatagggtgtctgaggatacaaagagataatagttaatgttttctccttttttatttatgtatttattttgagacggagtctcactctgtcacccaggctggagtgtggtggcgcaatctcggcccgctgc

SEQ ID NO: 20880 - DNA, 216 bp, Homo sapiens
  misc_feature 128: n=a, g, c or t
tggtgagggatgggggtgaaaaaggggagacttgctctaattatgcatatacatttgactatgtaaaggtagttgtagactatatgtataaataacaagttaacacttaatattctaaattgttctanggaacagtggcctgaagccatgactagttttgtggagctgctggctcttttaacagtagctgacctattggatttaaactgagactgt

SEQ ID NO: 20881 - DNA, 251 bp, Homo sapiens
agagcaaaagaagcatctgcaggaaagagggcaccacctggcagctccaagttcacactggactttgaagcagtgcaggccccaactattcattcctcccccatagacagccaaatggccatactgtgcagggggtcccctaccttcacagatttatttccccagtatcaacagcagaggcagggacacacctcatgaacagctcataggaaacctcattccaccacaaggcatccgctcccacccacctt

SEQ ID NO: 20882 - DNA, 241 bp, Homo sapiens
  misc_feature 70: w=a or t
  misc_feature 117: d=a or g or t
aaaatcagtgaatccaggagctggttttttgaaaagattaacaaaatacatggaccactagctagactawtaaagaagagagaggggaatcaaatagatgtgcaaaaaaatgataadaggaatatcaccactgatcccacagaaatacaaactaccatcagagaatactacaaacacttctacacaaataaacaagaaattctagaagaaatgaataagttgcttgacacatacaccctct

SEQ ID NO: 20883 - DNA, 318 bp, Homo sapiens
  misc_feature 85: w=a or t
  misc_feature 114: w=a or t
  misc_feature 127: k=g or t
tacagtatcattcccatgcttaagtctctgtggctgtggttttcaaactgcacttgcagtgcatgggctaagcatggagcatgtwcccacccctttggctctgttttcatagcwcttacttgttgakatcttatggaagctttctatgggaaaacaaaaaggattggtttctgaaacagtttgaaattccctggactataggataaaatctaatatgtcatagtaggcttagtatatgatgcagtgccaatctatctcaccagctttatcttttcttatcttcatctcgcagtttatgctttagcagtacaatgactt

SEQ ID NO: 20884 - DNA, 104 bp, Homo sapiens
tttaccttttctgaatatgcaagagaagaaattttcctttaatatataagttaaagacaaatcttgggaacagtttatggacattcagactttttaaaatagaa

SEQ ID NO: 20885 - DNA, 110 bp, Homo sapiens
aaaatgtatagaggaaaaaaaattaagtcagcaaaagttagacctaacctacacaaatcttttactgtagcaaactaaaggaatgactagctcaaagcaatacacggaga

SEQ ID NO: 20886 - DNA, 181 bp, Homo sapiens
tcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcc

SEQ ID NO: 20887 - DNA, 389 bp, Homo sapiens
  misc_feature 42: s=g or c
  misc_feature 44: s=g or c
  misc_feature 227: s=g or c
  misc_feature 229: b=c or g or t
  misc_feature 230: r=a or g
  misc_feature 280: y=c or t
  misc_feature 283: w=a or t
  misc_feature 288: w=a or t
  misc_feature 290: y=c or t
  misc_feature 293: w=a or t
  misc_feature 302: k=g or t
  misc_feature 310: y=c or t
  misc_feature 311: m=a or c
  misc_feature 315: r=a or g
  misc_feature 324: v=a or c or g
  misc_feature 335: b=c or g or t
  misc_feature 339: y=c or t
  misc_feature 351: s=g or c
  misc_feature 362: w=a or t
  misc_feature 381: h=a or c or t
accatttcttataaagcacccaatcacatgccttagtctcaststtaaaactcatcctctaagcattacacactaatgcttagaaaaaccaagacataaagattgaaggtgagagtggtataatttttctgaatgaagaatatgatagcatatgtgaaaggaaaatgaaacctcaggaccccaaactcagcatgctaaagggaaaagttaaactcgggaaatgagtsgbrtaagatctgttctcccctttttcctaaacagatcgctataatttcacatyctwacttwayctwatgtgaaakgtagatcymctargtgtgagavaaatgcctaabtggytttttcacccastcccctctttwcacatgtaaaatgtggathcaatgagt

SEQ ID NO: 20888 - DNA, 422 bp, Homo sapiens
  misc_feature 255: k=g or t
cccaaacaagatgtctttctgtatttttttctttccttctcttagttttgttaaaatctttttagttcagaatattctctatcaaatgccttttctatttgaagactctcctaaaaagttatattaatacttgcaaccaagtgatcaaccatttacatttaactaaattttgctacttttgtttactatctatttaaacattttaagtttgtgtttttagtcaaagtaatacttgttggtttttgtttgtttgtktttttaagtacagagaacaaccttatctgctgcacctcaccccctaattctgcttcagttatgtgcaatgtttactggtttctgctatttaatttttttggtggatacctctgtctaaaatgtttacacctcagtttatttatcacctaagatattatctgttgact

SEQ ID NO: 20889 - DNA, 219 bp, Homo sapiens
ggggtgttaaagtctcccattattaaggtgtgggagcctaagtctctttgtaggtcactcaggacttgctttatgaatctgggtgcatatatatttaggatagttagctcttcttgttgaattgatccctttaccattatgtaatggccttctttgtctcttttgatctttgttggtttaaattctgttttatcagagactaagattgcaacccctgcc

SEQ ID NO: 20890 - DNA, 146 bp, Homo sapiens
tgtattgcacgtcattcctttccaatcaactccactgcattccattccattgcattccattcaattccactctactctatttctttccctccattccactgcaatccatttcattccattacagtccactccattccaccccactc

SEQ ID NO: 20891 - DNA, 149 bp, Homo sapiens
  misc_feature 128: n=a, g, c or t
ctttttttaagctcccctgagccggtgctgcgctcctctaattgggactccgagccggggctatttctggcgctggcgcggctccaagaaggcatccgcatttgctaccagcggcggccgcggcggancagggccggtcctcagcaccc

SEQ ID NO: 20892 - DNA, 54 bp, Homo sapiens
attgcccaggctgtagtgcagtggcacaatcatagctcactataaccctcgacc

SEQ ID NO: 20893 - DNA, 113 bp, Homo sapiens
ttttttgagatggaatttcactcttgttgcccaggctgaagtgcagtggcaccatcttggttcattgcaacctctacctcccgggttcaagcaattctcctgcctcagcctcc

SEQ ID NO: 20894 - DNA, 72 bp, Homo sapiens
taagtagggtaatctatgttttaaaaaaactatttccattgaagtcagagaaaaaacaaggatggctcccct

SEQ ID NO: 20895 - DNA, 229 bp, Homo sapiens
atgacaagggactttaaaacagacatgctgtgtataatgttttcttcctgattaaaaagtaatatctgttcattatttgaatagttacaattaagaaacagattatttagggatgaaaatttccagtaatctccaaagatatgtacacttaacattttggtgttcgttcctccagattcttttctatgattattgtattatattttagaattgtagtttacccaccagc

SEQ ID NO: 20896 - DNA, 148 bp, Homo sapiens
  misc_feature 72: v=a or c or g
  misc_feature 145: m=a or c
  misc_feature 146: m=a or c
ggaataaaaataattaaaaacgtgtcatagaggcatatagtgataggcgaggggaaacttaaatcatcaacvtggagcagccgtggcagctccatgcgtgaggctggtgccacacagtatcccggtgttggcattgtctccaggmmtt

SEQ ID NO: 20897 - DNA, 135 bp, Homo sapiens
caaaagaatgtctcttactgcaatatatgacaagaggagagagacagattatagtgacaaaggatataatttagcttttgtttctcaagatgaacaagaaaattcttcctttactatattatacgaagagcccca

SEQ ID NO: 20898 - DNA, 178 bp, Homo sapiens
  misc_feature 9: d=a or g or t
ctcactgcdagcttcgttccccaggttcacgccattctcctgcctcagcctcctgactagctgggactacaggtgccgaccaccatgcccggcttattttttgtatttttagtagagatggggtttcaccgtgttagccaggatgatctccatctcctgacctcgtgatccgcccacc

SEQ ID NO: 20899 - DNA, 160 bp, Homo sapiens
tagctcttcttgctgaattgatccctttaccattacgtaatgcccttctttgtctcttttgatctttgttggtttaaagtctgttttatcagagactaggattgcaacccctgctttttttgttttccatttgcttggtagatcttcctccatccccccc

SEQ ID NO: 20900 - DNA, 198 bp, Homo sapiens
  misc_feature 12: s=g or c
acacacgatgascgttcggctgggatacttgtccaatgtgatggtatgaaaagctgtttgagatccttgaaggagacgtacaaagtgtcttgagtcttccagtaaagagccctctctgaaagccttgtaagaactggaagagcccgatgcccttggtttgactctactaagagcccctcagttgctgaacctgcacac

SEQ ID NO: 20901 - DNA, 170 bp, Homo sapiens
ctctctcacccagcactgagaggtaggcgccccggacaacagaggggacgctgctgctgcgcaggacagcctcacactcgtagtagccggcgtcactgccggtggggttggggatggtgagccggcggttgtggtcactgatgccgcccgacagcaataccccgtcctcc

SEQ ID NO: 20902 - DNA, 193 bp, Homo sapiens
  misc_feature 42: s=g or c
ccagttggagccagacagcggggtggacaagtggcgtgtgtsctgcgaccccgagggaagatgaacgggacgcggaactggtgtaccctggtggacgtgcacccagaggaccaggcggcggtaagaaaaagcgctctcgctgtcttctccgttttgtattcccggtttctaagtccgccccttccgtgcccca

SEQ ID NO: 20903 - DNA, 170 bp, Homo sapiens
ttgtaggatgtcaatttaagaatgtacaaaagtatcattgtttttcacaattattttaggttatgtttaagcaaaacaatgtgaaggccctgaataagtttttcccaaacacacacaagaattgtttcctgcaagagttatttaaaatcaaggttaaatctggggggcgc

SEQ ID NO: 20904 - DNA, 124 bp, Homo sapiens
caatttctgccaatgaattgttccctgtagtcagacaaagcctttcttgtgttcttcccctcatttctcctcgtgggaccctcctggaaggtgactgtcttgaatgctttattcatgcccatgg

SEQ ID NO: 20905 - DNA, 195 bp, Homo sapiens
  misc_feature 43: w=a or t
catcttttagtattgacacttaaaataaaacttctccccagawaaagagttctataaatgatggctgtagaaataggcactgtccaggcagttgttttgtggaagtagtgttgttattttctggtgttttccaagtcatctcagatggtgcgtgaaaatgagatgccaaagaaggcttaaaaaagataccctggg

SEQ ID NO: 20906 - DNA, 401 bp, Homo sapiens
  misc_feature 188: r=a or g
  misc_feature 391: k=g or t
tcaccaggcaaagaaaagggccttgttaggcaaataacttgtttgtgtaaaagagatgcagtccctacactactgatctgggaggaagtctcaacagaagagggactggattgcccatgtttcctgcaggtaagaggtattcacttgggaaagacccgcggaatctcacctggagaggtaaagcagtrctgtgtcctccgaccttcctcactgcattccaacctgtacaagttgtctggttcccaaaaaaattggccccttcattgtgtcaattgtcttctcatgaacatgcaacaacctttcagcctttttgtggcagagtttatgatgatgcctaagagtcaatgttcctccctgcagctcttggataagaagggttatacagtctctktcttcattta

SEQ ID NO: 20907 - DNA, 82 bp, Homo sapiens
  misc_feature 40: r=a or g
ctcccttccatgaagggcccaatagacataaacatgagtraaattggaatggattacattcatgaactcttctccaaagcac

SEQ ID NO: 20908 - DNA, 175 bp, Homo sapiens
  misc_feature 41: k=g or t
tatgtttgtatattgaaaaaatggtggccagtttttaagtkccttaatagaagagaattatgtctcagcacatataacagtaatgctaatttattgaaactactgctgttagagcacttcttattcattgtcttttagtgaaatttatggcgtaacactttgtcagagaggagcg

SEQ ID NO: 20909 - DNA, 357 bp, Homo sapiens
gttgagtgaggtaagatacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcagattgaaaggaaacacactgaatgaggaaaaactaacatacggtcatcaacatccttgtataacctagtttttaaaaaaattggatttcaaagctggagggc

SEQ ID NO: 20910 - DNA, 409 bp, Homo sapiens
  misc_feature 5: r=a or g
  misc_feature 45: r=a or g
  misc_feature 66: m=a or c
  misc_feature 69: m=a or c
  misc_feature 350: s=g or c
  misc_feature 351: v=a or c or g
  misc_feature 362: y=c or t
atcaractgaggtcaaagtttaagtcagctgacaggccgaagccrtccccctgagcaggggttccmtgmtctcttcctctccacctctcccagtctatatccttcctccttcctggagccctgaggctaatgaacccaaatcccatctcatctcaccctgcatgttacttctcttgtacacacagcctgttctccaggaatcaccttattttccaaataaaaatatcagggtatattgtgagcacacgggtactgtcacatgaattgctgtaatttcaatgcttagaatacttcacaatttatagtaaaataattatttaaaatttaggattatacttatatatggtctsvtgaggcagcayaggaaattgagactgtctgggaaaatttattatctgtgatcccttct

SEQ ID NO: 20911 - DNA, 262 bp, Homo sapiens
acctatttgttcaagtcactataaaccagggtttcttccttgtcttcaaccagacacatttgcagctgatagtaattcattttccaaaaaacttttattttaggttcaggggtacatgtgcagtttgttacataggtaaacttgtgtcataggagtttgttatacagattattttgtcaccaggtactaagcctggtacccaatagttattatttctgctcctctccctccttccaccctctaccctcaagtaggccccatt

SEQ ID NO: 20912 - DNA, 200 bp, Homo sapiens
atgtgactgttttagtgctataaatttccctcttaacactgccttagccatgccccagaaattctggtatgttgtatttttgttctcattagtttcaaagaatttcttaaagaactagaaaagccagagcaaaccaaacgcaaaattactagaagaaaagaaataataaagatcagagcagaaataaatgaaattgaagc

SEQ ID NO: 20913 - DNA, 180 bp, Homo sapiens
ttatacgttaagttctagggtacatgtgcacaaagtgcagctttgttatatatgtatacatgtgccatgttggtgtgctgcacccattaactcatcatttacattaggtatatctcctaatgctatcccttccccctcctcccacctcacgagaggccccggtgtgtgatgctccccttc

SEQ ID NO: 20914 - DNA, 74 bp, Homo sapiens
aagactatactttcagggatcatttctatagtgtgttactagagaagtttctctgaacgtgtagagcaccgaaa

SEQ ID NO: 20915 - DNA, 68 bp, Homo sapiens
gtcaccacccaggctcccttgcctttggctgggtgcaacttccattttaggtgttggatctgagaggg

SEQ ID NO: 20916 - DNA, 418 bp, Homo sapiens
  misc_feature 408: s=g or c
acatgacacagaaccaagatcttaacctttttgttccttggtctcctcattcttgatgatgatgtattcttcattagctactcactccagtggctccactgtagatcttatctgtcataactactcaacttgtaaaaacctaaattctcaaatgtcttcctttcgatcacagtttcctgttcttcaagcttatcacccagttaattcacactatagataatctttgaacacagagcgtgctccaggctgtgatcttcatatccttacttacccagcccagcttctgtagtccatggagttaactattctctttaattcccttaacccattgtccttctgtcacataggtttgtcatacaggcaattcatctaactatccactttatcttttcttacacttgagcagtsagacccccct

SEQ ID NO: 20917 - DNA, 346 bp, Homo sapiens
  misc_feature 200: w=a or t
  misc_feature 259: m=a or c
agtaaatggtccagcttttcattggtttctcaagaacttcaaaacttgaaaccttaaatgacttttaagcctatagaagttctgcccactaaattcttaaaagctactttatgatttgcatttgttgtctttatgtcagtttttcagctttcccattgctttacaaagttactttatgctcttttaaaaatttaaatgtwttggctgggtgcagtggctcacacctgtagtcccagcactttgggaggccaaggcaggmggatcacttgaggtcaggagttcaagaccagactggccaacatggcaaaaccccatctctacaaaaatacaaaaatgagccgggcca

SEQ ID NO: 20918 - DNA, 236 bp, Homo sapiens
tgacaggttctgccttcagctcatgcatgaagcatccacccagatttcctttcccccaaggccccgtgccaacaaagtgtccgaaaccttcatccaataggagcttctccaaatactctttgtccacgtagagctcccccagaagctggcggacagtcttctcactcttgagcgaggccttccacttgggctctcccttggtggggtgtaagaggtgtttcatgggctgaggcttc

SEQ ID NO: 20919 - DNA, 141 bp, Homo sapiens
  misc_feature 110: k=g or t
ttttttcgacgctggcggtggacgcaggcagcatggaccacggttgctgggcggatggggagcgtctatggtcagttgccttagaagtggtgagatgggaagctgcagtkggaagaccctggaggatgcctgacaagggga

SEQ ID NO: 20920 - DNA, 262 bp, Homo sapiens
  misc_feature 48: h=a or c or t
aattgttttccaggttagggagtcaataggtgaataagaattgcagthaagtattcagggctggcacccaaagctcctccaaagtgatgagttggtgaaggaagtccagcttccctctgagtgatgttaaaaatgtgtggggcactgggggagaggaaggccaggtggagaaatacatgcagttaaataacttttttatgatagattcgctgattactcagtgatgactttattgccaatgatgctccaatataactggccc

SEQ ID NO: 20921 - DNA, 132 bp, Homo sapiens
gtttgaatttgaaaacggtaacatcgcagtgctgctcgcgggtctggctagtcaggcgaagtttgcagaatggaatctaattttaatcaagagggagtacctcgaccatcttatgtttttagtgctgaccac

SEQ ID NO: 20922 - DNA, 93 bp, Homo sapiens
ccatttaaaaaaaaatcaggtactcatggtattacaatatgccaggggttggacaaatggattttttacccttttttaaagggttatgtaaaa

SEQ ID NO: 20923 - DNA, 118 bp, Homo sapiens
acatttgttgccgctgggaaagggaaaagagtatcctaaaacgagtctcgaaattcagacccaaaccccgaaacgaacccttccggtccgttcctggctgtttgaatgccatctgccc

SEQ ID NO: 20924 - DNA, 198 bp, Homo sapiens
actgggaaagtggtgtgtgttagccacagtgatgtatccacacccatttctcttttccagggactatggaaagactacatttctcaaccttcctagtagaaggtgatgtcaccagtcggaattgggcagaagaatgtatcacttcagcccaaggcaattaagtgttagtgtcaatcttttccctctcccctaccccca

SEQ ID NO: 20925 - DNA, 174 bp, Homo sapiens
  misc_feature 10: k=g or t
gctgtagtgktgttcttatcttctggttctttgttgatcttctagttgttctatcccttattgaaagtggggtactggagtctccaactgacatacttttcttttagctttttattttggaaaatttcaaacatatatgaaagaagagataatgtacttactcatcacccaggc

SEQ ID NO: 20926 - DNA, 288 bp, Homo sapiens
tctctctgtcttcatggacttccctcatcacactgatgtaaatagagaggcttaatactgtgttttcatgtcagctggggctagagtcttcaccattgtggttcttactcagagttgtctggttatttgtgcttactggttcttcttctccttttattttagatacagaaggtccatgtacagatttgttacatgaaaatattgcatgaggctggggtttggagtacagatcctgtcacctagttagtatagtacccaataggtagttgtttttaacccacccccacg

SEQ ID NO: 20927 - DNA, 455 bp, Homo sapiens
  misc_feature 395: k=g or t
  misc_feature 419: k=g or t
tgactttaaggagttgttcatatagactccaaatatttttcctaacttattatttgcttcttattctaaatattatttctatttttaaattggtaatagaccatcttccctgtaccctctagatctttaatggaatagctaagcatatatcttctcccatcctcctttaagacttgagtaggcaatgtaaggactagaactgtgtcctgctcactattgcaccttccttgaggggcacagagcctgaaacataaagggcattttcaagtatttctttttaaaaattttcttatagagacaggatatctctatgtcacccaggctggtcttgagcttctggcctcaagtagtcccctgccttaacctcccaaagcactggattataggcatgagckaccatgcctcgcctaaaagtagtktttaaattggtgaattaatttccacagtctaccaaa

SEQ ID NO: 20928 - DNA, 154 bp, Homo sapiens
ctcaaactcccgcgcttaggccatccgcctgcctcagcctcccaaagtgccaccatgcccagtctaactttttaaacctttagtattgtttgaatttttataactatgcaatacatttgtaatcaacacacacacacacacacacacacacacg

SEQ ID NO: 20929 - DNA, 91 bp, Homo sapiens
aaagactatactttcagggatcatttctatagtgtgttactagagaagtttctctgaacgtgtagagcaccgaaaaccacgaggaagagag

SEQ ID NO: 20930 - DNA, 291 bp, Homo sapiens
  misc_feature 78: r=a or g
aaaagggaactccctgaccccttgcgcttcccaagtgaggcaatgccttgccctgcttcggctcgcgcacggtgcgcrcacccactgacctgcccccactgtctggcactccctagtgagatgaacccggtacctcagatgcaaatccagaaatcacccgtcttctgcgtcgctcacgctgggagctgtagaccggagctgttcctattcggccatcttggctcctccaaaaaataccagtcttcgattagatattacttcttctgaacaatcttccttgatgacccatac

SEQ ID NO: 20931 - DNA, 248 bp, Homo sapiens
  misc_feature 8: s=g or c
  misc_feature 10: d=a or g or t
  misc_feature 11: s=g or c
  misc_feature 19: b=c or g or t
  misc_feature 41: m=a or c
  misc_feature 236: k=g or t
  misc_feature 238: s=g or c
gggggtgsgdsggcggccbtgggataggggctgtggcagtmcgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgggtaggaaagtgagactctgtcgttgtacaaaaaataaatgagtkasgcaaggtggt

SEQ ID NO: 20932 - DNA, 123 bp, Homo sapiens
agacccacgcacattatggagggtcacccttcgctttatgcaaagtcccctgacttaaatgttagccttgaaacccacccaattgtcccacagaccatttttttgacaaacttagaaactgac

SEQ ID NO: 20933 - DNA, 93 bp, Homo sapiens
aagactatactttcagggatcatttctatagtgtgttactagagaagtttctctgaacgtgtagagcaccgaaaaccacgaggaagagaggtc

SEQ ID NO: 20934 - DNA, 142 bp, Homo sapiens
aagtttgggaaaccaacttatttttgacccatccatctattaagagaatggttctttggaggtccagcttaatacaagcaggatagccagtaagaatccccactttggggaatcgcggcttctgtcctctcacccctcgacc

SEQ ID NO: 20935 - DNA, 174 bp, Homo sapiens
aaatccagagcggcgggcactgacgggcacttgcaccgtgtggacagactctccggttctggggaaatccagtccctgttactccattttggccagaaattcaagacatttcaggtggcagaataaattcaatccttgtttctccatcttatcgagtagtagaagttagttaca

SEQ ID NO: 20936 - DNA, 351 bp, Homo sapiens
  misc_feature 314: k=g or t
tcaaaaatgaaatacaaggctgggcgtgttcactcatgcctgtaggcccagcactttgggaggctgaggcgggcggatcacctgaggtcaggagttcgagaccagcctggccaacatggtgaaacccctctctgctaagaacataaaaattagctgggcatggtgttgcacgcctataatcccagctattggggaggctgaggcagaagaattgcttgaacccgggaggcggaggttgcagtgagccaagattgtgcctacattccaacctgggcgacagagcaagactctgtctcaaaaaaaaatagtaagtkgtgtaaagaaaaatattaattatataatatggcagaa

SEQ ID NO: 20937 - DNA, 128 bp, Homo sapiens
cgattttctttgaaccttcagcaaaggtatctgcgctcctaaaaaacaacaggaatgtggcactggcctttagccaggggaggctcagccagcaggataaaatttcagggcagatttacgggaagcac

SEQ ID NO: 20938 - DNA, 204 bp, Homo sapiens
gtcaaaaagactggcatcagaacccattttgatttctaggttctatgcagagaccatgtgatgaataatgttaaatgcagtacaccatacctgcttgagctgttgtgctaaatgggtagtagatgaagatgtgtcttgcttgaataatctttcttggatggcctttgtatttggagtaataatgggggttctgtggggtgtgct

SEQ ID NO: 20939 - DNA, 452 bp, Homo sapiens
  misc_feature 9: w=a or t
  misc_feature 10: k=g or t
  misc_feature 11: k=g or t
aaactgggwkkcagaggttgcagtgattcgatattgtgccacagcactccagccagggcgacagaacaagactccatctcaagaaaaaaaatactatctaacaggaacaacatctagaatgaatgaatgagccaatgagtccttcgatcctggcactgtgctaaagcaccagcctcaccgaaatgaataagccactccaggacaggagacaccccagccacccagaatctcatagcgcagtgccagacaagcagtgagaaggcatgggcgggcagcactcaggcagggaggctggcacttgtgcctgtcctcaggttgttccttcctctgggagctgcatccaccttgctagccccatggggcattgctagcccttctaagggctggaccaagcctggacaaaccctcctttccttgaatctcccaagcacagccagaatgagctagagctt

SEQ ID NO: 20940 - DNA, 219 bp, Homo sapiens
ctccacccccagccctgcccctccacacctcgccccaagagcagccagagagatgtcctgccgacaacccaccccaacacagtgttccctactcccaaacgacaaccgtgtctctacgaggggaggggacagtgctgggcgccaccgccaagtccctcaggtggctctgagtgcaagtctgccccaatgctcccttggactcctcataaacccccgcct

SEQ ID NO: 20941 - DNA, 174 bp, Homo sapiens
gagctggggcagttggaaaccacatccctgtgagtgctgattacagcctactaaggaaaatgagatttttatctcacaggaattcagttataaaaataaaatacagcgtctggcttgattcagctaaatgtacaagcactagggtgtttttaatttaacagagaagctggcacg

SEQ ID NO: 20942 - DNA, 424 bp, Homo sapiens
gctcttggggccggaagttaaggcgttcgcggcgtgtgaatccagggcctgaaaacccagaatgaacttgtgtccatcccagagatcactgcagatgtcatgaggtaccctttgtgtcaccagctcaagcaggcctctggccactttatcatctgtggtggtcctgtgccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtc

SEQ ID NO: 20943 - DNA, 273 bp, Homo sapiens
gcctagaatatgataatgaatatatgtacatttacttaaggttttgcaaacacggagagactatagtttatatatacagtgtatttttaaggtaagatcttaaagtgtccttgcatttaaaacaaaaaccactattattattattattattattattattattattgtggttcttttagaaatttcctctcagagtgttttatatgattaggggcattcagattgtttttaacttttttctcgtcatgtgaaacaactcttcctaaggtacaa

SEQ ID NO: 20944 - DNA, 257 bp, Homo sapiens
gaataaatacatatatcaataagcatttaatgtattttgtcttagattttatatgaaataataaaaagtaagcaaaccaatagcaaggtaatttcaccctgattgattcaaactgaaaaaatattaacatttctccattggaagttggattcatggattggcctcatgctgcattcaaggcactttagccaggacccaacactcattgccaagagtcatcaggctagaagtttgcttttaagatgttccccggccgt

SEQ ID NO: 20945 - DNA, 250 bp, Homo sapiens
  misc_feature 80: n=a, g, c or t
cattgcccagactgttctcaaactcctggactcaagccatctcctgcctgggcctcccaaagtgattacaggcgtgagcnaccgcgcctggccactatttcttttttcctttagacagagtgtcactctgtctcccaggctggagtgcagtggtacgatcttggctcactgcaaccacagcctcctgggttcaagtgattctcctgactcagcctctcgagtagctgagactacaggtgcccaccacaac

SEQ ID NO: 20946 - DNA, 159 bp, Homo sapiens
  misc_feature 54: r=a or g
  misc_feature 55: r=a or g
cccaaaaataggagaaaaattcttaattttcaagcctaaaatattaacattttrrcatttatttttctatgtatgaagaaatgtttttataaaaatgagatcataacaacatactgttttgtaatctgcttttttcattcaaaaaatacattgtggccc

SEQ ID NO: 20947 - DNA, 96 bp, Homo sapiens
  misc_feature 13: m=a or c
caaaaagtatgamttgtttatttctggaattttccatttattttcagacattggataactctggataatgagagactattgtacatgaaacagact

SEQ ID NO: 20948 - DNA, 214 bp, Homo sapiens
actgcctccgcctcccgagttcaagcgattctgctgcctcagcctcctgagtagctgggattacaggtgcctgccacctacacccagctaatttttgtagttttagtagagatggggttttgccatgttggccaggctagtctcaaactcctgaccttttgatctgccctcctcagcctcccaaagtgctgggactatagacgtgagccgccct

SEQ ID NO: 20949 - DNA, 79 bp, Homo sapiens
  misc_feature 10: m=a or c
  misc_feature 11: w=a or t
  misc_feature 20: k=g or t
  misc_feature 31: k=g or t
  misc_feature 32: k=g or t
  misc_feature 33: r=a or g
aagactatamwttcagggakcatttctatakkrtgttactagagaagtttctctgaacgtgtagagcaccgaaaaccac

SEQ ID NO: 20950 - DNA, 67 bp, Homo sapiens
taataaaaattcaaaaattagccaggcatggtggcagccgcctataatcccagctattcagggaggc

SEQ ID NO: 20951 - DNA, 82 bp, Homo sapiens
aagactatactttcagggatcatttctatagtgtgttactagagaagtttctctgaacgtgtagagcaccgaaaaccacgag

SEQ ID NO: 20952 - DNA, 161 bp, Homo sapiens
caatggatgctaaatccactgggtaaaagattgatgggaaactttgcagcagaaggatgaggctaacaacacctaaagccactgattaaccttaaggtcactaaaaggtagggcggcccgaccctatgggcctccttctctggtgcaccaggaaggactac

SEQ ID NO: 20953 - DNA, 175 bp, Homo sapiens
  misc_feature 10: b=c or g or t
  misc_feature 32: d=a or g or t
  misc_feature 33: k=g or t
agctccagabctgcacccactttgcaccaggdkatagaagcagagccaccttctggcatggaaggccttggctgaactgtcttaacgttaaatgctataggatcctccgtctctttagggcaccaggagccctggagaaagacacagcccccagggctcaccccattcccaggcc

SEQ ID NO: 20954 - DNA, 148 bp, Homo sapiens
atttaagccacacagacatttctgcattagtagtccataaacaagaaataaaaaggcagtgtagttgagggagaagaaggtaaagaggtaagatgttatgacaggacaggttttcaagtgctttgctttgcattggaaggagggtgcg

SEQ ID NO: 20955 - DNA, 81 bp, Homo sapiens
  misc_feature 12: m=a or c
atacaagaaggmgcgacagagagctgactgataacctgcatgtaccttatatgaagggcaaccagatgtttgaggaggcgg

SEQ ID NO: 20956 - DNA, 325 bp, Homo sapiens
  misc_feature 17: k=g or t
  misc_feature 28: s=g or c
  misc_feature 32: y=c or t
  misc_feature 57: s=g or c
  misc_feature 114: b=c or g or t
  misc_feature 115: w=a or t
  misc_feature 172: k=g or t
  misc_feature 192: k=g or t
gttgaggaccgagagckttgaggttttsatayctgatgatgtccaggaacccttctsagtaggcactgaagaccatcagcagaatcacagaccccaggagagatgtcgtcagabwgacacagaggcatcaccgaattaaagtgaaaatgaagaaaggagctgagcatctgtktcatgactttcgtggctgtkttactaaagaggctatcctggcccagtcagggcacgctatcatcaccaactacttgttgaactacgttcagggtcttgatcttgaaggagggacgcgttcgggttgaaagccgccatgcagggtcgaacggat

SEQ ID NO: 20957 - DNA, 162 bp, Homo sapiens
ctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaa

SEQ ID NO: 20958 - DNA, 231 bp, Homo sapiens
caggtaaaaagccaaaagcaaggatcaccttaaagaggaagagatgtcagggatgagctcagaggaaaatagggattccccagcctcggaggcatgagtcagtggggagcctcgttgtgaaacgcggattcgttcaagggatgaggtggtttggggtgtttggacctccacagctcacattcattcactgattcaggcattccatcagttctttgtttttttttttttttt

SEQ ID NO: 20959 - DNA, 442 bp, Homo sapiens
  misc_feature 299: m=a or c
  misc_feature 300: w=a or t
  misc_feature 301: w=a or t
  misc_feature 316: k=g or t
  misc_feature 317: b=c or g or t
  misc_feature 318: b=c or g or t
  misc_feature 320: y=c or t
ttggatgcagttccttcttgctctcacttccgattcctctgctgtgcttcctgggatgactttccaaataaaccacttgcactcaaattcttgtcttgggcctacatctgagggaactcaactcacaacacatatgctatggtttgaatgttagtgtcccttccaaaacccatgttgaaacctaatccacaatgcaacagtattaagaagtgtggtctttcggaggcaattcatgaggactctgacctcatgaatggaattagcacccatataaaaaggcaccaggctgtagggagcamwwtcttgcctttctgckbbcyggtatgtgaggacacagcaatgaggcaccatctgggaaacaaagcagcctttatcagatgccaatgttggtgtcttgattgtggatgttccagcctctaaatttctgttctttttttttttt

SEQ ID NO: 20960 - DNA, 212 bp, Homo sapiens
  misc_feature 103: s=g or c
aatttccaccgcggccaattcatggacaggaactaccccagcgccggcttcggggacccgctcggcgccggggcgggatggagttacgagaggtcagcgaaastagcttggtttatggcagctccaggacctcgcaccccgagacggacatcttacaccgccaggcctatgcggccccccacccactgcaaagctatgccaccaaccaccac

SEQ ID NO: 20961 - DNA, 178 bp, Homo sapiens
aggtagtacacactcacctaaagctagagctgtcttcctcctgtctacctcaaggaagacagccttccatgggtctccactgtgctgcagctacttccagaatctgacatgcagtctgaagtcagcctccatgggacagactcagctcatctcccatggttcttccacagcccatgac

SEQ ID NO: 20962 - DNA, 101 bp, Homo sapiens
aacaataatttttgctttgctactcacccccatcaacccccatcttttcctagaattacaacctaataaggctatactcttttctttcttttttttttttt

SEQ ID NO: 20963 - DNA, 442 bp, Homo sapiens
  misc_feature 68: s=g or c
ttcagtcagagtcactatggcggccggcgcttgcaaggtcggaaagtttcctgcctcgtcaggcgcasttgagcttgccccatcggccgcgatcggtgcaggctgcggtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaatttt

SEQ ID NO: 20964 - DNA, 256 bp, Homo sapiens
  misc_feature 96: s=g or c
  misc_feature 100: y=c or t
  misc_feature 140: d=a or g or t
agacccaccggcagacaggcggaccgggcgctcggctgtcgctgttctccgcgcggcgctgcggggcttctgacttggagaacaatgaagcgtgastggyaggggagcgagcgggccgccgggagcgcactgtgtacaadcagaggcggcgtgcgtcctttggaaggaattgggccatgagaagagccctcatgaatgggattagttcccttataagaagagacaccaaggaagtgatctttctctgccctctgca

SEQ ID NO: 20965 - DNA, 391 bp, Homo sapiens
  misc_feature 95: k=g or t
  misc_feature 106: w=a or t
  misc_feature 242: v=a or c or g
  misc_feature 334: m=a or c
  misc_feature 355: m=a or c
cactaggatttttttttttcaccaaaagcagagtgctggatgatattttagatggctgggattttagatcagccatacctgaggcaataagagtkggtcgaatgtwaccaatccttgagcagacacagatgagcagttgcggggtcgttcgctgctggatgtgggctaggagacccctggtttggggattatgaaggcagcctccttttcttccctgggctctggctgctgttttcccagtvatacccatcatggtctgccctgtccaggtgttccatgtggggagtattgatgtggtgcccagcctttgaactgttaacaacaccctgctcamagccagaaatgtgggccccamatctttctttcaactgtatgaatacttcagagggct

SEQ ID NO: 20966 - DNA, 95 bp, Homo sapiens
atctgagggtccagggttcaagtccctgttcgggcgtttgtagttttcgttactttaacctgctaaattatcccatcaagtcccaagagcggacc

SEQ ID NO: 20967 - DNA, 230 bp, Homo sapiens
attttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtg

SEQ ID NO: 20968 - DNA, 196 bp, Homo sapiens
  misc_feature 142: s=g or c
  misc_feature 143: s=g or c
aagccctaatctaaactctgggtgataatgttgtgtcaatgtaggttcactatggtgggggatgttgataactggggaagctttgcctgtgtcagagaaagatacgagaatctgcactttcttctcaattttgctgtgaacssaaaactactctaaaaatgagctctttaaaaacataacttcctcccctgcccgc

SEQ ID NO: 20969 - DNA, 290 bp, Homo sapiens
aaacttgtaaattaaggcgaagacccagtgttccctgggacagttgcaaagtgagaagagctcagaaactgaagcacagaaacgttaggtaggagtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacagtttgtacaatgacgacagaaacctgcttcgaattagagagaaggaaaggga

SEQ ID NO: 20970 - DNA, 376 bp, Homo sapiens
  misc_feature 33: r=a or g
acagagaaagagaaagaaagaaagaaagaaagrgagaaagaaacaaagaaagaaagaaagaggaaagaaagaaagaggaaagaaaagaaagaggaaagaaaagaaaagaaagagacaaagaaattcctcccctgactcttgctttgcttatgcaatctccattcaatttggctagtacattcatccctggacatgcctgtgtggctttctccaacctccaacacaaatcccaggggtgaacaagtaagaccttccatgatctctgcttctctgaaaggagaaggttggaatttatgtaacctagagagaactgaaatgaccttggaatcttccagtttgcagtttgtacagcctacctttaagtttcgtgggctct

SEQ ID NO: 20971 - DNA, 132 bp, Homo sapiens
catgctaaccgccatgcatttccacttcgcaagtgcctagcccagtgcagggctcacagctcagcacggagcctccacattcctggtgggaccgatgctgtgcagcatcctcagaaaccgtccctccccacc

SEQ ID NO: 20972 - DNA, 101 bp, Homo sapiens
agtatttcttactgttagttgtccatttgtgctgctataacaaattaacagattgggtgatataaataaaataaatttatttcttgaagttctgaaggccg

SEQ ID NO: 20973 - DNA, 119 bp, Homo sapiens
  misc_feature 33: y=c or t
aaaggagtcgcgccgccgccgccgccccctccytccggtgggcccgggaggtagagaaagtcagtgccacagcccgaccgcgctgctctgagccctgggcacgcggaacgggagggagt

SEQ ID NO: 20974 - DNA, 191 bp, Homo sapiens
ctacccagagccaacttctactcataaaacccgccctactctccttttcatttatttatttatttctatttatttatttattttgagacagggtcttgctctgtcgcccaggctggaatgcagtggcatgttcatagctcattgcagccttgaactcctgggttcaagccatcctcccgccccagcctcct

SEQ ID NO: 20975 - DNA, 273 bp, Homo sapiens
tttgctccttattttatcttaattagtccctgtagaaaggattgatttttgagaggcttgtagtgaacatctgttggtattcctggggtcattcttagcctgtcctgtgtttgacatttcttgtaaaagtggaggcatttgttcatattgacattagctgcctctgtatctctcggtggtacagatggtctgtgaataaagacatcaagctaataggcaagatgacaagcttcaatggagccaaggctcctcacacttaaatggcagggcagc

SEQ ID NO: 20976 - DNA, 134 bp, Homo sapiens
tatttgacttatgagaagttcaggcttgaatattatactttgcatttttgctttagctttttctagtaatatacaataaaggcactattcctgtaaaatcttatttctatgataatcataatccaaggccgcga

SEQ ID NO: 20977 - DNA, 146 bp, Homo sapiens
gtgttgcggtcggaccccatgcgaaggagctaaggacacaaaggtccgccacgtaattggccgccgccacagctagccaccctctccccagactggcccgaagagaggaaaagtgtggaagtccacaagccgcccccgccccgccc

SEQ ID NO: 20978 - DNA, 112 bp, Homo sapiens
caccacgcctggctaatttttttttgtatttttagtagcgatggggtttcaccatgttagccaggatgatctcaatctcctgacctcctgatccgcccgcctcggcctccca

SEQ ID NO: 20979 - DNA, 385 bp, Homo sapiens
  misc_feature 330: y=c or t
  misc_feature 331: n=a, g, c or t
agatattggcaattttcaatctaatcgtatttattgagcccctccatgtcccctgcacgtttccagtgctgaatattgtgaaaggaaattaaatcttgagaccccaaactcattaagccaaagggagaagtcaagctggggcctggatcacgcaaacctccctcccccttttggctcctaaataagatggctacaaggtgaaaagctacatgcctcccctgtattttgcccacaaggaaattcttagtgagctgcaagatcttttaaggtgtttctgttaacatttcaccatgacaacgtaaattcaaagcttatcattacagacgcagynaccccccgcccaccagacacaaatgcatatgggattgttttgctgccccatttt

SEQ ID NO: 20980 - DNA, 204 bp, Homo sapiens
aggtgtctgccctgcttatgggattgtgcagttgacctgagcagaggatggagctcactcctctttaaaccaagggccctgagccatggctcttcccgggatccaccttctctcaggctcaacttgccctggaccctgttcctgtggatccttgaggagccctcctgggcctgtgactgataaacccctccccctgccgcccca

SEQ ID NO: 20981 - DNA, 194 bp, Homo sapiens
ctcgttaaccgcagtaaaaccctgtttactgtcagccactcaggcaccatactgggaacctgtttgctgtgagccactcatccaccacagtgggaagcagttcactgtcacccactctttcatctctgttagaacatgttcactgtcaaccactcatacctcacagtgaaaacctgttcactgtcacccacgca

SEQ ID NO: 20982 - DNA, 102 bp, Homo sapiens
aacctgccttggcctctcaaagtgttgggattacaggcatgagccactgcgcccagccaatgcattcatttctgtaaaaaaaaaaaaaaaaaaaaaaaaaaa

SEQ ID NO: 20983 - DNA, 259 bp, Homo sapiens
atttctgccttcatttcgttttgtacccagtagtcattcaggagcaggttgttcagtttccatgtagttgagcagttttgagtgagattcttaatcctgagttctagtttgattgcactgtggtcttagagacagtttgttataatttctgttattttacatttgctgaggagagctttacttccaagtatgtggtcaattttggaataggtgtggtgtggtgctgaaaaaatgtatattctgttgatttggggaggag

SEQ ID NO: 20984 - DNA, 125 bp, Homo sapiens
tttttttttaaaaactgctccttgtggagcaggactaccccataggcagtgtacccacaatagatagccttttgttgttgttgttgttgagacaaggtctcgctgttgcccaggctagagcgctg

SEQ ID NO: 20985 - DNA, 144 bp, Homo sapiens
tttataggcatgaatcttggtgtctggcccataatgtactttaaggtggttttaatggtagtagatgccaaacccaggcttagggaaatcatatagattcagtgtcttctctcagaactggatgggggccttgtgcttagatta

SEQ ID NO: 20986 - DNA, 331 bp, Homo sapiens
  misc_feature 227: r=a or g
  misc_feature 232: r=a or g
  misc_feature 311: v=a or c or g
  misc_feature 312: n=a, g, c or t
  misc_feature 313: k=g or t
ctgtccacataagaaaattatgtaaaaataattaatgtctattataatttatttaaccaaagaaaaagtataatttaaagatgactctttaaggatcaaattgcaacaattggtaaaagtagatattagtcatatttattaagtgacacacagtaatactgaaggcacttatttctcaagaaacatcattttttccaaaaaagaacatactacatcctaaacatgaratgaraataagctttaattttcaccacaggagggcgacagtcagagaactgaggtagtacagatccattagaggaccatatccvnkagtctatcagtctctact

SEQ ID NO: 20987 - DNA, 266 bp, Homo sapiens
agactgattggcatcacatgttgtcctcataaatcatagctattgattttacatttgttttagctcttccaattgtatgcccccttgtatcataatttatcctgaaagccagcctctgagtcggtgctgaaactgagcctggagggtggtttctttccactcaaactaatctatatgtgaaagagatgagctttcaaacacagaaccacacccctcttgctttttatgacattaccctggtatttcccatggagataatggatgct

SEQ ID NO: 20988 - DNA, 303 bp, Homo sapiens
caagtttatataacataatagtttcaagggttttgccacttaattatactaagttacttaacctctcaatgccttatctgtagattttgtttttgatagggtgggatagtaatagtaactacaaggtttcacaaggttgtgaaattgaatgagaaatacatggcactttaacaagtggcaggatagttcagacggtttcacaaggttgtgaaattgaatgagaaatacatggcactttaacaagtcactatggattatttaatttcttttcttcttcttctgctgctgcttctccctgcccgg

SEQ ID NO: 20989 - DNA, 468 bp, Homo sapiens
  misc_feature 112: s=g or c
  misc_feature 329: m=a or c
  misc_feature 330: n=a, g, c or t
  misc_feature 336: w=a or t
  misc_feature 337: r=a or g
  misc_feature 431: n=a, g, c or t
tttttggtagagatggggtttcgccatgttggccaagttggtctcaaactcccaacctcaagtgatctgcctgccttggcttctcaaagtgctgggatggcaggcgtgagcsaccgtgcccagtacagtcagggaatttctaagcatcagttttctcaggtagaaaatggagaggatattgtcacctcccaggaacattaaatatgcagacacagagaaagccctgagcccaggccctggcacacagcaagtacccacagagccagctcagggcagcacatctcggggagaaggccagccacggtgtccctgcagtgacctcctggagmngggccwraccccacctcaatctctgccgaagactcaacccaggagggttctgtttgggctcaaaaaagatcataaacgacatggaagccactgagtgtgtncagagcccacctgaatcatgacatgccagtgagcctt

SEQ ID NO: 20990 - DNA, 320 bp, Homo sapiens
accgaaccgaggagagctgctgaagaagtagtagccctgctccttttcccttgtcttgttgggtcagatccttcccggggatgatgcagattggctgacagactccgctggagacttcgcagtgacaaagcagccgaggattaaccctgctcctgggtcctacgtctgtccagggagctgagcggggcgctcctcaggtctccttcctagttttcctcccagagtcgctccacacgagtgctgggcgcctactacgtgctgggcgtggggtcaaagtgacccagagttcgcgcccgtgccccccaacattaaagcaggac

SEQ ID NO: 20991 - DNA, 293 bp, Homo sapiens
gggtaggcatgggcggccaggatttgctggttctccgacgggaggggtgacaacgagagcgaggccgtgctgattctgaagggagtgcggaggaggcaggaccctggtagcctcggcaccttcagcccggagtctgaaaaaggggagcgcggagaggaggctggaagaggaagatgcctagcacagaccttctgatgttgaaggcctttgagccctacttagagattttggaattatactccacaaaagccaagaattatgtaaatggacattgcaccaagtatgagccctca

SEQ ID NO: 20992 - DNA, 376 bp, Homo sapiens
  misc_feature 10: n=a, g, c or t
  misc_feature 343: w=a or t
catttaatangaacctaacaagtgtagcatgattgatagctttaatagtcccaattctggcagcacgtggtggcttacgcctgtaattctagcactttgggatgccgaggtgggcggatcacctaaggtcaggagttcaagaccagcctgaccaacatggagaaaccccgtctctactaaaaatacaaaattagctgggcgtggtggtgtatgcctgtaatcccagctactcgggaggctgaggcaggagaatcgcttgaacacaggaggcagaagttgcggtgagccaagattgcactccagcccgggcaagaaaagtgaaactctgtctcaaaagaaagawaaaaaaaaatggtcccgattccttacccctccc

SEQ ID NO: 20993 - DNA, 193 bp, Homo sapiens
  misc_feature 32: s=g or c
  misc_feature 33: k=g or t
  misc_feature 34: w=a or t
agtcgacggtaagaggaccctgctttacccaskwcaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatct

SEQ ID NO: 20994 - DNA, 476 bp, Homo sapiens
  misc_feature 113: s=g or c
  misc_feature 114: s=g or c
  misc_feature 412: m=a or c
  misc_feature 414: w=a or t
  misc_feature 425: r=a or g
gtatttctagtagagacggggtttctccatagtggtcaggctggtctcgaactcccaagctcaggtgatccgcctgccttggcctcccaaagtgctgggattacaggcgtgassactgcgcccggccatgcttatatctttaatccaaccatatactatttttgtgaatgatggaagtaaggctcccctcaagttaatttttctccaatctggcttgcaggaaaggggtttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcmtwgctccggagaraccggtacgatcccagagacaagcactgaacataaggcaccggcgccgcgc

SEQ ID NO: 20995 - DNA, 216 bp, Homo sapiens
gaaatgcccctagtggagtgatatcccaagatcacaagcatacttagaagatgggaagagcacaaattctttatatctccatttctgtttttgtggagggctagttagttcactgggccctaaggactatttatagctataatcaaaatagaatcaaaggagaggtgtagttctccacagaagagaatgaccctttttatttagatcagaccccag

SEQ ID NO: 20996 - DNA, 387 bp, Homo sapiens
tccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttcc

SEQ ID NO: 20997 - DNA, 342 bp, Homo sapiens
agatgtgaaaaacaagacccagagaggggaaatcatttgaatcctgtcctggtattgctttgtgttcctggatttggagaatttctgggaacacaggaaaaggaaaggtaggtaggtgttgggggaggaaagtcaagggaagaaggtatgcaggatattattctccattgcttgaagtctcaagtttctatcccctgtcttagaagcaacttaggggagtcatggacaggttcagcttctatggagcactattagggggacatttcctctatacagcttgttccagagatcatcttatccattctcttgcttccaagtacacaaatcccctacagccccgat

SEQ ID NO: 20998 - DNA, 127 bp, Homo sapiens
  misc_feature 21: v=a or c or g
  misc_feature 22: s=g or c
  misc_feature 29: n=a, g, c or t
  misc_feature 30: m=a or c
caaagactcaggggttacctvsatgtgcnmtttttagggaagctgttggagaaaatactccagcaaaatgaaggagtacacaaaccagagaatgacatgaatccagcaaataggatccaacacaggc

SEQ ID NO: 20999 - DNA, 169 bp, Homo sapiens
  misc_feature 29: s=g or c
aggcgggagccggtaagcccagcgcggascggccgcggccccctgttgtgttgctgcggagaggcgcagtcatgcaggaaaacctcagatttgcttcatcaggagatgatattaaaatatgggatgcttcatctatgacattggtggataaattcaacccacacacttc

SEQ ID NO: 21000 - DNA, 164 bp, Homo sapiens
  misc_feature 120: s=g or c
  misc_feature 121: r=a or g
  misc_feature 127: r=a or g
atagctgggtgtggtggcgggccaccagctagggaggctgagacatgagaattgcttgaacctggaagggggtcggagaggcagagattgcagtgaactgagatggcgccactgcactgsracctgrgtgacacagcaagactctgtctcaaaaaaaaaaaaaa

SEQ ID NO: 21001 - DNA, 191 bp, Homo sapiens
  misc_feature 127: w=a or t
  misc_feature 152: n=a, g, c or t
gatttgcatttctctgatggccagtgatgatgagcattttttcatgtgtctgttggctgcataaatgtcttcttttgagaagtgtctgttcatatccttcacccactttttgatggggttgtttgtwtttttcttgtaaatttgtatgagtnctttgtagattctggatattagccctttgtcagatgaga

SEQ ID NO: 21002 - DNA, 216 bp, Homo sapiens
cacatttggcctaaaaatgatactttatgttataataatattttataattgaatttattctgtaaaaaaatagaaaagaaaaatagaaaaaggtcccttagacatgggctcttatgaccctttactggctcatgttattgcctggccccaagaagccacatttaagatatctcctcctagatgctccccctaaaaggcctacacccccgcccccat

SEQ ID NO: 21003 - DNA, 334 bp, Homo sapiens
gatttagaactcaacttcagaactatactcactgtcctgcaaatcacttaagagaagaatgtatttgaccttaaaaacaaatacaaataactggtacaagttgatcacagagacgttctccaagaccctatcaaggggcccgataccccttgcaggccatttgggtactgtttactacatagttcctggaaagcgcatgccttctctacacctaagggacaacaggacagccacaagaatgtaaaagaaaggctgcgttaagagggcatttaattgacctatgtcctttgccccatctcatttcggcaagaggacaaggacagcagggggcagc

SEQ ID NO: 21004 - DNA, 431 bp, Homo sapiens
  misc_feature 255: s=g or c
  misc_feature 256: v=a or c or g
  misc_feature 383: r=a or g
tggtgtgggtttttttgttcttgcgatagtttactgagaatgatgatttccaatttcatccatgtccctacaaaggacatgaactcatcattttttatggctgcatagtattccatggtgtatatgtgccacattttcttaatccagtctatcactgttggacatttgggttggttccaagtctttgctattgtgaataatgccacaataaacatacgtgtggcatgtgtctttatagcagcatgatttatagtsvtttgggtatatacccagtaatgggatggctgggtcaaatggtatttctagttctagatccctgaggaatcgccacactgacttccacaatgcttgaactagtttacagtcccaccaacagtgtaaarctgttcctatttctccacatcctctccagcacctgttgtttcctgact

SEQ ID NO: 21005 - DNA, 176 bp, Homo sapiens
catacccccccaaaaacctgaggtaaggaactttctgccaggcctcaccaagatttttctctacagagcatccttgtgatgagcataggtgattgctctctgctctcaccatctgcaacatacctgcccctcttttgtctctactccatcttctccccatgtgattgatcccttaa

SEQ ID NO: 21006 - DNA, 173 bp, Homo sapiens
attcacagaaacgctggctcgctcgctagccttttcattcacacaaacagcatttcattacattttgcggtttttgtctgcatctaatgaagatctcgctttgggaatgatagggctgtttcgctacagatctggggaggactctgataaccatcaaaatcatctatggggat

SEQ ID NO: 21007 - DNA, 236 bp, Homo sapiens
  misc_feature 154: s=g or c
actccgtcggcggcggcggcggcgcgatgctgtgcttcctgaggggaatggctttcgtcccttcctcttggtgacctggtcgtcagccgccttcattatctcctacgtggtcgccgtgctctccgggcacgtcaaccccttcctcccgtatatsagtgatacgggaacaacacctccagagagtggtatttttggatttatgataaacttctctgcatttcttggtgcagccacga

SEQ ID NO: 21008 - DNA, 157 bp, Homo sapiens
  misc_feature 143: y=c or t
gtacctgcgccaccacgcccagctaatttttgtatttttagtagagatggggtttcaccatgttggccagatgggctcgatctcttgacctcatgatctgcctgcctcggcctcccacagtgctgggattacaggcgtgagcyactgtgcccggcct

SEQ ID NO: 21009 - DNA, 176 bp, Homo sapiens
cttcatcctgtgaatgtgacaccgacaaaattcctagaaaaaatatgagcaacacttgggcaagtgaaactgagaagtcatagctcttgacatgctaattgatttccatgcttattattagcaggtcaccagccgacaggaggtcaagctttttttcagttgcttttttttttttt

SEQ ID NO: 21010 - DNA, 166 bp, Homo sapiens
accatgtccggccattttattatttttttttaaatagagatgggggtctcgccgtgttgaccaggctggtcctgaactcctgggctcaagcaatgctcctgcctcagactcccaagtagctagggctaaaggcacaaaccaccatgccctgctagttaaaaaaaat

SEQ ID NO: 21011 - DNA, 394 bp, Homo sapiens
  misc_feature 116: s=g or c
  misc_feature 282: k=g or t
  misc_feature 375: m=a or c
attcactcatttattcctcacaatgacccttcaggcgggtactattatcattcccattttacaggtgaggaaactgaggcccaaaatcacaaaactgataagtagcagagacagascctgaacttggaccatcaggtgactcctgcagtggtgaccctcaaggcagccaggccacaccagcctcacagagaggacacagatttgaatcacagtcctgacactgcaggtaaccaaacactgtttttagcagccttcctttccttcataagggctaagcttgtkaaccttttatattacctttctcctggaaaagtatcgacagtgtttaagccttgcttccattgagaccaaaaatgaactgacattagctgctamagcttacctcacctacacc

SEQ ID NO: 21012 - DNA, 172 bp, Homo sapiens
  misc_feature 32: k=g or t
  misc_feature 33: h=a or c or t
  misc_feature 54: s=g or c
  misc_feature 58: y=c or t
  misc_feature 130: d=a or g or t
agagcgacctcggggaagcgtgtggtgcgggkhagtcgcccccgggcggcgaasagcyattatgcaggccttgcattgaaaggctctagttacagtggacttcttgaacgacatcatattcacaccaaadatgtagaacatattatagatagtttacggaatgagggagtgt

SEQ ID NO: 21013 - DNA, 76 bp, Homo sapiens
  misc_feature 73: n=a, g, c or t
agttcctgctctaggctgcgagcggctggcggcttcgaggggagctgaggcgcggaggggctcggcggcagcngcg

SEQ ID NO: 21014 - DNA, 221 bp, Homo sapiens
tgcaaacacgaatggagatgaggttataaagcctgaccattttgacccacctgagaggattctgacaggtccttccagtgcctgagaaacccagggctcacatgctttatattctgatcattctgtaggggttgttcccatgggtgatagaagctgccaaatataaagaggcaaccatgcaaatttttaggaattatttccaaaactctcataacaacatc

SEQ ID NO: 21015 - DNA, 171 bp, Homo sapiens
ttcttaatcttggtggaggatgtacaaagtgcggttcagagaaaagaattggcaacaacagcaagagacttggtgttagtctcagtttaattacaatacaaggaagagttgagtaatttgccgcatctcaagaccttgtatctcagttttctttttttttttttttttttt

SEQ ID NO: 21016 - DNA, 84 bp, Homo sapiens
gcgtaaatgaagcccagaaagtgtaggtggcagagttccagaaagcttttcaaaaagtaagaagctaaccttccaaagccggcc

SEQ ID NO: 21017 - DNA, 174 bp, Homo sapiens
tgcttccaatgtggcccgagtctgtttacccttgtctagtcctcagaagagatgaggaataatcttctgtgtaataatcactcttcttatgcctggtgctggtgattaagtcacttcttagccttttcttttttgggctagatcttaacttcattttccacccagttaatcttt

SEQ ID NO: 21018 - DNA, 304 bp, Homo sapiens
aaggcaacaggaagggccttcaaaccacagtgtggctctaatacccacaaaaagagagagggaaagagccagagaaataaaatcctaagcccctcaactgaccaaatggaccacctcttggcctaggggacccccgagaaaccttaaaaatggagttcccggacatgatggaacaggaggttggacaggcctcattatgccccctccccccctaaccattaggctttcttctctaagggttaaacagaaaccactgcttcacgctggtaccaaccaactgcctaacacagcccctcccccatcc

SEQ ID NO: 21019 - DNA, 464 bp, Homo sapiens
  misc_feature 20: s=g or c
  misc_feature 21: s=g or c
  misc_feature 104: r=a or g
  misc_feature 261: n=a, g, c or t
  misc_feature 262: n=a, g, c or t
  misc_feature 391: k=g or t
aatcctagagaagtacattssttttgctagcacatggagactatgatatcataaaagtaagcctgccattacaactgtttttatttgacttcaaagataaagaragaaacagcaagcaataatacccaggctgacgtgaaaaaactcctccacgccaagaagcccttaatgtgctcaattaggccctcgggcacctccacttgccaccttcaagagctcctccagttgtgctgcaaataatatatttgatcatggactagnnacaggaagtgctcatacacaaagacactacttgctcataccagtttctggctgaaggtcttcttatttgaaaacatagggataaagctcacacttagcagatgtgggacttctttcaaagatgtgtgtkacagaatcagaagcaaattttacttttaaaagtgatataagccaagtggggaggatcgcttggggctaggagt

SEQ ID NO: 21020 - DNA, 444 bp, Homo sapiens
cattttatggcagacctaagtcttaatatggcaggtcctcaattctggaaagttgtactcccaccacaaaaaaacatagttattggggagaaaggaatcattatcatcaatgccatctccattaattgaacatttttgaagcaatcatctgaacatttgttatttgtgcttacaatgattctttgaggaaatactattaccataattttacagatatggaaactgaagtttaggaaggtcaaaacttgtacaagccactcagctggtaacaagtggaggtgggaggtgaacccaggcagtaaaaaccattacaactttattactttttccttaaaaaagaaaagaccataggatgatcttttcaatatggaacaggggagcttttcctccagaagtcctgtatcggggcctttccatctccaccgacttctcatagacaattta

SEQ ID NO: 21021 - DNA, 166 bp, Homo sapiens
tattaacaagcctgttctatagacaaatgcagaatctcttacccaagagattgttattattattattattatcattattttgagagggagtcttgctctgtcgccaggctggagtgcagtggcgcgatctccgctcactataacctccgcctacctccgcctccct

SEQ ID NO: 21022 - DNA, 218 bp, Homo sapiens
catgcctctaatcccagctacttgggaggctgaggcaggagaatcgcttgaacccgggaggcggaggttgtagtgagctgagatcgcaccactctgcagtccagcctgggcgatagagcaagactctgtctcaggttttggacttacttgggaccagctacccctttcttcttgcctattgctcccttttggaatgggaatgtctatcctatgcctgc

SEQ ID NO: 21023 - DNA, 456 bp, Homo sapiens
  misc_feature 310: k=g or t
  misc_feature 344: d=a or g or t
  misc_feature 347: r=a or g
agcgaaggactatggcaggggagaacttcgctacgccgttccacgggcacgtggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagtkattacagatttggtcaaaggcttgctaccaaaadggraccgaaaaagttgatcttctggtgtttaatcccccctatgtagtgactccacctcaagaggtaagaagtcacggaatagaggcagcttgggctggtggcagaaatggtc

SEQ ID NO: 21024 - DNA, 280 bp, Homo sapiens
agacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaaccagc

SEQ ID NO: 21025 - DNA, 152 bp, Homo sapiens
  misc_feature 133: k=g or t
tatggaagaaacaaaactgtcattctttaaaggttagatgattgtatgtatggaaatccaatatcatctataagcagattattagaattaagagtttagcaaatttgcgagctaaaacatcaacatttaagtktttctaagtaccagcacca

SEQ ID NO: 21026 - DNA, 257 bp, Homo sapiens
  misc_feature 222: k=g or t
tacatatgctgtcttacttgttgcaaaaactgggttatgtgatatgcccattttacagaggaaactgtgatcacacagtaagcggtgacgtagaaatctctgtcttctcactccagtttatctatacttttccctgtcctacactagttcccaccacttcaggttcctcaggttttctatttcatccttcctatcaggccacttccctgatttttttgtgtkatggctagagacaatctgtcatagctgagtgccac

SEQ ID NO: 21027 - DNA, 131 bp, Homo sapiens
ttttctgacttgcctttagtaaagaccttagcaatatttgaagcacagttgtctgtaggaaagggtgggtgtttatacttttttaaaaaggagtctatatcatatttatcttgtggtctgccatgccccca

SEQ ID NO: 21028 - DNA, 188 bp, Homo sapiens
aaatctactaaaaatacaaaaaattagccaggcatggtggcgggcacctgtagtctcagctacttgggaggctgaagcaggagaatggcgtgaacccgggagatggagcttgcggtgagccgagatcacgctactgcactccagcctgggggacagagtgagactttgtctcaaaaaaaaaaaaaaaa

SEQ ID NO: 21029 - DNA, 150 bp, Homo sapiens
taagggaataaatggatgcggaaggaaaccacccctcaacccccggtaaaggggggttagtgtgagagagactgcagccttcacgatagtgtgaggcagagatgccaaaactgtcctgggaaatagtgcctctgcgcctccaccccacac

SEQ ID NO: 21030 - DNA, 124 bp, Homo sapiens
agagacagagagggagagagagagcaagagggagagtgtgtgagagagagttagttcaagccaaaatggccgacagagtctctgctggtttctgaatatttaaaatacaaaaaaacagatagac

SEQ ID NO: 21031 - DNA, 118 bp, Homo sapiens
ggaaattcctatcagaactcaacaatgtcagattcacttcaaatattaacattctggccgaaaacaaagaagcaattaagaaagtgttgcctatgttcttctgccaccagccagcatt

SEQ ID NO: 21032 - DNA, 400 bp, Homo sapiens
  misc_feature 352: s=g or c
aagtgatcctcccacctctgccacccgagtatgtgagactacaggcacctgccaccacgctcagctaagtttttgtatttttaatagatgttgcccagtctggtctcactcgtgaactcaagtaattcgcctgcctcagactcccaaaatgctgggattaccggtttgagccaccacgcccagcctatcaatcttcttgattaaacgagaagaaggcagataacctggggagcagggagcagaaatcaggtcaggtcttactgagacgggcagggtcaatctctgtttctggttggaactttgacaaaattctaggggcaagattaccaggagcagatggctgataagcagstgcaggaaatatccagtaattactgaatgttaccttgagtgaaaaata

SEQ ID NO: 21033 - DNA, 437 bp, Homo sapiens
  misc_feature 323: d=a or g or t
  misc_feature 326: w=a or t
  misc_feature 327: n=a, g, c or t
  misc_feature 344: d=a or g or t
  misc_feature 350: k=g or t
ctctctttttaataaactataatcatgagaaagacagctttcctgtgttctgtgagtccttctagtgaatcaccgaacctgagggtagtcttggggactctcaatccactttacttcctaggaagtaacccaaagtttgggtttcctcagggacaatttctattcattgcccatttcccccatgtatggaccacactttccagtttcttttcatgtgtcataatttttggttgaaaactggatattttaaactatataatatggcaattctgaaaatcagatcctccctccttccttccccatggtatgttgttgtttatgtdtgwntttgttgctcttgctcdgtattkattgagtgattttcttgaacaaattctgtaaggtcagtattttttgccatgtgtggcctattaagtctctgctcagcatagtggtca

SEQ ID NO: 21034 - DNA, 365 bp, Homo sapiens
  misc_feature 10: d=a or g or t
  misc_feature 27: m=a or c
  misc_feature 28: m=a or c
  misc_feature 265: r=a or g
  misc_feature 282: y=c or t
gaaggatagdtgagaggtcccactggmmtggtaagctaagctgaggattttagttgtttttcaacaagcaacagaaaatctttgaaaagttttgttgttgttgtttgttttttttttgagatgaagtcttgctctgttgcccaggctggagtgcagtggcacaatctcagctcactgcaacctccacctcccagattcaagcaattctcctgcctcagcctccagagtagctgggactacaggagcacaccaccacacctgactratttttgtaattttttyctttggtagagacagggtttcgccatgttgcccaggctggtcttcaacttctgggctcaaatgatcctcccacctcagccttt

SEQ ID NO: 21035 - DNA, 58 bp, Homo sapiens
catttcgagagatgtaatgttgattgctgctgttttttatgtcagataccgaactcat

SEQ ID NO: 21036 - DNA, 187 bp, Homo sapiens
agtggagatgaaggaagggaattagctatgagcagcttagaagagctaacccgggggtggcttctcaagcagaactcacatgcttacaaaggggcttcaatagatcctttacccttttcacttaacacttttaaaaatggtatcacgctggcctagcgcagtggctcatgcttgtaatcccagcact

SEQ ID NO: 21037 - DNA, 180 bp, Homo sapiens
  misc_feature 10: d=a or g or t
  misc_feature 11: k=g or t
  misc_feature 31: r=a or g
tgcgccaccdkgcccagctcatttttttgtrgttttagtagagatggggtttcaccatgttggccaggctggtctccaacttctgacctcaaatgatctgcccacctcggcctcccaaagtgctgggattacaggtgtgagccaccgcgcctggccagggatgtatcatcttattacaag

SEQ ID NO: 21038 - DNA, 224 bp, Homo sapiens
  misc_feature 10: r=a or g
  misc_feature 33: n=a, g, c or t
aacgtggtgrcctctctgttcacccacagaggngggctgccagatgatatgcaggatgcctggttctatgtggtgctcagataaagaataagtattttcttactgtaagtgtgtcccatgcagtatttgggacatactacaaaaaaattatctgtggtttacctaaaattcaaatgtaactgagtatcttaaatttttatttgctaaatatggcaccccctaca

SEQ ID NO: 21039 - DNA, 174 bp, Homo sapiens
  misc_feature 10: s=g or c
  misc_feature 87: k=g or t
  misc_feature 92: w=a or t
cataggacasattttgtcagtgtttgaccagtaaagcttgggaaggaagcgctgtctgtgctcacggacagaggcggccggcgccgktaggwttccatcctttctgtagggaaaggagcctttatttactattttgtatttatatttgatgaataagtatataaacagagacgt

SEQ ID NO: 21040 - DNA, 67 bp, Homo sapiens
agggttctcctcggatgtttcattcgccgtctgcacgtcactcccaaacttttcctcccagcgcact

SEQ ID NO: 21041 - DNA, 63 bp, Homo sapiens
  misc_feature 32: k=g or t
tagttgcaattatccgaaaagcttttaggtgkagagagttattgtttgtcatcctgtagggcc

SEQ ID NO: 21042 - DNA, 102 bp, Homo sapiens
agtaaggtagccgccgccgccgccgctgccgcgtcccctcgccggctcgctggtaccggcagtgccatggcggccttcagcaagtacttgacggcgcaaatg

SEQ ID NO: 21043 - DNA, 176 bp, Homo sapiens
  misc_feature 10: r=a or g
  misc_feature 11: k=g or t
agttcttgtrkccatggttttgagctccgtcagtcatttaaggtcctctctacactgtgtattctagttagccattcgtcaaaccttttttcaaggtttttagcttccttgtgatggactaggacatggtcctttcactcaaagaagtttgttattacagatcttctgaagcctgc

SEQ ID NO: 21044 - DNA, 83 bp, Homo sapiens
  misc_feature 42: v=a or c or g
acttagctgctgacaaacaacctgctccgtggagcgcctgavacaccagtctttggggccagtgcctcagtttcaatccagct

SEQ ID NO: 21045 - DNA, 245 bp, Homo sapiens
acaagttgggtgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaaga

SEQ ID NO: 21046 - DNA, 288 bp, Homo sapiens
  misc_feature 9: k=g or t
  misc_feature 10: k=g or t
  misc_feature 33: k=g or t
  misc_feature 34: b=c or g or t
  misc_feature 69: r=a or g
  misc_feature 208: r=a or g
  misc_feature 209: s=g or c
  misc_feature 210: w=a or t
cggctgtakktatttcagttgtcactgctggckbcctcctgctatgaaacgacactgccagtgccagcrgtgtccttgggaaaggcaatatttatgaagggcagaagaggcagccccaagaacctaaagactgcaggctgctaattgcaggaaatgactttggaagggcaggctcttgtccagtttcagggctgaaatgcctggcgarswccattcagccatcacatattgactgagtggctgcttagcatgggccaccgcgctaggctcgggacagctggtctttcc

SEQ ID NO: 21047 - DNA, 106 bp, Homo sapiens
  misc_feature 33: d=a or g or t
  misc_feature 34: w=a or t
gcaagaccactgaacccaccgggaggaacaaadwctctggacatgtcgcctttaaaagctgtaacactcactgtgaaggtctgcggcttcactcctaaagccagga

SEQ ID NO: 21048 - DNA, 240 bp, Homo sapiens
  misc_feature 10: w=a or t
  misc_feature 34: n=a, g, c or t
  misc_feature 234: s=g or c
  misc_feature 235: w=a or t
tttgggacawttttagatacctgagtgcactttnttcagttagtcctaacttttaaaagaaggaaaaccaagagacatatctggtgtacgtgttgcagtatgaactctggttgcaatccctcccccctcccacactgccccccatttgagtacgccgcacaagtcaaacgctaggaagtttgaataaaaccaatttttctaacttgttgctcatttgttgtaactcaataaagswaagac

SEQ ID NO: 21049 - DNA, 378 bp, Homo sapiens
gtcatatgtacaccaaaccctgttctacacacggagaatactcttgtatcactttgggtatttatttacttgtttctttctgtgtttttcttgtttgtttgtttgttttgttttgagacaaggtctagctttatcacccaggctggagtgcagtggtgccatgtcgacttactgcaacctccacctgccacctcagcctcctgagtacttgtctacaggtgcgcaccaccacacccagctaacttttctattttttgtgcataaggtttcaccatattacccatgctggttgagctcgaactcctgagctcaagtgatcctcctgccttgccctctttaagtgctgggtttattggtgtgagccaccacgccccacag

SEQ ID NO: 21050 - DNA, 264 bp, Homo sapiens
  misc_feature 192: n=a, g, c or t
atgtctggaagttaatgccgtattgtgctgctggctctgtctgcctcagctaatggagtgtagagagctatggttgtttgcaacttctgtcctccccttaggggttccagtcagtaattccagccagttctgataaacaaaggacaaaaagaactggcacagagtttggaaattgcctgctcggtgccagtnccagcctgccacaggccagtgcccagagagtgacagtgcagctgtaggtagaccacattggggtgagccgtc

SEQ ID NO: 21051 - DNA, 205 bp, Homo sapiens
cctccctgagtcttagtcttcccatctgtcaaatgggagaagcatcaccatcttcccctctggcagcctgggagggaggtggaaatgcagcttctcagagtgccagacaagtatgggctgccaggactgtcagatcagataccctgaagtctctgcagacagccaggcacctgccaaggagcctctgaccagagtccccgggggt

SEQ ID NO: 21052 - DNA, 144 bp, Homo sapiens
ccacttcagcttcccgagtagctaggactacaggcacgtgccatcgccttcgtctacttttgtttacttattaacttagagacggggtcttgttatgttgcccagttggtctcaaacttctggcctcaagtgatcttcccaccg

SEQ ID NO: 21053 - DNA, 96 bp, Homo sapiens
actctcgggctcgcgcacctccccaagatggcggcgcccgaggcctggcgcgcccggagttgctggttctgtgaggtagcggcggcaacgaccatt

SEQ ID NO: 21054 - DNA, 118 bp, Homo sapiens
caatatatgaccaagtttctcattgtccatcatccccaggtgatgtctgatcacatggcctgttttcagcaagaatcctgttagatttctgtagccagaatccctgcaccctcaccca

SEQ ID NO: 21055 - DNA, 187 bp, Homo sapiens
aagaacagcacaaaaagcacagcctctcacatgtgcaaggaggttcatggcacctctgtgatgaaattctcacattatttccatttttatgttgttttgttttactttttatagcaaacgtggatttctaacattaaaattaactagttcatcttgaaggaaagacactggcttccttgtgcctccc

SEQ ID NO: 21056 - DNA, 60 bp, Homo sapiens
actccagagccagagttcctaaccatttcagcctctcccgtagaggtctagccccagtta

SEQ ID NO: 21057 - DNA, 245 bp, Homo sapiens
gttttcacaagatctctatgggattttatgtgcttaaatttgagaaccattgctctaagcaaaattacctagggagatgagttttatgagacagaggaatcctcctctgcatcttttcccaatgtgcttctgccaagtcactaaacctggagaggcatcccaagagcagcctccccaggttggtacctgacagccacactgggttttcagcagctctctccagccactcaggacgctgccccacg

SEQ ID NO: 21058 - DNA, 420 bp, Homo sapiens
  misc_feature 228: k=g or t
acgtagggtgttttgttttgttttgagacagggtcttggtcttttgcccaggctagagtgcagtggctcaataatggctcactgcagccttgacctcctggttgaagtgatcctcctgcctcagccccacaaaatgctgggcttacagacatgagccaccatgcccagctgttcatggggtgtttttttatacccaaattgtaaccattaggtgaagtcatcatatckgagccccctctcctacacccccaagtgaaatggaactgggctatgtggttattaataccttccacacaggagatttgtagagtcctttagtgggctatccattcagtagggctttcactatagtgtgtagtctgacttcagatttgaactcatgtctgcagaaaatatttttctatactgaataagcctctt

SEQ ID NO: 21059 - DNA, 205 bp, Homo sapiens
  misc_feature 175: r=a or g
  misc_feature 176: b=c or g or t
gcctttccaatactaacgagcacatcaatggagggaggcaatttctgacttctgccataaagcagccatggtatcaactttcattacttcaaggatgtccaaccttttggcttcctgggtcacactggaacaaggagaattatcttgggccacacacaaaatacactaacactarbgatagttgatgaactaaaaaaaaaaaaaa

SEQ ID NO: 21060 - DNA, 121 bp, Homo sapiens
aggaaggggtccagtttctgttttctgcatatggctagccagctttcccatcaagctaccattgactttcttcacagaactagaaaaaaactactcacatttcatatggaaccaaaaaaga

SEQ ID NO: 21061 - DNA, 113 bp, Homo sapiens
  misc_feature 82: r=a or g
  misc_feature 86: r=a or g
  misc_feature 89: m=a or c
  misc_feature 90: w=a or t
  misc_feature 92: r=a or g
  misc_feature 108: r=a or g
ccgaggcaggaggaccacttgagcccatgagttcaagaccagcctggacaacaaagtctacaaaaaaaaaattttaaattarccargcmwartggtgcatgcctgtartccta

SEQ ID NO: 21062 - DNA, 85 bp, Homo sapiens
gaggttgcagtgagcaaatatggcaccattgcactccagcctgggtgacagaacaagactccgtctcaaaaaaaaaaaaaaaaaa

SEQ ID NO: 21063 - DNA, 277 bp, Homo sapiens
  misc_feature 78: y=c or t
attttgaccctaaggaagcggccacaatcgacagggacaccgccttcgccattggatgtactggcctggaagagttgyttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagca

SEQ ID NO: 21064 - DNA, 94 bp, Homo sapiens
aagactatactttcagggatcatttctatagtgtgttactagagaagtttctctgaacgtgtagagcaccgaaaaccacgaggaagagagggat

SEQ ID NO: 21065 - DNA, 230 bp, Homo sapiens
  misc_feature 206: k=g or t
agaaatccctgagactgggtgatttatttatttttattttttaaatgttattttactttaagttctgggatacatgtgctgaacgtgcaggtttgttacataggtatacatgtgccatggtggtctgctgcacctatcaacccgtcatctaggttttaagccccacgtgcattaggtatttgtcctaatgctctccctcccctttkcccccacccctcaacaggccccgg

SEQ ID NO: 21066 - DNA, 458 bp, Homo sapiens
  misc_feature 323: n=a, g, c or t
  misc_feature 324: d=a or g or t
gaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagndaaggctctcatggactagaaatattccagcgttgttactgtggagaaggtctgtcttgccggatacagaaagatcaccatcaagccagtaattcttctaggcttcacacttgtcagagacactaaaccagctat

SEQ ID NO: 21067 - DNA, 91 bp, Homo sapiens
ctgtatcgctaatattttcttccagtttgttggttggttgcttatcttgtttttgtttttggtgttttttaaaaaaaataatgcagaagga

SEQ ID NO: 21068 - DNA, 380 bp, Homo sapiens
cctatagtgaaagctcagatccacacagacagctgtctcgcctcccacttctcccctcgtgttttcaccccaaattatcaccgcatcgggcttgatctggtttttgagtcagttgcgtgttgcccattacactgtgccctgctgcttctcactcacttgtcctcccctgtcctgcctggcacagccaggttcccagggaagaccaggggtgccgatgctgatgcgtgggcctgagctggccttgcctattgactgagaaggctcctgggtggctcagaagtggttccagccaagcctctagagacatgccagacttctgcccgctgtgtcatagggcagtaacggcttagcaggtacctctgtctccctctgtaggccgc

SEQ ID NO: 21069 - DNA, 161 bp, Homo sapiens
aaatttcctttttgttggatggggataataacacttgagttgctgctgagcatcaaatagaagatttttgttattcatgaagccagaatgaattagatgattttaaagaagtcttctgggattggattctctggttatcactaaggaagattgaacggcat

SEQ ID NO: 21070 - DNA, 284 bp, Homo sapiens
  misc_feature 36: k=g or t
  misc_feature 51: d=a or g or t
  misc_feature 187: w=a or t
tgttaacaataagtgtaattctttagtttgttagakaacttcttaattcadgctttgtgcttttatctctttgtgttcctgaagttagattttgtgtggccctaaagtgaggctgggctgattgacgtgacccttgccctaagacaacacttctttagaactactcctcccctacctattagcagtwagcccctcaaaaattagtgactcatgaaagtgggcacaaacaatttggccagcaaaaaataaatgggatcattcagttcttctcattaaacacccat

SEQ ID NO: 21071 - DNA, 121 bp, Homo sapiens
atcctttcacacggcagccatcatttttgtcttgctagtaagccgaaggaagcctcaccatcctttccaagtatccagatccactatctgtccaactggatgaagtctcctcaccataccc

SEQ ID NO: 21072 - DNA, 249 bp, Homo sapiens
tagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctagtgagtaccatttacaccagtggtcctctcatatacttgacaccc

SEQ ID NO: 21073 - DNA, 257 bp, Homo sapiens
  misc_feature 88: k=g or t
aaaagctgaggtgaagccttgttaactatcgctagcttggcctaagcccttagggagggctgtttgttgtttgtttgttgttgttgtkattctagctcattttctgcttccattatttcagtgttaatataaataaggtaagcagtgtaaagggctggactaagagcagtcatttgctcaggctctagaataagccttcagctaaaggaacaaagaatagcagagcatagtgaagactgggagaggctacccccgca

SEQ ID NO: 21074 - DNA, 89 bp, Homo sapiens
tttttacaaagctcaaaaacaagcaaaagtaaacaagtaaagtttgtagatacaaacatatgtgatgaagctttttttttttttttttt

SEQ ID NO: 21075 - DNA, 274 bp, Homo sapiens
gaggggaggatggatggagttgcttgccctgctgtaggggttttcagggcaacaggaggctgaactctttggtaaattcaggcagaagtagaaccactgggtgagaagctctagcagatgtggctcccctggctaccagtggtgggagtgggtgaggataactgccttgttgtccagatgcttcctggaacaacaggaggctgcacccactagctgaatttccacagaagcaggatcgctgggcccaaagctctacaggtgttgcccacctagc

SEQ ID NO: 21076 - DNA, 123 bp, Homo sapiens
agtcttactgttacttcctttaaattgaagctcactattgccatccttcatttcctaagatgataacattgataagggttatggtgagtatgtctaagtgtggctttaaacaccagcggaccg

SEQ ID NO: 21077 - DNA, 212 bp, Homo sapiens
  misc_feature 32: k=g or t
ctcaggaagctgagaggcaggagaatggcgtkaacctgggaggcagagcctgcagtgagccgagatcatgccactgcactctagcctggacaacagagcgagactccgtctcataaataaataaataaataggatcaacagggcacaaaagttatgttaggaactacacaaaggtgagcctagtgtttctcagttggaacccccctccccgc

SEQ ID NO: 21078 - DNA, 380 bp, Homo sapiens
tccctgagtttcttttgaacactgaagttttccagccagtgagctgggtccctggattcttgatttacagttgcagggtcaagtctgttgctgtctttcttagagcacctccttgctcttccagatcctgccctttagacaggaatctgtctctcagcctaccggaagtctcaggtaaactctctaatgttccagagaaaccccaggtattttccaagttacctcaggggtatgtgggaatgtggctatctcaattgtgtgggttggggggcttggactaaggcctctgatctaatgaaaattatctcctttccctcccctctagtggtacttggaattctgtcactgtccagtcattcttaaactctttggcgcccact

SEQ ID NO: 21079 - DNA, 326 bp, Homo sapiens
  misc_feature 153: m=a or c
aaatatcagggaacagaatctataagagccttgggagggacaagaatcattcctccatgtagacacccaggttgcttctgggcttgtgcttctggactggctctaccatcactgcgtggacagggagggcttcctattgccttgataggaacmccaggcctgctctgtgtgatgggccacttgcagcctggtccatcagttttatcccccatttaaggctactggtttcctcaactgagctgagacaataggatttccggtggccagatacttcagccaaccctcactgccctggttaatgagactgacaccaccccctccccccg

SEQ ID NO: 21080 - DNA, 152 bp, Homo sapiens
cctccaagatcagattaatttgttttcgtgttaaagctgtcctcatagaattatttaggaagtgtttcatctgcttctattttctgaagctaatgtagagaattggtattatttcttcctaaatatttggtagaattaactagtgaacaccc

SEQ ID NO: 21081 - DNA, 144 bp, Homo sapiens
tgaatatttttccttctgtatatcattcatgcagccctagaagacatcaagcagctgcttaagagagtataggccaccaatttttaataactctggaaaacaagtagggtaagcatttttattctcatttcaccagtggggaaa

SEQ ID NO: 21082 - DNA, 437 bp, Homo sapiens
  misc_feature 419: s=g or c
aaaatcttaattatattaaaataaactcaacaacactcctctcttttccttccttcacaacctcctctcacctcaggctaatgagagcccctcactcaaagctctgctcatccctgcagcccatccttcactgcatcatcgctgctctttatccctacttctcccgaccctctcagctttgtactacatagatcaatttagttttcttatctttcacttttttcccttttctcaagccccaccttcctctgctcagttttagagatatctcaaaattctaaattccatttttgcaggaagctatagaccttagagagtggggaaggcaaaatcaagctagcaaaaaaaacaaaaacaaaaagcattgtcttgagagactgggaagagtgtggagaggccagagcattataatccctctstccctccttcccttcctt

SEQ ID NO: 21083 - DNA, 163 bp, Homo sapiens
tagctgggtgtggtggcgggccaccagctagggaggctgagacatgagaattgcttgaacctggaagggggtcggagaggcagagattgcagtgaactgagatggcgccactgcactgcaacctgggtgacacagcaagactctgtctcaaaaaaaaaaaaaa

SEQ ID NO: 21084 - DNA, 401 bp, Homo sapiens
  misc_feature 10: r=a or g
  misc_feature 11: k=g or t
  misc_feature 12: w=a or t
  misc_feature 13: w=a or t
catgaagatrkwwcaatgaaacaccaaatgactgtgttggcaaatttttaaaaaggatagtggatttacttaatttaaaaaaaaagagtgagttttttaaaaggatggacaaactgaccaatctggtacccttttcccacctttgcccaaagaagaaattaactatgttggaactgtgccccctttccatcgttaatgaagaatcaaaaacatgatgggttcaatgtagtgggtgtctcttgcccatcctggtttaaatccatgtatccacatcttccccaagacaaatgactatggaagcctagtattattcaaaaagtttgaatctgtgtgcaaagagaacatttgcagttttcaataacaaaacaatactataagctttgaagggtgccttatctgta

SEQ ID NO: 21085 - DNA, 440 bp, Homo sapiens
  misc_feature 40: s=g or c
tcctgatctgagacatgaacatatagagagagtaagatasaagtatatgtaagagatcagtgttgcaaactgagggaggggcaataataattatcctgaagtcatgcttaaagatctgtaagaagaccgtgagggccacagtattatgtgtaaggaagaaagaaataggtggggtccacaagaaaatcagactggattatgacagctttattggtaagtgtaagatgagatttcctgttaatcatgatgtaaaggcaccaatagattgtgattgtacatacaggaatcatatgatctggtttgaatttttgaaagattgttcggttgctcactgaaagtagtagaggagcctgagagaaacagggaaccagtaaaatggttatcacagatgtccgggtgatggtgccagatggtggcttggactagcatgatgtctttca

SEQ ID NO: 21086 - DNA, 182 bp, Homo sapiens
ttacaggtgtgagccactgcatctggccctgcagttatttttaaggtaaaatttacatatacttaaatacaaaaaagttaactgtataattctgacaaatagatatacgtctataacccataccttcaagatacagaaagctctattgtgtcctttccccatcactccttcccccccccccc

SEQ ID NO: 21087 - DNA, 138 bp, Homo sapiens
  misc_feature 45: y=c or t
  misc_feature 46: y=c or t
ccttcttcccaacccccagcctcagctcaagatgctgagcagccyyacagacccctgccgtcccttatggaagtcagcacgtcaggggacatccctgatgctgccttttctggaatctccctggtcaacccatcccct

SEQ ID NO: 21088 - DNA, 147 bp, Homo sapiens
  misc_feature 57: r=a or g
  misc_feature 75: k=g or t
  misc_feature 76: w=a or t
  misc_feature 85: s=g or c
  misc_feature 113: h=a or c or t
gggtgtccagcagcccgactgaagcttgatgggtggggggctgtggtggtgggggargctcagatgacatggctkwcctggaaasagaagaggctgtcaggggctcgtgccthgcaaggtagggaccctgtgcttacccccatgtcc

SEQ ID NO: 21089 - DNA, 98 bp, Homo sapiens
agaagttaacttctagggacatcttcagggactcctcaaggcaaatattcatgaaatggggcctattggcttttcttttcatcttggttctgggcgga

SEQ ID NO: 21090 - DNA, 245 bp, Homo sapiens
ctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgctcggggtggc

SEQ ID NO: 21091 - DNA, 106 bp, Homo sapiens
agactggccggggtgccccgcaaagagagacaagggagaaaaagacagcagggaaaaccccggggaggagaaggcgaaagagaaggtggagctcagagaagggggc

SEQ ID NO: 21092 - DNA, 159 bp, Homo sapiens
  misc_feature 10: s=g or c
aatggcggcsggtggagctctaggtgatgtgtgcagacagaaaaagtaaactgtcaaggaattcagagcattgggtacttgttatttggaccagtttgaagcatctttgatttattggaccaactggcaacagaaaatgaaaagtagtgtggcacagac

SEQ ID NO: 21093 - DNA, 301 bp, Homo sapiens
  misc_feature 187: d=a or g or t
atattaaaattatttttgtagagaggagggcttgctctattgaccagtctggactcaaactcctgaactcaagtgatccttctgccttggcctcccaaagtgctgggattacagatgtgagccacttcgcccagcccaccgttttatttttaaagaacattggagctatcatgtctggaagtgtgtdtgcaatctaattttacctattcactctcctccttaaatttttcttttgtgacttttctgcaaccagtaagggaaactcagattatcatgagaatctttctaaatccctccatga

SEQ ID NO: 21094 - DNA, 201 bp, Homo sapiens
  misc_feature 11: d=a or g or t
  misc_feature 12: r=a or g
gactgaccatdrcagaaaataacacagaacagtttacttggatcttctctttttcttggttagcacagctataagtttattgattttaactagattgtggtttctgtgattttctctattgtttccctgtttcagttccattgatttatgttctaatgtttattgttacttttcttttgctttaagtttaatatttttcct

SEQ ID NO: 21095 - DNA, 277 bp, Homo sapiens
gaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgca

SEQ ID NO: 21096 - DNA, 294 bp, Homo sapiens
  misc_feature 10: k=g or t
  misc_feature 11: h=a or c or t
  misc_feature 30: w=a or t
  misc_feature 31: r=a or g
  misc_feature 32: k=g or t
  misc_feature 33: k=g or t
aaaagtatakhgatgaaatgataggatgtwrkkaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaattttgaaaaaagaatctcttttactcaagtttgaggtaaagtctcatttcacctcactgggtcttcctggaccagataaccatccccgaaca

SEQ ID NO: 21097 - DNA, 290 bp, Homo sapiens
  misc_feature 32: y=c or t
atgtgtgtgggaatggacgcaaaggaaaacayagctgagctgcattgtaactcttcctgtagaacctgttcatgtccaggttattccaatggaaacagctggagaacttatatttccgtgagaaaaaatttgctgttgaagttcatgatccacgaaggatttcagtttcaagaagaacctttgggcaaagtggcctgtttgtgcaaacatggtatgctaactcttctctcatcaagtccatttgggtaatggcaattagtcagcatcagttttacttggaccggaagcaa

SEQ ID NO: 21098 - DNA, 349 bp, Homo sapiens
attgcttctgccactcttttcttgctattttggctgtaacaggattggacccaggagtttatcatgactaagttcaaagggtggagcagcagcaaacatggatgacttctgactctctaagtcacccgaccccagggtcaaccagctaatatcggtcttgacattaaacagatccccaggcaacaagagtctctgaaccaaatccttagctcaattgcagcactggccagatgggagaaaaatgtctcagtgcccaaggatcatggtccaatttcagacagctaagacctgaagaaagtgaactaattcacactaaagggataagtgctactatggccaacacccctct

SEQ ID NO: 21099 - DNA, 377 bp, Homo sapiens
  misc_feature 57: s=g or c
tggaagacagtgcttcttaaaggataagcaataaaagtgcattaacttgaagcttcsacatattactaagcccaatggtaatcacagcaatggtttagaatctagaccaacacaagatttctttggggagcaggatttgagctctgaaattatgtaaacttgcccctgcatggtgatcatcgtaagcagcctgaccttttatctgtgttgttatttcttgtaaacttcctatagatgacgaaccccttattttctgccctggaacgggtggcttcctctgccctgtccttggtactggcatttgtcccgtctaattacctttgctaagtgacaagttgggaggctttcgtgtccttccatacccttgccccacccct

SEQ ID NO: 21100 - DNA, 145 bp, Homo sapiens
aatgatgaagggttccactgtgttgtatgtgttaaatttatttaaaactttttttaatccagatgtagactatattctaaaaaataaaaaagcaaatgtgtcaactaaattggacaagcgtctggtcctcattaatctgccaacc

SEQ ID NO: 21101 - DNA, 89 bp, Homo sapiens
aagactatattttgagggataacttctatagtgtgtttctcgaggagtatatctgaacgtgtagaacgctggaaaccgcgagagggaga

SEQ ID NO: 21102 - DNA, 361 bp, Homo sapiens
  misc_feature 10: s=g or c
  misc_feature 11: b=c or g or t
  misc_feature 12: h=a or c or t
  misc_feature 30: w=a or t
  misc_feature 31: b=c or g or t
  misc_feature 32: d=a or g or t
  misc_feature 56: k=g or t
  misc_feature 305: k=g or t
  misc_feature 308: k=g or t
  misc_feature 330: k=g or t
aattaaagtsbhatgaattaattatcatcwbdacaagagtcaatttaagagataakctacaatgagttttcagattggataataaataatattagaatttttttctgccacttattcccttccaatagaacaatgaaaaatccttgataatgatttgctgactaacatagaataacctcatttgtatgtacatcaatttgaaattcgtctggctgggaactcggtaattggttacactttagtatatatgagagcaaatatagaatatggaaatcattttacacaaatttttcaatttctgtatkttkttcatagaatgagttgtattakaccagacacacatacacacacacacacacac

SEQ ID NO: 21103 - DNA, 379 bp, Homo sapiens
  misc_feature 33: r=a or g
  misc_feature 254: w=a or t
  misc_feature 347: r=a or g
  misc_feature 364: y=c or t
  misc_feature 365: b=c or g or t
gggtatttgttaaggcagattctcaagtaagtracatttaagctgatacctgaaggatatgtacacactagatgtcagaaacgggtgaggcatgagtgaataaagtgtgagttgcaaggcagaacgtactgcaggcagaagatagcatgatagtatttaggaattggaaaaagtccaatgtagccagacattggagcgagaggaggagagtagccagaggtgagcagagaggctgataggcctgggaagcagtwtggattttatcctaacagcaaagggacgccaggcacaggctttagatggagaagccacttgatgagatttgcctgttcagagcatctcaaaarcccagcaaactgacagybacttccacccatcc

SEQ ID NO: 21104 - DNA, 217 bp, Homo sapiens
tttacatcttccccccatcattgctctgtccttccgaaggctgtggctggcacaggacagaatagaacctcctagcctcaagttccaaacccacactctccaatagccaggctctcagatgggaagcttcaaagtcttgtgacagcctggctgaacctctccagcctgggccctccctccatttcctgccccggaaacaggcatctcctctggccac

SEQ ID NO: 21105 - DNA, 348 bp, Homo sapiens
  misc_feature 262: k=g or t
  misc_feature 263: k=g or t
ttttggcttgaagtcagtatagagaagttatttaaaataagattttcgtcccacggaattgtcccctttgttattgtatatccttcaggtttatgggacagcactagaggaaagtgacagcctcagaggaccttcagatggtgtcctgggtagctgaaactgtggaaagcaaaaccgtggataagggggaactactatactgaaaatgtacaaaacagagaagatttcattgaagaagtctgctgtttctggaatgggaaakkaagggagaggttcgtgaagaagtgattgggaaagagagcaagtcttggttggacagtgtgattcaatagaaatgtgaggaggtca

SEQ ID NO: 21106 - DNA, 73 bp, Homo sapiens
aagactatactttcagggatcatttctatagtgtgttactagagaagtttctctgaacgtgtagagcaccgaa

SEQ ID NO: 21107 - DNA, 332 bp, Homo sapiens
  misc_feature 317: k=g or t
gctgaggtgggaggattgctcaagcctcatgagctgtgattgtgccactgtactccagcctggacatcagatcaagactctatttcaaacaaacaagaaagttaagatttatcaacacttgagctcactgcaatagtaacaagaggtggctgcaaaattatttcagtagtacagtatgtcctgcagttaattttaagcagttatgatttaatactgcatctttaatttgtttgcatttctctcaactgcaaatggtgccatgtgtggtctgtaagtgtgtgcataagtgttgataaatcttaactttcttgtttgtktgaaatagagtcttg

SEQ ID NO: 21108 - DNA, 322 bp, Homo sapiens
  misc_feature 21: k=g or t
  misc_feature 267: k=g or t
caattttgaaaaactcttgtkctcatgagcctaaatttcaaaggtaattttaggcctgtaatatattgtggaggtcttttgaataataataattcaaaaaatctcagagaaggtgggcacagtggcacatgcctctagtactagttactcaagaggctgaggagggaggattgcttaagccccaagatcaaggccagcttgggcaacatatcaagaccttgtctctttgaaaaaagaaatccagataatgaatggtttttttaatcktatttttccttctagttgaaacttattcaagtttgtaaactacaaaaagtggtat

SEQ ID NO: 21109 - DNA, 114 bp, Homo sapiens
  misc_feature 80: w=a or t
aggctggggtcggtggctcatacctgtaatctcagcacgttgggaggccgaggcgggcggctcacctgaggtcaggagtwcgagaccagcctggccaatatggtgaaaccccag

SEQ ID NO: 21110 - DNA, 245 bp, Homo sapiens
  misc_feature 10: k=g or t
  misc_feature 11: k=g or t
  misc_feature 32: y=c or t
caatgcagakkcctttcgagaaactgggcctycagcttgttctaccagtcatgtgcttgtcctcccaggggcctgctctgtgcccccaacccagctctagcctcaaactccacttgggcctaactgtctagagtgctaggatacccttcaatcctcagcaactgggtcaacagggaggagaaggaagtgaagagcaggcatgatggaagacggaacactaccatgaagttaggctgacccctagc

SEQ ID NO: 21111 - DNA, 307 bp, Homo sapiens
  misc_feature 115: w=a or t
  misc_feature 242: b=c or g or t
ttagagtggggaatacacttgttatttacatgaaatattgccccccgtcaaatggcaatcttagtatataccattactgtcagtatggatagcttagtccagcttctggttgaawtttgttatgaatgaaaataatattttatcatctataatcacacttgactttctgcccatggtttttaataagggacaggtgtcgtttatagatagaatgttcttaggctcattactttaagccagtbgtgcttaagaacacacagatttttgacatagcctctaagatgccatcagttgttaatgagccaac

SEQ ID NO: 21112 - DNA, 405 bp, Homo sapiens
  misc_feature 231: k=g or t
  misc_feature 322: k=g or t
caatgtcagggaaatgcatcagcttaaagctattttgcattcaattaatgttagcacctgccaagttccagatttttcacaagtaaaatatgatgccatcactcctcccttattttttggcttaactagaaagagggaagcaaaatatgtttttagaaggatgggggctatataaattcacaataaaattatttaaattccaaaagaatctgtactgtcagtttttctgtkttcatagatttctttttgcccattatatctgcacactctaacttgctcttttcatgacaaaggaccagttctgaaaatctttcacctcgtkcatgggtggtcttataagtggctactgtaactgcatttccatgtcattcctggggagaggacgcccctagtaacagcaagtgc

SEQ ID NO: 21113 - DNA, 158 bp, Homo sapiens
ctatgttgcccaggctggttttgaactcatggcctcaagcaatcttcccacttcagcctcccaaagtgctgggattactggtatgaaccactgtgcctgactgctctcagaatgaataagaccctggatgacctagttcctgcccacctcttccccat

SEQ ID NO: 21114 - DNA, 221 bp, Homo sapiens
  misc_feature 179: s=g or c
  misc_feature 180: n=a, g, c or t
  misc_feature 181: m=a or c
ctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaasnmcagctcatttctcttggaaagaaagttattaccgatccac

SEQ ID NO: 21115 - DNA, 363 bp, Homo sapiens
  misc_feature 321: r=a or g
  misc_feature 322: r=a or g
  misc_feature 346: k=g or t
aatattacctcttatcaattgaagattaattgcagatatttctaagccagtctcagaactagagaattttattttaaaccttaccatttgaggtttgaaaatggattataaaaaatcaaggaatatgtatgctgtgtaaacttttccttggtaaaaacccaattaaccctaatagccaaaactgacaaatagcaacacacacaccccataaatatagatgcagaaattcaaaataaagtattagcaattcattttcaagaaccatgtacataaccaagtgaatggtagtctaggaatgtaagggtagcctactatcagggrrtcccttgaacagtagcatagtgtkatgtttaagtgctcaga

SEQ ID NO: 21116 - DNA, 171 bp, Homo sapiens
  misc_feature 12: s=g or c
  misc_feature 48: k=g or t
taaatgatactstagatttaggtactcaaaactatggggacacaattkaaaagagaaaccaagctaggttgaagtccagaaaagcttcacagatgaggaacatattagtctgctattaaagaataattgagattttgttggaaggaagaatgatttggatagaagcaactc

SEQ ID NO: 21117 - DNA, 174 bp, Homo sapiens
taaagaaatgtatataaatctactttatatttttaaaaaatcactacagcccatcaccttaaacttctgctcattcatatttatatatgtattctgattgtgattactcctacatacaatttttaatatagtacaaaatcgtacatatataattttatggtacccatccccccc

SEQ ID NO: 21118 - DNA, 378 bp, Homo sapiens
  misc_feature 128: s=g or c
  misc_feature 129: s=g or c
  misc_feature 371: k=g or t
agctcattgttggcagctgccgggcggtcctgccgagctgatgagggcaacggaggggaaataaaagggaacggctccgaatctgccccagcggccgctgcgagacctcggcgccgacatcgcgacassaagcgcatttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagckgccccac

SEQ ID NO: 21119 - DNA, 425 bp, Homo sapiens
  misc_feature 32: k=g or t
  misc_feature 36: r=a or g
  misc_feature 108: n=a, g, c or t
  misc_feature 110: w=a or t
  misc_feature 267: m=a or c
  misc_feature 268: w=a or t
aaaataagaagcactgaaaaataaaaatgtaktcarggaaaaattacaataaatggtctgggtttccgtctttcttaagacagaagttaatgatgagaacgaagtgtntwtaatagcgtccagaactcagatcaaggtaatgaaaaaccaccaccaacaacacaaaaacccaaacaaatgtattgtccatggtaccctgctgtctctgacaacattgtgaaatatccctactagcaggtcagtcattgttgacttctggcctttctmwccttaggaaacaacacccagaaaacataggaagcagcccagaaatgtagaattatagactgtcagagccagaagtactctaaagacaacctttcatttaacagatgaggaaactgaagcccagagagagagagaacttgcctaaggtcccacagcta

SEQ ID NO: 21120 - DNA, 423 bp, Homo sapiens
  misc_feature 354: n=a, g, c or t
agatggcctgtttttcttgagacagactctcactccgttgcccgggctggagtatagtggtgcgaccttggctcgctgcaacctcctcccaggttcaggtgattctcctgcctcagccacccaggtagctggaattacaggcacctgccgccacaccaggctaatttttgtatttttagtagagatggggtttcaccatgttggtcaggttggtctcaaatttatgacctcaagtgatccacctgcttaagcctcccaaagtgctgggattacaggcatgagcctctgtgcccggctcaagatggcctgccttttcacgcttgcagccaagctgcgggtcctgcagtgagccangttgctggtgtgcatggataatggccctcgctgctttgagggtgtctggtgcctgcagtttcccctctt

SEQ ID NO: 21121 - DNA, 67 bp, Homo sapiens
tatctagtgtgtcacgccaatgggcttggacttaatcctttctttctcctcctcttcccccggtcct

SEQ ID NO: 21122 - DNA, 244 bp, Homo sapiens
tgcacttcagcctgagcaacggagggagactccatctcaaaacaaaacaaaaacaaacacacaaacaaaacctgcaaattctgcgaaattctgtctggagagtcaaggagggaggggagtgtgggcagaggacaagagggttgacagggacagacaaggtgttccctgcactttcctgctcctcctcctcccagaactccacctccttgatgaacccatccccatcctcagcccctctccctca

SEQ ID NO: 21123 - DNA, 246 bp, Homo sapiens
tctccacaaatgttctattacagtgtatgccttctcagaagtcacatggtattgattatttcctgtctctcctgcatactgatcctttctgtgttggtcattcctattgacatttaaaaatattctgtcgttaaacaaaaccacaccactacaataattacaataataatgaaaaccactgaccttggaattatgttcctgtccacttacctttctaattatcccttccctacactgccagctcct

SEQ ID NO: 21124 - DNA, 369 bp, Homo sapiens
  misc_feature 37: w=a or t
  misc_feature 344: w=a or t
  misc_feature 345: h=a or c or t
  misc_feature 361: k=g or t
tctttacaattagctagttgcgattggctaagttgtwagggcctaaatacttactaagctgtctggagcctaacccagcagaagggttagatatttcttttagcttaggggcacagtgagaaaaattgctgagactaagggccccataaacataggaaattggagaacttctagctgaaactgatcatggttcctccttgatcagtcttggggcaggaactgggactggggcctgcctcacctgaagcccatgaagagtgtatacctgaataaactcttataaagaaaggaggggaatgcattaggaatgccactaaactcagtgatatggtttggatctgtgwhcccatgcatatctcakgttgaatt

SEQ ID NO: 21125 - DNA, 112 bp, Homo sapiens
ctttttttccttctggttctgaacgtgaaaccctgttggaaacaggtctcttgaccctcgcccttgacattcaaatggctgaatggaggagagattgctactcgcacgtccg

SEQ ID NO: 21126 - DNA, 196 bp, Homo sapiens
tatagcaggaatccaatgaatgtctttttgcgtgagagtcatgcagagctttgctctaagaagattaatttggtaaccatgaataggttggaatggagagaacatactgtgaatagggagatcaattaagagactattcacattagtctgtgaaagaggtaataaagacctgaaatacggtaacaatagtggcccg

SEQ ID NO: 21127 - DNA, 312 bp, Homo sapiens
  misc_feature 32: w=a or t
gtttccttcctttgagtggtgcaaaggcttawgggtgtaacctcagaatggggccctgaatcagctgtgggcgagctcctagagtatcttaattcctgcttcatctctttccattttgcagttgggcaaactgcggctcagaaagataaagaacttctccggagcgaaaaagctgctaagaatgtatccaaaactccgcacggtaaggactgaggacggtcaaaagaccaccaagagttaaaaccatgaagctgcgtagtaccgcggaggctagagagacccggcccaccccttccaacctatgcccctcca

SEQ ID NO: 21128 - DNA, 113 bp, Homo sapiens
agtctgttgagcatttcctgtgagtcatcttgctccaactgagagtcaggctgagctggagttatttccattttcctgattggtagactaaggctcagagagaggaggcggca

SEQ ID NO: 21129 - DNA, 398 bp, Homo sapiens
  misc_feature 286: k=g or t
atgaaacagttctctgtctctgtttttgtgtatggctgttatggctgagacttacctatgaaaatgtggaatcagagggttaaaatgaccaaaaggtaattcatttacttgccacctggagagatgatcagctgatactggtttatctgagagaaaaccaatagttatgtgtgtgattctaaatattgcagatcttgaatattcaaataaatattgcccttgtcaaaatagacccctcagatggtgcaaatgctaatagctaggtgtagcctgttctcacactgckatgaagaaatacccgaggctgggcaatttacatttgtttaaagagctttaatgattcacagttccgcatggctgggaaggcctcaggaaacttacaatcatggcggacgggc

SEQ ID NO: 21130 - DNA, 111 bp, Homo sapiens
  misc_feature 4: s=g or c
  misc_feature 32: w=a or t
agcsaattccacataggcagcgagagggcagwagagagacagagagggagggacggaagagggaaggagagaaggagaaaaggaagagcaggctgagaaacggtgacagga

SEQ ID NO: 21131 - DNA, 235 bp, Homo sapiens
  misc_feature 201: w=a or t
  misc_feature 208: r=a or g
  misc_feature 210: s=g or c
  misc_feature 212: m=a or c
  misc_feature 216: k=g or t
  misc_feature 219: r=a or g
  misc_feature 227: m=a or c
  misc_feature 232: s=g or c
agacaaccagggagtcctggcagactgggatgctttgggagccggagcgtgttgagtcaggcgctggccatcaggaaacatcaggacacctctgacagggagtatcccacaggaatgttgcaaatcaaggcaaaggagagaggcaaatacacgacagggtcatttcccacctttcccatggaatttttttttttttttttwaaataarascmcttktcraaggaacmcccascca

SEQ ID NO: 21132 - DNA, 63 bp, Homo sapiens
aagagtagaatcgtgtcgcggctcgagagcgagagtcacgtcccggcgctagcccagcccgaa

SEQ ID NO: 21133 - DNA, 171 bp, Homo sapiens
gtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggca

SEQ ID NO: 21134 - DNA, 69 bp, Homo sapiens
  misc_feature 35: y=c or t
catgacaaaaggggctttgtaaatgtaactaagtyaaggatcttgaggcaggtattatccaggtgggcc

SEQ ID NO: 21135 - DNA, 334 bp, Homo sapiens
ctgggtgctcaattgttaatattaaagctgaaaatattttatcataagatctataaccttataatattattgaaattcactttcaaatcctatacaatgggaaattgcagaagataacctcttgagtcttttccagctcaaatgttatatgttttggggatttatttcacagggaaatgcacagtaacaacaatctcgatctgttctttcagtaacccttaatttctgcccttctctttcctgactcactatggcaggccctctccccacagactgccaagcgcctatctgtctctgctagggttacttctgggctctttataaccctccccac

SEQ ID NO: 21136 - DNA, 88 bp, Homo sapiens
ccctgttgtgctagcaaatgctaggttttattcattaattctatttttttgtaccaattaaccatcttcacttcccctccaaccctcc

SEQ ID NO: 21137 - DNA, 152 bp, Homo sapiens
tttgtagggacatggataaaattggaaaccatcattctcagtaaactatcacaaggacaaaaaaccaaacaccttatgttctcactcataggtgggaattgaacaatgagaacacatggacacaggaaggggaacatcacactccggggtca

SEQ ID NO: 21138 - DNA, 394 bp, Homo sapiens
  misc_feature 317: k=g or t
  misc_feature 385: r=a or g
aaaattgttaatgaaatatatgttttttctcacgctaagccttcaaaatccagtgtgtatctcacgtttatagcacatctcaattcagactcaccagccacatttaaagtgctcagtagccacatgtgacagcagctaccaacctggcaacacaggtctaaagaatctctttaggttgtttatattttagtatttctctcaggtgatttgtgtcttttgccatctctgtcttcctgccttagcctgcaattgcaatctgtatgggaccatgaagcagcagagcagctgtaaccccgtgacggggcagtgtgaatgtktgcctcacgtgactggccaggactgtggtgcttgtgaccctggattctacaatctgcagagtgggcargctgtgaga

SEQ ID NO: 21139 - DNA, 434 bp, Homo sapiens
  misc_feature 11: y=c or t
gaaaagcttgycggtcctggtggtgaggccaagaaagggagaaggtgctctcctgcccagggctctgggtgtggagcaccggggccaactcgtgccccgtcaccaactcctgtggaaattggtgcagctccagcagagaaggaggccaaaagtggaagaggcccagggcttctcccttagcactggaggcctcagatgcaatggcaggagctcggccgtgggccccactgtctgaggtgttgaaactggccattggcaactcgagaggtgttggtgctctcctgctcagcttgcttgaagttactggactcttggagggggtcaacagatgctttttaagcaccctgttctggcccaggaattgttccattccagtggtaaatgagggggatgtggccccgcctttatggtgttcataggagacataggagaca

SEQ ID NO: 21140 - DNA, 245 bp, Homo sapiens
gattatccaggaaacagaatgagataggctgtccatggaatttccaagtcaaacataatagctcatttttgagtttgccctacagttttctagttaggtaggataaaaagtaataggttattttaaacaactcaatcactttgcatgttctttgatattaaccattccatagaaaccacttatacttctttattaccaagttactattttctgaagacatttataagtcatgttgagacagtaga

SEQ ID NO: 21141 - DNA, 235 bp, Homo sapiens
agtattgctaggtctttgatcaaaggttcttgcatatacacttatacccaaggactagtaatatattcttcataagtcaaagcaactaatcaaaacctttcaaactttctttttaaagacgtattttaaataagtgaataaaaaccacctatctaggaacaataaatctccccttaaacaaaaacttttttatacattcatctcttatttcagcactgcaaaatgccccgttact

SEQ ID NO: 21142 - DNA, 451 bp, Homo sapiens
aatgttcgagggcagcacattatactaagagaaatcggtctccttctccatcaagtacattaatatcctcctctttgtattaggccttagatgttcagctgctcttctatttgtcactgttttcttttggagcttccttaggtgggggggcagcggaaagataactagttaaagtaacagaatttctttctttttttttccaacttttattttaagttccagagtacatgtgcaggatgtgcaggtttgttacacaggtaaacgtgtgtcatgatggtttgcagtacagatcaacccatccccaaggtattaaagcacagcatccattagctattcttcctgatgctctccttcctcccaccccccataggccccagtgtaatcgagtttcagtggtattaaatgaaaggccactcctgtctataatgatactatgcttaaattgagagat

SEQ ID NO: 21143 - DNA, 189 bp, Homo sapiens
  misc_feature 131: s=g or c
  misc_feature 132: m=a or c
attccagagctgctccctttacggaagggaagacttggtttctcagcgaaaataaggggcggggaacccctgtcaacatccatccagagagctgcatcctgtggccctataacactcttctccaaaaggasmtgccagagactgggagtgttgactgctgcaaggaccaaggtgggatagtaacatcgc

SEQ ID NO: 21144 - DNA, 75 bp, Homo sapiens
aagactatactttcagggatcatttctatagtgtgttactagagaagtttctctgaacgtgtagagcaccgaaaa

SEQ ID NO: 21145 - DNA, 107 bp, Homo sapiens
tctgggtggtaaaattctccatgcgtggtcaaacggcttatgcatagctcaggaccgttacgtgcgaccccaccaggactgagtggggacagccgctgcgccccctt

SEQ ID NO: 21146 - DNA, 160 bp, Homo sapiens
aaaagtggaattctgcctcatctttctcagaactataaaccagtcagacactgtttcagagattacgctagaaaatatgtacctatccttggcacttttgctgagaaataaaactctcatcactggagataaaggtagatttatatttaatgccacccca

SEQ ID NO: 21147 - DNA, 120 bp, Homo sapiens
cttttttttcctttcctggatggcaccagcagggccgattggagtggtaaaccctgggccggaaggcatgccaaagggtggacaggatggacaggagacagtagcacaacgaggagcgga

SEQ ID NO: 21148 - DNA, 142 bp, Homo sapiens
  misc_feature 41: s=g or c
  misc_feature 42: s=g or c
ataatttggagtaatatcattatgaaaactctaatagtacssttagccactattaatattaaaatagctctggtatatgcacttatagaaaaagagaaacctaattgttgatcatcttaaatgattttgtgcaccctcataa

SEQ ID NO: 21149 - DNA, 197 bp, Homo sapiens
  misc_feature 10: r=a or g
taaaaagttraattttctgtatggcaagaagtatcataaacaaagttaaaataaaaatgacaaactgaggggaattattcacaataaacatgtgactaagtaggggttaatatttttgatatgtaaagaactcttacaaataagttagaaaaaagtaccccaaaaatgaattgggagtttaatacaatagaggcgca

SEQ ID NO: 21150 - DNA, 60 bp, Homo sapiens
agggataaatggagatagccatgagtagaactgctgtagggcttcaggaggctacgcaga

SEQ ID NO: 21151 - DNA, 223 bp, Homo sapiens
  misc_feature 32: w=a or t
ttaaaaagagtgataaattttactacattaawattaagaactgttcctcaaaatataccttaaagaaagtgaaaagactgggcacagtggctcatgcctgtaatcccagcactttgggagggtgaggtgtggaattgcttgagtccaggaatttgagaccagcctgggcaacatagcaagaccccatctctacaaagtagcagcactctactatgccagacac

SEQ ID NO: 21152 - DNA, 83 bp, Homo sapiens
tccacctcctgggctcaacgatactcccacctcagcctcctgagtgagtagctgagactacagacgcaagccaccacgcccta

SEQ ID NO: 21153 - DNA, 102 bp, Homo sapiens
gcctaccacctttgtgtcccagcatcttgcggcgcgctgaactccggccccacggagaaggttgtaaggtttgcgccggcagaggcgacaaccccaccactc

SEQ ID NO: 21154 - DNA, 321 bp, Homo sapiens
  misc_feature 93: k=g or t
attcataaactttcctaaaatactatgagattttttttgcaaaattttttttttagcccatcagctatcattactgttagtgtgttttatgtkaggcccaagacaatttttcttcttccaatgtggcccagagaagccaaaagattggacatccctggtctagatgatcacaggtgcactgaagtgaagaaaaaaaaattgtgttctagaggtgccccattgttccttgtgtggattaatgtaatattgtaaaatatatatttaatcttccatcctgttactggcatacaactcctaaaatccttggaatctgcacagcga

SEQ ID NO: 21155 - DNA, 117 bp, Homo sapiens
ttcaacctatttttaacacctcaactatttatttttaatacctgatttcttgaaaaagcatattgttaaggaagtaaggtatcttcattaatatacatctttcacaactgaacaggt

SEQ ID NO: 21156 - DNA, 108 bp, Homo sapiens
caccatggtaagatggggacatccccctatgttctgtgtctctctcctgctccaccatgcttatcctttgccttccaccatgattgtaagtttcccaaggcctcccct

SEQ ID NO: 21157 - DNA, 157 bp, Homo sapiens
  misc_feature 10: r=a or g
tctcaatttraaaagatatatataaagttccctgggtgaatactggtttccctcctcccttcagtatatgtgaaatgtagtgaaatttatatggttctgacagtattttattttaatgatttttcctccatccttggtagttttttttttttccctt

SEQ ID NO: 21158 - DNA, 90 bp, Homo sapiens
atacaaaaagtagccgggcgtggtggcgtgcacctgtagtcccagctactcaggaagctgaggcaggagaattgtttgaacccaggaacc

SEQ ID NO: 21159 - DNA, 336 bp, Homo sapiens
  misc_feature 194: k=g or t
  misc_feature 299: m=a or c
  misc_feature 334: w=a or t
ccattttttttttccattggccattctgatatgtgtgtagtaatatttcattgtgggtttaactggaatttctttacgggctagtgacattgaatttattttcatacacttattcatcatctgtgtattctctttggtgtaacgtccatgctttttgttcattttctaaatagattttttttgttttgtttttkgtttttgacatggagtctcactctgccacccaggctggagtgcactggtgtgatctagactcactgcaacctccacctccggggttcaagcaattctcctgcctmagcctcctgagtagctgggactacaggcatgtgcwac

SEQ ID NO: 21160 - DNA, 112 bp, Homo sapiens
gggttcagcaggggggagggggaacagcagctgcagcctcagcatctcctccagcttctccttctgctcttctcgagctcttggataattcttcctcttttttcccctagcc

SEQ ID NO: 21161 - DNA, 368 bp, Homo sapiens
  misc_feature 10: n=a, g, c or t
  misc_feature 300: k=g or t
  misc_feature 362: d=a or g or t
cttcgaagtnggttttttaaacctttctttctcaaaagtgacctaagaaagaattgctcttatactcatagcaaatgagaactggaatagcgtaaagattttctagtttaactccttgatttcatagaacccgaggcatgtaagggttaagcaacatggtagatttaggactagaactcaggaataagactctcaggagatctctttgcctgaggttctatacctatttgccagaatcctgtgggggtaatctgtaagtctcatcagatttctctaaacatttataaattggaccatgtkatacctcgtgttacacaaatttgtttcctcactgggctataacttggacatctttctatgtdgatacc

SEQ ID NO: 21162 - DNA, 122 bp, Homo sapiens
  misc_feature 31: w=a or t
  misc_feature 118: m=a or c
  misc_feature 121: r=a or g
  misc_feature 122: n=a, g, c or t
tccacaaggtgcagtaataaaaataaataawtacaaaacttaaaaaaagaaatatttgtggattctgattagaaaaaaaaattcaccctcactaattacacacataccagagaaagcmaarn

SEQ ID NO: 21163 - DNA, 277 bp, Homo sapiens
ttggcggtcgcagcatcacagcgttggccggctgctgcttagctttattttacttgtgatttttctttgttatgcaccgaacagattcccctctctggtattcagtggggagcatatagccggaggatagcaattagctatagctaggcctgctcctctttgcacagctcaagatgacgtgtacaattactttggcacctcaccagctctttcagaccttttccatgcatgatgggaagacaggtccattctctgagagtccctcactccctccccc

SEQ ID NO: 21164 - DNA, 101 bp, Homo sapiens
gagtgctttccggggaggcgaccgccgcggtggaaagtgcaggagtgggcgaggaggaggaggaagaggaggtgatggcgacggaccaggggagggggaga

SEQ ID NO: 21165 - DNA, 128 bp, Homo sapiens
gttttggttttgtttattatttagccatcctagttggtgtgaggtggtgtctcctggatgttttgatttgcatttcccagatgactaatgatgctgagcatctcctcatgtgcttcttggccacctgc

SEQ ID NO: 21166 - DNA, 88 bp, Homo sapiens
ttcgcgcataggcaatatggtcccgctactggacccatttcctacctgggaaatggagtcgaagctgactcaaaacgtaacggccgct

SEQ ID NO: 21167 - DNA, 77 bp, Homo sapiens
aagactatactttcagggatcatttctatagtgtgttactagagaggtttctctgaacgtgtagagcgccgaaagtc

SEQ ID NO: 21168 - DNA, 327 bp, Homo sapiens
cctttctggctgtggctgactcctcggacactcttccttctcatcttccttcggcttctagaccacagtcttcttctttgctttttgtccttccaggcagattggcaatgaaagttgtgccgctcgatgtccctgaactgccccaggcctcctcctcccctcaaggcactccacggctagccacctggcagcctgggctgctcactagaaggctactgccctctaccccactgctttcatgatcaccctccctcagacctccagcctgctctgtagcctcatggcctccatctcccccaccctcactgctgtgattctgtggccccc

SEQ ID NO: 21169 - DNA, 160 bp, Homo sapiens
taatgataatcagttactttataccctaccaagccttcctttcttctctatgagccctaacgcaccatcagcaaagaatcacagccatcagacagccataggcttgggttatgcatgcttgtaaagaaagtgagccttttagaatcatcccagcaccacc

SEQ ID NO: 21170 - DNA, 173 bp, Homo sapiens
  misc_feature 118: r=a or g
  misc_feature 121: s=g or c
  misc_feature 122: s=g or c
  misc_feature 127: b=c or g or t
  misc_feature 128: w=a or t
ttttccccctccttgcacctagcagggagaggagtgtgcggaaagatggagttgagacagaaacttgttagcataacaccgaagagttttgctgtgagtagcatcagcatagcaggargassatccbwagctctcctgccgctgctctgccacaaggagagaaagggaaagca

SEQ ID NO: 21171 - DNA, 332 bp, Homo sapiens
  misc_feature 11: y=c or t
aattgaaagtygggaaactctgggtagagagtcctgggagagaaagtttagggatctctcaaggtccttcaagataacccattatgtattagggaaaactgaaaattgcatcctcattaatttaaggcaaaatcaacagaaatctagacttatgtcagcttatttcacagttaagaaatctaagcttatttccttctgatgccatcttgccactcctgataaatccccaaacagtttcccggctggtgcggattcacgtatggccagacagtgggctgctgtatcattcactgaataacacattggcattccccattgatcgctgccacact

SEQ ID NO: 21172 - DNA, 104 bp, Homo sapiens
taggtgtgtgtgtgtatgtgtgctgtgtgtgctgggatggtcttggaacgcggagtgtgcccatcggtgcctgccacttgtctctctctctctttttttttttt

SEQ ID NO: 21173 - DNA, 208 bp, Homo sapiens
ttcttgtctcgtcacggccataactagggaggaaggagggccgaggagtggaggggctcaggcgaactggggtgctgttgggggtatccgagtcccagaagcacctggaaccccgacagaagattctggactccccagacgggaccaggagagggacggcatgagcgacacacacaaacacagaaccacacagccagtcccaggagcc

SEQ ID NO: 21174 - DNA, 255 bp, Homo sapiens
  misc_feature 201: d=a or g or t
ttgctatgccactgctaggttaaaacaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgtdcaggtgataaaagactgatgaaagtcatccctcactgttagtaaggaagcagta

SEQ ID NO: 21175 - DNA, 267 bp, Homo sapiens
caactgtgagtttcatcatgtgtgtccgttgagcttgcttttaagagcaatgttttgctttgctctctggtccatgaactcatttccatttgagtgagctcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggcccgt

SEQ ID NO: 21176 - DNA, 136 bp, Homo sapiens
ggaatgctttcaacttttctctgttcagtatagtgttggctgtggtttgtcatagatggcttttattacctcaagttatgtcccttctatgccaattttactgagggttttaatcataaaggatggtggattttgt

SEQ ID NO: 21177 - DNA, 227 bp, Homo sapiens
ccttcagcgacagttttacagcagataatgtctgcacgacatgggcggaggaggcaaaaccctcccctactcctgccagtcctcatttgtctttcatgctttcccttaaagaaataaagcaccaagaaaacgaagcctttgaagaattccaccattccgttatatttcaaggcaccccctcattaagggaaggttggaggatttaaaattaaacacacacaccccag

SEQ ID NO: 21178 - DNA, 186 bp, Homo sapiens
attatcctagtcagagaagttagcaaaagcttccctaaagaaaagatgaactcttctcatggaaggatgaaaatatgtaagacagtgagtgccactgacacagagatagtactacacaaccgtttatgaggagagaacaagcaacctgacttacaggaagtaaaagaagatcattgtgactggagc

SEQ ID NO: 21179 - DNA, 176 bp, Homo sapiens
taagttattttataatcgagtctatattttccttgttgaattgagtttatgtttttgcttgctaatgttatttaaaaaatttatccatatgatttgtatttttgtggttttaattgtaaaaatttaaaattctaaattataataatttattttggcttaggagtgaattggggatc

SEQ ID NO: 21180 - DNA, 184 bp, Homo sapiens
  misc_feature 161: d=a or g or t
agatagcagaggggaaatttctagggagatcaggtttcatttttgtgtaattacatactctgttgaatttaattatttcatagttaaattcctggaagacaaatgtctccttggtatataccttcattttctttgtggtgaagtcaaactttttctaagtdttttttcaatgagaaattgtgtt

SEQ ID NO: 21181 - DNA, 418 bp, Homo sapiens
  misc_feature 20: k=g or t
  misc_feature 204: s=g or c
  misc_feature 205: m=a or c
tctatataaatacctactckcttaggacatgtgatattgtggcatattgccacgtttccatagtggcaagtttttctcattccttgttagtggaggaaccacgggttgagacatggaagtcacctggaacataagacacaggcttgcagtgcaccacaccactgtgtccattgtttaaggaacatgttggtctcatctggctgsmtcttgtgggactcgcagctcctgccttattccatttgaagattactatttgctatggaaaaagtgatgtcaaatttatggggttgggcttggggccatgaataaacacaaaatagttgaccccacagggtaggagttattattaggtttaggagtcgccaccttatgtgggtcaccaccccaggccctgctttttgggtggagcagtctggca

SEQ ID NO: 21182 - DNA, 86 bp, Homo sapiens
acttgtgcggcagtcgggtgggaagccgtgtctcgcagagaggctgatgacatcgtgaactggctgaagaagcgcacgggcccaca

SEQ ID NO: 21183 - DNA, 183 bp, Homo sapiens
  misc_feature 44: w=a or t
atttttctatttattttattgctgtctaatcaataaagaatgcwgagctgtcaaaaaatgtgtcttacattagctgtcccaacaggattgtcttccctcccagctctgttttaattggcttttagacccactatctgtcagatccttgccatctgtcagtgtctgcctgcgccacccccgacg

SEQ ID NO: 21184 - DNA, 126 bp, Homo sapiens
  misc_feature 32: d=a or g or t
  misc_feature 97: s=g or c
cttctctgggggctgaggtgggaggatggctdgagcccagaaagtggaggttgcagtgagctatgattgtgccactgtactcctgcctgagcaacasagcaagaccctgtctcaaaaaaaaaaaaa

SEQ ID NO: 21185 - DNA, 228 bp, Homo sapiens
ttttatgcctcaaacaagataccccggccaggactaagttggggagtttgaggggccaagatgaggaacacgagatcaggatcatgcagaaatctaaaggaaacaccagctctccgacattgcaacctgggccagaaaccaccagtgacctctgctaactttgtcctttcttccaggtggaaaggggaaaatgtggccaccccctgaagtcgcctgccgccgccgcca

SEQ ID NO: 21186 - DNA, 455 bp, Homo sapiens
  misc_feature 157: r=a or g
  misc_feature 346: k=g or t
  misc_feature 348: n=a, g, c or t
  misc_feature 379: r=a or g
atttttgaggcggtcctcctagcggcctgtagtacaaaatgtcaaaaattagaaggaaggtcacagtggaaaataccaagactatatctgatagcacatcccgaagacccagtgtattttgagaggcttggacccagcactggcagtacagcagagrcacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaackgnaatacagaggagtcatcctcacctgttaggraagaatcttcaagagggagacatagggaaaaggaagacataaaaatcactaaggaaagaactccagaaagtgaaga

SEQ ID NO: 21187 - DNA, 251 bp, Homo sapiens
  misc_feature 119: r=a or g
ccatttctttcagccagatcctcccagggaatcactacaggctggttagccaaaaagtcctgattttctgctcaatagaggtccttactggaaggcagcatgtccaatgttaccttgargaaaaatgtctcccacaggaaatgagatgaagagcaccactcagggaaccacacggaagcagcaggattttcacgaggtgaacaaaagaagaactttcttacaggataacagttggataaagaaacgcccct

SEQ ID NO: 21188 - DNA, 243 bp, Homo sapiens
atctaccaccgagcaaaccatcagagaaggcacccagcgaagggctgtatctttcatctttggaaatggactgaagagatatttaatgtgtcaagagctctacttccgggagaccaatatttcttttttattcagttatttcaaggagggctcccagtaaattttgcttggtaaggagattaatttcagagccatggactcccgtaggatatatcctggatgtttacgttgcaaaaacccggg

SEQ ID NO: 21189 - DNA, 213 bp, Homo sapiens
tggatggatggatggacgaacggatggatgggtaaatgaatgggaggatgggttgatggatggatggataaaaggaggatgcatggctggatggatgcatggatgcataaatggatggataaatggatggaaggacacatggatacctagaacacggagaccctgaggagctggagaggcctcagtgactggtctaagttcaccaccaggagt

SEQ ID NO: 21190 - DNA, 379 bp, Homo sapiens
ggagagaagaacacatgtctcctagccctcacagacaccgaaaagacctgtggaattttgtgtttgagaactccaaagcctcaaatgggtgttcctagttagatcaggtagtatcctccccaaccgtggttaaaaaaacaaatcattctttcttagataaagctgccagaattaatttaatgattaaattctctaacagggtattttaaacattgtttacatatgaaatgtgcatctgctgccaactctactgtcgaatatgaggtgcatataaattagaactgcacagagttatagaaatgtgaaacattctgaaaggggatttttctccacttccactattccaaggagaaaagcctgaacaagagtgtcgtgcgat

SEQ ID NO: 21191 - DNA, 118 bp, Homo sapiens
ttgtcttcagctcaacaattctttctattttggggaggcacatgctggtctcccacattatcatcctctgtatggcaaaaaacctagtcttaaataatcatgtacttctccactgcca

SEQ ID NO: 21192 - DNA, 197 bp, Homo sapiens
  misc_feature 183: k=g or t
taatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagtkttgcactggccaat

SEQ ID NO: 21193 - DNA, 373 bp, Homo sapiens
  misc_feature 288: d=a or g or t
  misc_feature 289: k=g or t
  misc_feature 291: k=g or t
ggttaaatggattaagggcggtgcaagatgtgctttgttaaacagagtgcttgaaggcagcatgctcgttaagagtcatcaccactccctaatctcaagtacccagggacacaaacactgcggaaggccgcagggtcctctgcctaggaaaaccagagacctttgttcacatgtttatctgctgaccttctctccactattgtcctatgaccctgccaaatccccctctccgagaaacacccaagaatgatcaataaatactaaaaaaatttaaaaaaaaagagaagdktkcgagagaaacagtttataaaagtgaaagttggccagatgtggtggctcatgcctgtaattccagcactttgggaggccgagg

SEQ ID NO: 21194 - DNA, 126 bp, Homo sapiens
ctgatctcgaactcgtgacctcaggtgatccgcctgcctcggcctcccaaagtgctgggattacaggtgtgagccaccacacccggcctgtctccaccatcttaagtacagtggaggggtctgcat

SEQ ID NO: 21195 - DNA, 219 bp, Homo sapiens
  misc_feature 130: k=g or t
  misc_feature 157: k=g or t
  misc_feature 179: k=g or t
tgatatattcaggatttacacattaaaatgattatttaaattgtggcagtgatggggtttactttcatgaatttaaattgtttttatttctgtaacaattgcttccaaatattgactactaaaggcagtkctgcaagatgtactaaatatgtatatkagaaattatagaaaatcatgtkgtccgttttcaaattcatcaacagcctagagtgcctgcgg

SEQ ID NO: 21196 - DNA, 245 bp, Homo sapiens
  misc_feature 7: k=g or t
  misc_feature 8: k=g or t
gcaaaakkacttcaactgcgtggaaaaataaagacattaccatgcagtccaccaagcagtatgcctgtttgcacgatttaactaacaagggcattggagaagaaatagataatgaacaccctgtgctgtctttgaaaataagtcttcagacatgtgtgtcggaaaagatctgcaaagcttggtacagtgttaatgtgtaaagagaaccaatcacctccatggactataaactctctgagggcaca

SEQ ID NO: 21197 - DNA, 65 bp, Homo sapiens
ggttgcagtgagccaagactatgccattgcactcagcctgggtgacacagcaagactctgtatca

SEQ ID NO: 21198 - DNA, 408 bp, Homo sapiens
  misc_feature 215: w=a or t
  misc_feature 229: y=c or t
  misc_feature 235: w=a or t
  misc_feature 243: w=a or t
  misc_feature 249: d=a or g or t
  misc_feature 254: w=a or t
  misc_feature 257: w=a or t
  misc_feature 260: k=g or t
  misc_feature 263: w=a or t
  misc_feature 277: w=a or t
  misc_feature 304: w=a or t
  misc_feature 308: w=a or t
  misc_feature 314: k=g or t
  misc_feature 349: w=a or t
  misc_feature 375: y=c or t
  misc_feature 377: y=c or t
  misc_feature 386: d=a or g or t
tattggtaccactgttcttacctgtcagttgtactttatttacttgttatttatactattagcctcactgatgcatatatgcaaaaatgcactttttacatttaaaaatctgatacagttgtgtaaaaatcagatactatcagattgatgtaatatgtgattgtcacattttttcttgaaaattagcttgatgggttaattttcttttttttttwatgtttacagtatycttttwatttattwattttdatttwatwatkatwatactttaagtttwagggtacatgtgcacaatgtgcaggtwagtwacatakgtatacatgtgccatgctggtgtgctgcacctatwaactcgtcatttagcattaggtataycycctaatgcdatccctcccccctccgcccacg

SEQ ID NO: 21199 - DNA, 73 bp, Homo sapiens
ctcattgaactcgcctgcagctcttgggttttttgtggcttccttcgttattggagccaggcctacaccccgg

SEQ ID NO: 21200 - DNA, 82 bp, Homo sapiens
  misc_feature 10: s=g or c
  misc_feature 19: s=g or c
  misc_feature 21: n=a, g, c or t
gagcgcgcascctgcgcasancgcccactggtcccgtcctgtgagccccggccccagccgcggacagacccgcggagtcgcc

SEQ ID NO: 21201 - DNA, 122 bp, Homo sapiens
ctgttcgttagggttatcgaagtgtataaaggtgcagggaaagtgagactgtgtaaaacaaagcggattggggcgttgtgcttccttgtacctcgtgagcctccgttgccttgggcggagac

SEQ ID NO: 21202 - DNA, 114 bp, Homo sapiens
gaaaatcaaaggaaatgttcattggaagatttcaggttttcagatttgggatgctctgtggtacatatattccaaaatctgaaaaaaatttgaaatctgagacacttctggccc

SEQ ID NO: 21203 - DNA, 140 bp, Homo sapiens
  misc_feature 120: r=a or g
cattctgtgtgcccctcctctttccttcctccttccagccctgacagccacgaatctgctttctgtctctgcagatttgcctatcttgaatatctcatgtatgtggaatcatacatgtgraacatttgtgtctggctttg

SEQ ID NO: 21204 - DNA, 171 bp, Homo sapiens
ttgcaaaattgtggaacgaacccaaatgctcatcaatcaatgaatggataaagaaactgtggcatacagaaatacaaactatcatctgaggatactataaacacttctatgcaaataaactagaaaatttagaagaaatggataaattccttgatacatacacccacccag

SEQ ID NO: 21205 - DNA, 251 bp, Homo sapiens
ctttctctctctgtcactctcactctttcataatccttgttcatactcatctcccgggaatactgtgagaatcagaggggctgatgtacttggcaacgatctgtagaccaccaagcactagaagaggaagaggacacccatcatcacagagcaggtggcctcacacacccacacctatcagaactgggactggcaagaggcagtgggacggcatttagagaagaggctggaagaaggcagattccaccccc

SEQ ID NO: 21206 - DNA, 234 bp, Homo sapiens
catcacgttgtgtcacaatgggagtgactcacagagcaaggagagaacctgaggattcctcacacatgtagtactcagagctctacggaaaccaggcacctcgacctcaagaggatcagcctggccagggtggcacaactcttccttccccgtgcacagcaggaaagctgccatcagctgagcaagtccaccaacagtttctgtgtcccacttcatctttaataaggacaccac

SEQ ID NO: 21207 - DNA, 114 bp, Homo sapiens
catttttatagttcttaatacagatggccaaattgctttctgaaagagaagcttttcttaagtatttttctccaacttgtatcttaaacatcctgaacatgcttagcaccaccg

SEQ ID NO: 21208 - DNA, 334 bp, Homo sapiens
  misc_feature 304: r=a or g
  misc_feature 310: r=a or g
  misc_feature 317: m=a or c
ctgaaaagggattatttcaactgttcaaattcttgaaacatctttacacaggtactattcattggatccttactgttgtacaaaagcccatgcttccagagttgcatcagaacctttcgtgaagttttattcttcatttttgtcctcctatgccatagttaaggggcataaaaaaaactagtggggtgggcctggtggctcacgcctgtaatctcagcactttgggaagctaaggcgggcagatcgcttaagcttaggagttcgagaccagcctgggcaacatgatgaaaccctgtcttaaaaraaaaargaaaagmctagtagaaacccccca

SEQ ID NO: 21209 - DNA, 84 bp, Homo sapiens
ttggggaagcacagttttgttattataataagttttaatttaaaggggaagaaagagttgcaaaaatatagaaaaagcccattg

SEQ ID NO: 21210 - DNA, 225 bp, Homo sapiens
atgtcactgaggaacattaactgatatggaacaaattcatgatacagtgttatataaataacaacaataataacaaaattgcttgccatttctgtgtgccaagcactgctctaagcaccttacctgttgctctcctttccagattagctgattaagtagcttgcccaggtgcacacaggttctaagcagtggactcaggactccacacagacacacttcacccca

SEQ ID NO: 21211 - DNA, 462 bp, Homo sapiens
  misc_feature 359: y=c or t
  misc_feature 360: k=g or t
  misc_feature 461: v=a or c or g
taaaattaaggttcttatcagtaacaattaaagttcttattcagctcttttcatcagtcctagcatacattcactgtgaagctggtacattggtctacattgattagccccaatgaaagtgcagtgatttaagacacttgtattagttagagttctccagagaaacagaaccaataagatgtgtgtatgtgtacatacatgtacatacacacagacacacatataaaatgtatgtgttatatatataccatatgtacacacatatctctttacatattatttagaaagagagagattgagatatattaattttagggaattgactcgtgtgactgtggaggctggtaagtccaaactcykcagggcaggatggcaggctggagacccaggggaggggttgaagttgcagtcccggtgaaaaggtcatctgctagcagaattccctcttcctcctgggagava

SEQ ID NO: 21212 - DNA, 121 bp, Homo sapiens
agagtggaagcaggtgagaatggagggggcggcaaaggctcgtttctgggcatctctgcagtcctcctctgctccatgatgtgcactttgggcgaggagagtgcgtgcgtgtaagagggtc

SEQ ID NO: 21213 - DNA, 251 bp, Homo sapiens
tctcgctcactcggtgctcaatgttgcccctgctgcagtgcagtggcgtgatctcggctcgctacaacctccacttcccagccgcctgccttggcctcccaaagtgccgagactgcagcctctgcccggccgccaccccgtctgggaagtgaggagcgtctctgcctggccgcccatcgtctgagatgtgggaagcgcctctgccctgccgccccctctgggatgtgaggagcgcctctgcccggccgcta

SEQ ID NO: 21214 - DNA, 97 bp, Homo sapiens
  misc_feature 59: r=a or g
aacttttcaacttggcggggaattcctctccctcttacacagtttgcagcgcgggggcrgcggggtgacagtccccgtgcatgaatcagccacccct

SEQ ID NO: 21215 - DNA, 202 bp, Homo sapiens
atcatgtgtgagtagatttttgaagtaatttaattaccttgcacagcaatgaaatctggtttctgctttcattaatgaccaatgacatgggctgaggtttcctgacaccctgggggagaggagtttatgcaaccccaggcagcctcaactgttctgttctgatcagtcctgaccttgctaccaattgccccctgcccctccc

SEQ ID NO: 21216 - DNA, 179 bp, Homo sapiens
cagcaggggaaaagcacagactggagctatagaaatggttgctgcccttccccagcccagggagtttggtgtattaggcagttgtgagtcccactgctggctgctgcctttcccccaaggagttcaaatggcttagactgcaggcagcatcagcaggtgctggtcagccctccccctag

SEQ ID NO: 21217 - DNA, 364 bp, Homo sapiens
  misc_feature 300: s=g or c
atttatggactctgagaaattcacataacacatatgccgatgctgcgttttctttctgcttgatccgttccagcttttattaagtttaatgcctgactttcattaatttatgaggagttgtgaactgcaatctgaaatgctcccctgaattttagagttttcttgcagggaaaatttcacgtgagctcatcctgacccttgctaatatttcagccaagcacatagtttattgtctaatgacctttcaaggcccttcagtgatgttggcacgtgctgtcatattctgagggtggtgcgcastagtctttgtcagtgttgatttcattctgcctcatacctgatttatcaaacctgagagcccacc

SEQ ID NO: 21218 - DNA, 179 bp, Homo sapiens
agcagacttagaaagtacacatgcactggggctccccatggctgctcttggaaccttgagaccaccatgacatgagaaggcccgggcagcctgctggtgggtgagacattgaagtggaaggaggccccagtcatcccagtcatcacagatgagaccattataaaccaggccaccgcgga

SEQ ID NO: 21219 - DNA, 99 bp, Homo sapiens
tatattttccaattagttggtgtctaaaaataaatgttttgtctaattttagatcaggtatacattcacaaaagcataaatcatagtctcacaggaaat

SEQ ID NO: 21220 - DNA, 278 bp, Homo sapiens
  misc_feature 145: k=g or t
cttagcattattatgaaaatggatcttagggcctcctgcctgtctgcagaccacattttgagaactgctgatttaaataattccttgttgataagcacttaagatgttttcaaattttccaaactaaaaacgtcatttgtttgtktttgaagacagggtctcactctgtcacccaggctggggtggcgtgtaatctcggctcactgcagccttcaccttccgtacccaagccatctttccaccccagctggggccccacaggcatgcaccaccactca

SEQ ID NO: 21221 - DNA, 292 bp, Homo sapiens
  misc_feature 4: v=a or c or g
ttgvtattattgataaacagagaacacaggttgacaaaagacaagagaggccaccagaaatccatgaagacagagcctcttctggagagagcaggctgttggccaccctgagacccctccccaacttgcgcctggcctggattttgcaggggacggggctggggagctggtgctggtgtagccaccggccctgacacccagccgcgtgaccttctctcgtggcctcacagtcctcccttcaagggtcccaggcctgcccctcgaggccctctgccctccaggagcgccccca

SEQ ID NO: 21222 - DNA, 200 bp, Homo sapiens
catctttcggcctagatggaggaaccgtgtgctggctgggcaggctgctggcagaggtcaggagggctcttccctgagccctgccatccatgaactgtgtaactttgatccaggccttgtccctctgggcctcagtttccccaagctggatgtgtcgtccccctgcttcattcataatcaccaccaccaccaccacctgc

SEQ ID NO: 21223 - DNA, 192 bp, Homo sapiens
  misc_feature 6: y=c or t
gttttycctggggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggcac

SEQ ID NO: 21224 - DNA, 289 bp, Homo sapiens
gtgattctgatttttcttaagacaggattctaggctactctatatgagagccagggccaggcagaggctgtggagaccagagtcggggtcagaatgatagtccagccccacagtagcctgctcctgtccttctgggactccctggagactggaccctagcacctccactcagcctcaccctcctcacttcctctgcagaggtctattctaggaaaaggaaatggccggagctggcaatgaggagctgtgaccacagggtggcagcagtgcttcagctgtggagagtgac

SEQ ID NO: 21225 - DNA, 181 bp, Homo sapiens
caggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatg

SEQ ID NO: 21226 - DNA, 136 bp, Homo sapiens
tattgaatagactcctgaatcagtaaagattctgatcctatctctatgaggaacatgcattgaatgctgagaaaattagcctgatcctaaatgcttcattattattttttcctcccaagaggcctttcaagggttg

SEQ ID NO: 21227 - DNA, 276 bp, Homo sapiens
  misc_feature 27: k=g or t
ccccttttttcatcttctatgtttatkttcttccaagaatagattattctttccagtttaaatcactttagcctcttttggctccttccaaccaagttctttcctaaaccagttatcttactcagtattttagaagtccaggagcattgtcttgatttcatttggtttgcccttaccaactttctttgcatcattttatttaatcttaatgcctcacatcagtgagtattccctgacctcctgggtgtctcccttctgtgtctctgtggtgccccg

SEQ ID NO: 21228 - DNA, 400 bp, Homo sapiens
aaaaaatttttttttttaaaaaaggacaaggtcttcctctgtcacccaggctatactgcagtatatttaacccataaatgggttaagaatattaccttcccacagggctgcatttgaatacatttcttttgatgcaacccgtattttttgtttaagctatttcctttagaaagtcacttatattctgcatatgaatttactggaaaaagaaggctcattggaatgctggcaatggctagtgtgctcatgtgtcaattagtgccctgtcctaagaacaatatgaggagataggatacaaaattgttaagtctttcaggaacagagggaaactaaaagcatcttgaggatgagaagacttttttaaaaaacagatccagaaaacaacaacaacaactacagt

SEQ ID NO: 21229 - DNA, 112 bp, Homo sapiens
tattctgggtatttcatataaatggaatcatatgtgtccttttatgtctggcttttttcacttaccataatgtttttgtggttcatctttattacagcataataccggtgcg

SEQ ID NO: 21230 - DNA, 183 bp, Homo sapiens
  misc_feature 158: v=a or c or g
agtctaagctggtattgttactacttgaaattcgtagtgttggagaactatgctggaaatttttaggatcatctgggttagtctgcttttatgtaataaacctgtttttaaagtggaagatgactaaagctcttgcatgtgaacagatgctgattttvatttatttaaaggaatcatgcagct

SEQ ID NO: 21231 - DNA, 127 bp, Homo sapiens
gtatatgcttctcacagcctctgcatccttctatgagaaatgattgtgttggacttgaactcttaagtttgttattggctccaaaataccataatgctatgaaaataggtgccaattgtccctgtct

SEQ ID NO: 21232 - DNA, 128 bp, Homo sapiens
ctcatcataactagtcattagagaaatgcaaataaaaaccacaatgaattatcacggtggccattatgaaaaaaatcagatagtaacaggtgttgcccatgatgtggagaaattcagaccctggtgcc

SEQ ID NO: 21233 - DNA, 258 bp, Homo sapiens
  misc_feature 238: n=a, g, c or t
  misc_feature 239: n=a, g, c or t
aaacagtttgcaaaaatagaggaatctactccagtgcacgattctcctggaaaagacgacgcggtaccagatttgatgggtccccattctgaccagggtgagcacagtggcactgtggggcgtgcctgtgagctacacagactgtgctccttcacccgtcggttgttcagttgtgacatcagatagcttcaaaacaaaagacagctttagaactgcaaaaagtaaaaagaagaggcgnntcacaaggtatgatgcacc

SEQ ID NO: 21234 - DNA, 228 bp, Homo sapiens
  misc_feature 135: k=g or t
taattgggcagccagggtctcctggagcatggcggtgacattcagagccccacagcaactccgggcatcccacctctgcctaggtgggatacatcttgagcctacggcagtccctctgtcggtctcatgagccakcttcttcctgtggttcttgcctcacctccagtaggccatgggcttccctccccagtacctctgttacaggacccctgccccctccctgctgtc

SEQ ID NO: 21235 - DNA, 431 bp, Homo sapiens
  misc_feature 11: s=g or c
  misc_feature 404: k=g or t
ccttgcttccstaacagactttagccctagggaagtcagacctgatcagtgcagggcgttcttgccgataagttggggatggttggacctgagcacctcttggtcagctggcctctcccagggctccaggctacccacacctgcttgcagtgcgacctcggttgcccaggtggggtcccttatgggggtgtacatcatagctcctgtgctggtgaactgcagttgataaatcccatagtcgtgcaacagcccacctgcaccttcccaaaactgcggcctctctgagacactttgcctgcatgcattcacctatggccacccccgacgttgctttgccagcatatgtgcatgcaagtggaccttgccttctcttttccaccagcatgcgtgtgcatgtgcaccckgtcatgctacagctgccagtgtgagca

SEQ ID NO: 21236 - DNA, 83 bp, Homo sapiens
  misc_feature 20: b=c or g or t
ctctcggtcccacgtgtgcbagttgctacgatggaagttaaagggaaaaagcaattcacaggaaagagtacaaagacagcacg

SEQ ID NO: 21237 - DNA, 246 bp, Homo sapiens
  misc_feature 134: n=a, g, c or t
  misc_feature 135: n=a, g, c or t
  misc_feature 138: k=g or t
agctgtaatttctcctgggcagtgtgatttgcaaccaggagcagccttatggcatagaactgatctgcatatgtcattgctgggtgcctcagcttgctccttcagtcagttagggtagtgttccaaggagtgtnncakttgcaaggagcaggagcaaggcagaccccactctggctagcctggattgggagcaagggccacacttcccttctcttacaagaaccagatgcaatggtgccccctccg

SEQ ID NO: 21238 - DNA, 75 bp, Homo sapiens
  misc_feature 3: k=g or t
aakactatactttcagggatcatttctatagtgtgttactagagaggtttctctgaacgtgtagagcgccgaatt

SEQ ID NO: 21239 - DNA, 257 bp, Homo sapiens
aaaggttattaattaggcaatatacagcagcacctgacacgtaatatacattatatacagcacctgacacggaagtgctcagtagtttgccattataaagtagtttttatatagtgagagctgttaatcatttactcaattcataatgcttatatctgaaatttatgtagcttttctgaattaagaaaaactttgcagtttgacttttaaacaaatactatttttttccttctgggtttcaagatataacaggcaca

SEQ ID NO: 21240 - DNA, 444 bp, Homo sapiens
  misc_feature 215: w=a or t
  misc_feature 224: w=a or t
  misc_feature 230: k=g or t
  misc_feature 237: w=a or t
  misc_feature 264: k=g or t
  misc_feature 280: b=c or g or t
  misc_feature 282: w=a or t
  misc_feature 285: n=a, g, c or t
  misc_feature 291: k=g or t
  misc_feature 298: w=a or t
  misc_feature 326: d=a or g or t
  misc_feature 346: w=a or t
  misc_feature 371: m=a or c
  misc_feature 377: w=a or t
  misc_feature 381: k=g or t
  misc_feature 404: k=g or t
  misc_feature 409: y=c or t
tatttggcataaacgaatttagttttctttttccctctctcacatatattgacattttcatttatctccaatttatcttcgctatcttatctcattcacaggagatgaggtgctccttctctgcatcctcaatcgagtccaatcttttcacttttacatttgatctcatcttttttttttgtcaacagctacattactccatcaatatatcctcwattccattwatattkgacctcwaactccttcagtcacctctctcatcckgtttataaggaatttbcwacngttttkcattccwaagctcctcctcaaataaaaagcctttdattaaccatacacaccctawttatacttacaatcactaatctctmagtttwaatkgattcaccaacacatttcagttkgtttycgttttcatcctcaagactaattaaacatgaaaag

SEQ ID NO: 21241 - DNA, 65 bp, Homo sapiens
gacatgaaggtgtgcccctgtggtttcagatactcaggagggtgaagtgggaggatcgcttgagc

SEQ ID NO: 21242 - DNA, 181 bp, Homo sapiens
aaaatctttgcctaagccaatgtctagaagagtttttccagcgttattttctaaagtttttatggtttcaggtcttacatttaagtgtttgatccatcttgagttgatgtctgtataaggtaagagatgaggatccagtttcattcttctgtatgtggctagacagttatcccagcaccgc

SEQ ID NO: 21243 - DNA, 329 bp, Homo sapiens
  misc_feature 60: w=a or t
  misc_feature 61: m=a or c
  misc_feature 280: n=a, g, c or t
  misc_feature 281: n=a, g, c or t
  misc_feature 298: s=g or c
gtgacggtgctctcgggcagggtcacgtagactttgctcaggcaggacacgccttcctgwmcctgctcctcattcttggctgtcaccctgaagaatgggtctgggtagggagaggaatgaagagagcccagtggctcatttctgaacatctgccgcgagcagtgccctgagcctggcgccgcagggagagatgagcgccaccgagacaccagccccaaagtccagtaggggaggccggatccacacaggagcagaccacgactgcctcttccagaagagnntgcagccgcagcgtgtstgtctccactcagtggctggaacatcctcca

SEQ ID NO: 21244 - DNA, 413 bp, Homo sapiens
  misc_feature 8: n=a, g, c or t
  misc_feature 9: h=a or c or t
  misc_feature 10: m=a or c
  misc_feature 14: m=a or c
  misc_feature 66: r=a or g
  misc_feature 73: s=g or c
  misc_feature 159: k=g or t
gagtttanhmggcmggggcttacagtaggcgggagttggaggcgataacgatttgtgttgtgagargcgcaastgcgatttctgctgaacttggaggcatttctacgacttttctctcagctgaggcttttcctccgaccctgatgctcttcaattcgktgctccgccagccccagcttggcgtcctgagaaatggtgagtaacggtcccaaccgctgctcggagctggcggaattcatttcccccgaaacacacgccatctccgaccagggccgactcccaattctgaactcagcttctgagttctcccatggcaagggtaaattagtgttagcagggactactaaagaaagctgtactttcatcccctcgggacacttgtaatcgtaatcgggcttttaaaatcgtaacgt

SEQ ID NO: 21245 - DNA, 111 bp, Homo sapiens
  misc_feature 88: k=g or t
  misc_feature 89: r=a or g
actgattaggatttgatttcttgaaaccctctaggtctctagaacactgaggacagtttcttttgaaaagaactatgttaattttttkrcacattaaaatgccccagcagt

SEQ ID NO: 21246 - DNA, 371 bp, Homo sapiens
  misc_feature 86: r=a or g
  misc_feature 317: s=g or c
  misc_feature 318: n=a, g, c or t
  misc_feature 320: r=a or g
  misc_feature 340: m=a or c
  misc_feature 341: s=g or c
  misc_feature 344: r=a or g
  misc_feature 345: k=g or t
ttatcaggatgttagaattggttgttctaggctaggtaccttcaaacaaaaagttttctctttcaatgaaactgtcagtgattcartgcctattatattcaacctctgtgtggaattagaaagatgcccttaagacaaaatgtagtccacgtacccaaataactgtaacatgagggagaatgtgagtattgtaatccaaaccccaccatgcactgagagcacagaggaggatgaaataaattgggagattggaaaggtgagagggtgagagaatgatctgggaaggcttttccttgtaggatagttaagattttcasnargggaataaatggagaggaamsgcrkaccagagagaggcaatattagagtca

SEQ ID NO: 21247 - DNA, 432 bp, Homo sapiens
  misc_feature 344: k=g or t
gagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatgggctctctacttcgaattggacctgggaaattcgagtttgggaaggataagtacaatcatkggtttgatgggatggcgctgcttcaccagttcagaatggcaaagggcacagtgacatacaggagcagtttctacagagtgatacatat

SEQ ID NO: 21248 - DNA, 121 bp, Homo sapiens
ttttttgtagagacagggtcttgctatgttgccctggttggtcttgaaatcctgggctccatctgtcctcacgcctcagcctcccaaagtgttgggattacaggtgtgagccaccacccct

SEQ ID NO: 21249 - DNA, 98 bp, Homo sapiens
ccttgcttccaaaacaggcctatggtgagatcgtaccaaccattacaggataagattacaaagagaaaattatttttattccattctgaggggatggt

SEQ ID NO: 21250 - DNA, 266 bp, Homo sapiens
  misc_feature 7: y=c or t
tttgggyagcctcaatgggacttttgtgaatgatgtaaggattccggaacagacttatatcaccttgaaacttgaagataagctgagatttggatatgatagtccaggtgctgtggctcacacctgtaatcccagcacttcgggaggccgaggtgggcaggtcacgaggtcaggagttcgagaccagcctgaccaatgtggtgaaaccccgtctctactaaaaatacaaaaaaatgttttaaataaccagtcatggtggcacgcat

SEQ ID NO: 21251 - DNA, 54 bp, Homo sapiens
aagaagaaaatagtccatagtcttactaaccagagatttttttttttttttttt

SEQ ID NO: 21252 - DNA, 272 bp, Homo sapiens
  misc_feature 7: m=a or c
  misc_feature 135: k=g or t
aaggtcmctggatgacttgattccagaagttcaaggctgcagtgagctataattgcacgaatatacttcagcctaggtgatagagagaaatcctatctctaaaacaaaacaaaaaaatttctttaaatgcttttkacacttcaaaagttccccctgccacaagaacatgtatattatgcatcagaatgtggcatgtgaaagctaggtaatgtagaacttgtcagaaaaggaccttttcaatacacacacaaacacacccacccaccccccct

SEQ ID NO: 21253 - DNA, 132 bp, Homo sapiens
ccaacctgcttgacattcagcttctatggcggtgggtggagggagcgttccatgccatgccttgcctctgttctccatggcagaatctgggactttctctccaagatagccgaagcctgttgacagcctgtc

SEQ ID NO: 21254 - DNA, 130 bp, Homo sapiens
  misc_feature 95: r=a or g
  misc_feature 96: r=a or g
ttttcctggagtttctggtactggcacatttagttcatcatagaaagtttgaaacactggctcaggaaagcgtttgtaaacttctcctcaaaccrrgatatttactggaggatccagtccagccccgtcg

SEQ ID NO: 21255 - DNA, 144 bp, Homo sapiens
caaccctgatatgtgggtgtgtgtgtgtgtaaaatctgtgtaagattatgtgggtaaagagaagaatatggaagaaaccacactagattgttattgtagatttcctgagtcagtagcagggcaggaggaagtttagataccgag

SEQ ID NO: 21256 - DNA, 211 bp, Homo sapiens
  misc_feature 13: r=a or g
ccttacaaatggragcctgacaattctccaggctcatgaaccagctactgtgggccatccgaacattcactcagcgtccacacggcccatgcccctacctccttctgcactccgcccctcacatgccctatctctgtaaatactgtgtagataattcagggcacttcctatgggcaacaagccccacttactgattcctccttccctgtct

SEQ ID NO: 21257 - DNA, 93 bp, Homo sapiens
aaaacactccggctccagagttttgaacacttaaccactgcgctctagattcattgaagtggtgattaaaatggtatctcttttgggggatca

SEQ ID NO: 21258 - DNA, 451 bp, Homo sapiens
  misc_feature 426: r=a or g
cagcacaccccgtgttccagctaggaaagccctccaaaggctctcctggaatttgaattatttgcctgtaggttgtttagagattttccgtggagaattggggttttaattcagagatgccgagcatacacatttaaagtgccaataagcaaaaagctagttattgatatgtcaagaaaaagtcaggcaacccacacagaaatcttcagctctaaatttacaactgcagccaacttctgaacttcgagtcctcctacaaagccgaggtcggtgggcccccctttcaagcctaaaaacagagtgaaaaggagtacatttaaataactgttcttccatgaagagatgcaaagttattagcaacaacataattcttccttatattcagagtacttctcatttgatttgtcccccaaactgaaatatgcrgcaagtgagagctcccctctgtgca

SEQ ID NO: 21259 - DNA, 171 bp, Homo sapiens
tagagcatcaaataaggaaatgtacataaaatataaccagtcaggtgcattaatggtagccattattatcatattactagctttttcttacatgtcttttttttggtctatagtttgtattcatatgatacgactaaacattttagtttagcccgtgggaaaccagagcgc

SEQ ID NO: 21260 - DNA, 481 bp, Homo sapiens
  misc_feature 3: k=g or t
  misc_feature 7: n=a, g, c or t
  misc_feature 8: b=c or g or t
  misc_feature 31: k=g or t
  misc_feature 262: r=a or g
  misc_feature 270: r=a or g
  misc_feature 271: n=a, g, c or t
  misc_feature 272: m=a or c
  misc_feature 418: r=a or g
  misc_feature 423: r=a or g
  misc_feature 426: w=a or t
  misc_feature 433: r=a or g
  misc_feature 434: s=g or c
  misc_feature 435: n=a, g, c or t
atkgagnbcacttactttgatctaatttgtktactcataaagttcattaaacattcacatcaacagcttctgaatatctaagccaattaaacatggcgatgttactcgattcttaaaacaagctggatactgggcacagtggctcacacctgtaatcctaacactttgggaggctgaggcaggtggatcacctgaggtcaggagttcgagaccaacctggccaacatggtgaaacccctgtctttactaaaaaaaatacaaraaaattarnmgacatggtggtcggcacctgtaatcccagctacttgggaggctgaggcaggagaatggcaggaaccctggagtcggaggttgcagtgagccaagatcgcaccaccgcactccagcctgggcaatagagcaagactccatctcagaraatarcawacagaarsnaaataagctggagaagggtttgttttagcttcattttggaatgtga

SEQ ID NO: 21261 - DNA, 85 bp, Homo sapiens
atagcaatgagtcgggagactttcgcgggctgaaattgggagctccaagcactttttccccccactttttttttttttttttttt

SEQ ID NO: 21262 - DNA, 107 bp, Homo sapiens
agtaatcaggaagtatatctatatgatcttgatattgttttataataatttgaagtctaaaagactgcatttttaaacaagttagtattaatgcgttggcccacgag

SEQ ID NO: 21263 - DNA, 294 bp, Homo sapiens
  misc_feature 120: r=a or g
taacccatgtattattttaaatctacaaaccaacatttcagctacagattttgaaaagccaattgttactattttgtaaaattcacatttctagccacataaattaacaacattcctgaraaacataagaatcagatataactctgcagtaggcaatcctgggtcctgacactgactttcctacctgaggacaaccacattcaaactgcaaccatttgacaaatggggagtctcaaaaagtacagaagatagcaatccagatcacgcaaaaacatggctttttcttgccaataa

SEQ ID NO: 21264 - DNA, 116 bp, Homo sapiens
attctgcttccccggagccgaatgaagcagggagcaggattagagactgccaccggctatcagaggagcttagataaaaggaactgcttcttaagcaccactgcagcagaccttgt

SEQ ID NO: 21265 - DNA, 409 bp, Homo sapiens
  misc_feature 275: d=a or g or t
  misc_feature 276: r=a or g
  misc_feature 277: m=a or c
  misc_feature 294: n=a, g, c or t
  misc_feature 310: r=a or g
  misc_feature 320: k=g or t
tatattactgctcaaaaaggcagccagagtaaccagacggcacaatttgaatttatccttctattcgaaatgctgacttggattgccttcccccacccccactccctccaaaattgcacattatccagtatataaacaggtaggttatttatatatatgtgtactctgttttaagatgaaaagaacaattcttcactttttattagctgaaccatatgaaattgccatttgataggccaaaaaatgctcaaatatcaccaacttcataaaattcdrmctaatacaaagactcancacattaattctgtaratagtaaatkctcctaatatgtttaaaaagaatccaattttttaaaatatattttgcatatatttcagaatcatgggttgtacaaaatgaagtatattg

SEQ ID NO: 21266 - DNA, 187 bp, Homo sapiens
tgctttgacttacaccctagacagagttgttttgtgctcactgactcctcttttgtgtccctgtgcaacctcttagagctcaccctgtccaacagtgctccgatttgagttatagacttgcagctgggggagatgccttaaggggtattgcttatttgtttgcgccattaggatattgctgggtcag

SEQ ID NO: 21267 - DNA, 169 bp, Homo sapiens
gtttgcttccattccgttccagtattttccattccattccattccattccattcctttccattccatttgattcaggttgattgcattccattccattccattccattccagtccattccattgcattcctttccattccattccactcgtgttgattccattagattc

SEQ ID NO: 21268 - DNA, 138 bp, Homo sapiens
  misc_feature 36: n=a, g, c or t
  misc_feature 130: r=a or g
actcacacagtacactctataaaggatttgaaagtngctgaaggaaactagtttgtcccttgtgcccagttttgctcagaagcaggagaaagacctagggtggcatattttaaccttgaatatgtgtgtractcaccc

SEQ ID NO: 21269 - DNA, 156 bp, Homo sapiens
caggttcaagcaattctcctgcctcagtctcccgagtagctgggattacaggggcccgccaccacgccggctaatttttgtatttttataaagacggggtttcaccatgtttgccaggctggtctcgaactcctgacctcatgattcgcccgcctc

SEQ ID NO: 21270 - DNA, 271 bp, Homo sapiens
aaaaattctaaaagagaaagagtgggagagagaaaacatgagctattgctacatcagcttccctgtcataattctctctttgcagctcatccctcttaagtttcttctctctcttcctccaaccatacaagagtgatggctggacttgaagcaagacagaaggctggccctgtcactttgcagaaaccaagaaatccaaatgcatagagatgcaaagagatagttggaggcagatacactaagtcacagaaagaggggtctggtgggggct

SEQ ID NO: 21271 - DNA, 179 bp, Homo sapiens
gtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcc

SEQ ID NO: 21272 - DNA, 164 bp, Homo sapiens
cagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgagt

SEQ ID NO: 21273 - DNA, 379 bp, Homo sapiens
ccatcccccagcccgacacctgtaaagggtctgtgctgaggaggattagtaaaagaggaaggcctcttgcagttgaggtaagaggaaggcctccatatcctgcatgccccttggaatggaatgactcagtgtaaaacctgatcgtacattctttctattctgagaggagaaaaccaccctgtggctggaggtggggtatgctggcggcaatgatgctctgttactctttgctacactgagatgtttgggtggaaagaagcataaatctggcctatgtgcacatccaggcatagtaccttcccttgaacttatttgtgacacagattcctttgctcacgttttcttgctggccttctccccactatcaccctgttctcct

SEQ ID NO: 21274 - DNA, 231 bp, Homo sapiens
ttaagcagtcacccattcaggaatgagaatattatacacctatatatttattttgtatatattaacaaaattatatatgacattgtagcaggtaggtttgacccagttgcaggttggggctgagatgaaatgtaaaattgtatgtctcattctggatgtttttagtctcgtgcgttatctgcactgggagctttgcctttaataactcaaacgttcctctccccagcagcc

SEQ ID NO: 21275 - DNA, 194 bp, Homo sapiens
gattactgccattttatattaattgccttggcccaaaaggtgagggttcttggtttttaatcaaattaagataaatcgtccattcctgttcttatgaactcctgctcctccctctgcaaaagagatgttcttttctagtaattttataaaaattagttatttgagacaatttagagctgtgttcaactggagga

SEQ ID NO: 21276 - DNA, 138 bp, Homo sapiens
atttcagaaaggaggagttgatgatcttctagatgtatatgaacacctgtctatatctgcatgtatatgttttgacctgcagtggttgcaatgttgatatgtgttcaagattattcctgtctacaaaactgaaggccc

SEQ ID NO: 21277 - DNA, 187 bp, Homo sapiens
tttttcttgtgattgaaatgagaaatatgactcaaatttggacagtttatgttttgcttaaaaaactcctcagtttcttctggtttcaaactttttaaaaaaatattaggacaagtgcagtggctcacacctataatcccagcactctgggaggctgaggtgggtggatcgcttgagtccaggacca

SEQ ID NO: 21278 - DNA, 271 bp, Homo sapiens
attcccagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggcccca

SEQ ID NO: 21279 - DNA, 111 bp, Homo sapiens
gaaaatggctgttctctgtgactgggcatagaaggtttgtaagttttagagactgcagctgttgaatcctttctgctaagagagcgatgacaggcaatagaaaagggatag

SEQ ID NO: 21280 - DNA, 367 bp, Homo sapiens
  misc_feature 272: r=a or g
  misc_feature 273: n=a, g, c or t
  misc_feature 274: s=g or c
  misc_feature 338: k=g or t
  misc_feature 339: k=g or t
ctcccacattctttcaattctctttcctctctacttccttaagctaccaccctttcccgaaggaatttagtagccgctaaactgtccctcccaccttcagtttggcatcatccaaataatccatttattgcaacaaaacatttcttactaaaatacattatgccatgcctagacgactttcacttcacccatggaggtaagctggtgcgctgactttcaactttgacaactgcaggctacaaaggagtagcacgtggaggatatgcatttgrnstttcactgaaggcaaacacatagaagaaaacagtcaagggtgttggtgctggcagctctctcckktgggaagaacgtaggagccccatagaga

SEQ ID NO: 21281 - DNA, 81 bp, Homo sapiens
ttagtaattgccattctaactggtgtgagatggtatctcattgtggttttgagctttttttcatctgtttgttggccccat

SEQ ID NO: 21282 - DNA, 214 bp, Homo sapiens
gaaaaagctgtagtgaaggttattgcctaaaagacagatggcaaagttgaccttaaaagatctgcttgtgagtctcagaggctgtgccttctcccaggagctgcctcttgtctctgggaagaaaggaggggagtgggtagggaagaggaaagacaaattaagtgccatgtgattctgtagaggtgacctcccttcctttgtcctctgcaccccc

SEQ ID NO: 21283 - DNA, 151 bp, Homo sapiens
gaagaattaaaagataaaccacagtctgggagaaaatattttcaaagcctatgtctgataaaggactttttctagatgtataaaaaactctcaaaacccaataataagaaaacaacccaattaaaaatggacaaaacaggccgggcgcagt

SEQ ID NO: 21284 - DNA, 179 bp, Homo sapiens
tttcacacatacacccaagaaagtttgtatactcaatgcaatatcttgcagtgcaagggtctttaaccatcattagccagtggacttggaactgagagtttaaaacaaccattaaggagcacatctatgtaacacgctggtctccagtgctaagattcttgaggacagagaccgcatct

SEQ ID NO: 21285 - DNA, 256 bp, Homo sapiens
  misc_feature 6: y=c or t
  misc_feature 8: s=g or c
  misc_feature 35: k=g or t
  misc_feature 39: k=g or t
  misc_feature 41: s=g or c
  misc_feature 43: s=g or c
  misc_feature 45: s=g or c
  misc_feature 57: k=g or t
  misc_feature 73: k=g or t
  misc_feature 106: k=g or t
  misc_feature 111: s=g or c
  misc_feature 115: b=c or g or t
  misc_feature 121: k=g or t
  misc_feature 152: k=g or t
  misc_feature 178: s=g or c
  misc_feature 229: k=g or t
gctgtycsttcgtcgcggcggcgaaggaggaggakgaakasgscsaggcgacaagakaagaaggaggcaggckcggcggcagcggcggcgccccgagccggcggakgcgasgggbgggaakatggcggacgtgcttagcgtcctgcgacagkacaacatccagaagaaggagattgtsgtgaagggagacgaagtgatcttcggggagttctcctggcccaagaatgtkaagaccaactatgttgtttgggggacc

SEQ ID NO: 21286 - DNA, 406 bp, Homo sapiens
  misc_feature 336: k=g or t
cctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccctttgcttggtagatctccctccatccttttattttgagcctatgtgtgtctctgcacatgagatgggtttcctgaatacagcacactgatgagtcttgactctttatccaatttgccagtctgtgtcttttaataggagcatttagtccatttacatttaaagttaatattgtkatgtgtgaatttgatcctgtcattatgatgttagctggtgattttgctcgttagttgatgcagtttcttc

SEQ ID NO: 21287 - DNA, 416 bp, Homo sapiens
atgtgctaatactggctcagtgacctagacacaggccctcccacagtgcaggcacttggatactgaggtgtggtctgcacctccctagatgtggtctctattggtatctttctgtgctaacctcttccatctgtcccctggacccaaatctatcacaacatccctgtgaagattacagaccatgtatctgatgcatctgtgtccccagtgcaggcctggaacagaggagatgctctggaaagggtatagcatgaaggaaggaaggaatgagcccaatggatgaggctggtacagctcagaaggaaggctccctgaccccaatcctatcctggcatgtcaccagggttccactagtgggaaaaagaaccttgagtcaggagaccccggttctgccgctggctcatcacatgaccatt

SEQ ID NO: 21288 - DNA, 104 bp, Homo sapiens
ccatgaaaccatcaagattatgattatatccatcatccctagaagtttcttcctactgctttgtattccctttcttaccctcctcttgtatacataccccccca

SEQ ID NO: 21289 - DNA, 127 bp, Homo sapiens
aagagagcaaggtcaaaaccaagttattgtttttgcctgaaactttgacagggactccaagttcttccgtgtgacctacttagatgagatgtgggaaacgtggagatgttcatttctcctgggccat

SEQ ID NO: 21290 - DNA, 188 bp, Homo sapiens
  misc_feature 78: k=g or t
  misc_feature 120: w=a or t
  misc_feature 132: m=a or c
  misc_feature 139: m=a or c
  misc_feature 155: y=c or t
  misc_feature 178: m=a or c
agaaaagaatatgtggcacatatacaccatggaatactatgtagccataaaaaaaaaaacgatgagttcatgtccttkgtagtgacatggatgaagctggaaaccatcattctgagcaawttatagcaaggmcagaaamccaaacactgcatgtyctcactaataggtgggaattgamcaatgagaac

SEQ ID NO: 21291 - DNA, 430 bp, Homo sapiens
  misc_feature 372: k=g or t
  misc_feature 380: k=g or t
tacagcagttttccaggggctaagcaacccacagggttatcacaataggttatattattttttcttttgaaaaagttattttgcataaaattttatgttaactttaactgggttattactttgtcaatgaactgatgaataaatattttttagagttcttagttttaatttctaatagagtaaatttcaatagctatagcctatataaagcaccttgagatattcaataatttttaacaacacagacattccaaaactcttaaaaagtttgagaattgctgcttttagaagtagtagccacatcaaattattccctcatgatatcacagggcctgtgaggaacttttttactgcaaatttaatttccttaakaaatacgkagctgttttcttgtgtaaatctgggcaatgaatattttttaaaagagtgt

SEQ ID NO: 21292 - DNA, 332 bp, Homo sapiens
gcagttaggagaaaagtcaaaaaatagcaccttgggagagcggaatgaaaaaagtttatgaaacacggcactagaccaatggtggggtgtgagatctgtttcttccctcttccctccctcatttgctttgccagtgggggtaagtagtggagtggcaaagtctttttacttagctggtgttatgtaattccccctagctgttgaattccccctgctatggcaagcatcaaaggcgggtctccttgcagtcctgggcctgggtggcttttcatggattcctactttgaatatctgtgtgatatggctagaacactctccaatttccctccagc

SEQ ID NO: 21293 - DNA, 104 bp, Homo sapiens
  misc_feature 57: s=g or c
  misc_feature 60: n=a, g, c or t
gggaggagccaagatggccgaataggaacagctccggtctacagctcccagcgtgasgancgcagaagacgggtgatttctgcatttccatctgaggtaccggg

SEQ ID NO: 21294 - DNA, 130 bp, Homo sapiens
ttttctgggcttgtaggtggctgccatcttaccgtgtgctcagaatgacctctgggtgtactcggagaagaagcaagttctctgatgcctcttcttttaaggacactgatcccatcatgaggcccccgtc

SEQ ID NO: 21295 - DNA, 129 bp, Homo sapiens
tcatcatcactggtcatcagagaaatgcaaatcaaaaccacaatgagataccatctcacaccagttaaaatggcgatcattaaaaagtcagaagacaacagacgctggagaggatgtggagaaatagga

SEQ ID NO: 21296 - DNA, 247 bp, Homo sapiens
  misc_feature 243: r=a or g
  misc_feature 244: n=a, g, c or t
  misc_feature 245: k=g or t
gaaaactcggctgggcgcggtggctcacgcctgtaatcccaccactttgggaggccgaggtgggcggatcacgaggtaaggagatcgagaccatcctggctaacacagtgaaaccctgtctctactaaaaatacaaaaaaattagctgggcatggtggtgggcgcctgtagtcccagctgctggggaggctgagggaggaaaatggtgtgaacccaggctggagtgcagtggcgcgatctcarnkca

SEQ ID NO: 21297 - DNA, 63 bp, Homo sapiens
atgaggtttcaccatgttggccaggatggtctttatctcttgacctcgtgatccccctgccac

SEQ ID NO: 21298 - DNA, 466 bp, Homo sapiens
  misc_feature 394: k=g or t
  misc_feature 412: n=a, g, c or t
  misc_feature 427: r=a or g
  misc_feature 438: n=a, g, c or t
tagatttttaagcaagttcctgattataaaagtaattcctgatcactgtaggaaaaaaaaaggaaaaaaaattcttatccaaaatttcaccagacataaatcaccagttactacttttgtgattttccatctttttaatatgtgcatttgtatatgtattatatttttatagaatagtcatactatattattttgtaacttgctgtctaattaatattgtatttgtttcactaaatttcttcattaatgtaaaatggattcattaatagaatttaaatatgtttatccacatatgacatagatgtaccattcatttgactatttcttggttgtttagcatttaggctattttcatttttaggtgtacaaatatttgtcgacatttataattttkttacactaaattaatgantgtgggattactaarataaagaatgncaatttgttagtatatagtagaaaaata

SEQ ID NO: 21299 - DNA, 163 bp, Homo sapiens
ggcagcattcaatccaggaagtgccagcatcacatggtgacttctggtagctgtaacatttagtgactgtctccatgtcatgcacaggggtgacatcgagaccctcttatgcctgggaagttcctgctgtcaatgcagaatattctctttttttttttttttt

SEQ ID NO: 21300 - DNA, 449 bp, Homo sapiens
  misc_feature 88: s=g or c
  misc_feature 268: n=a, g, c or t
ttcctggaaggctgaggggcttctcctgctgtctcccattggtggcgatggactgtagtatttaacagcattgctgtccaatgcggasaggaatccacctaccttaactcttcctaattaagggtgttctggagaaagtcccaatggcagtgctattagtgattccaagcctgctgcctgctcagatggatatcagcggaggccgactgtgatttgtgctgctgtcatcagaacacacatacagctatacaggggagggccctccgangccagaacaacaggctttgtttccagaatttagccctttctctttcgaagtcccacctccctctccctgcccagacacgcactgatggcctttattacttaaggtgcgactttcccacacatcatttgcatagtctcccagcccagttttccctccctaccttgaaagaagtcaaaacaga

SEQ ID NO: 21301 - DNA, 444 bp, Homo sapiens
actgctctcgttttcctctctgcttgcgcccactatcagaatcgatgtccaccgtaaagaaaatgcgggggctgctgagaagtcgattactatcctctctactcctgaaggcacctctgcggcttgtaagtctattctggagattatgcataaggaagctcaagatataaaattcacaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgttgccaaagctgaggaggagatcatgaagaaaatcagggagtcttatgaaaatgatattgcttctatgaatcttcaagcacat

SEQ ID NO: 21302 - DNA, 123 bp, Homo sapiens
caaattgtctattgtagcaaaaatgtttttgtcgtaaacctgttttgtctcctttttttgttctcttgccacttctctcctcttcctcctgcccctggttccctcctctcctcccctcctccc

SEQ ID NO: 21303 - DNA, 97 bp, Homo sapiens
gacaacaggaattttctccgagagcgggccgggctcagttcagctgctgtccagacccggatcggcaacagtgccgcctccagacgttctcctgccg

SEQ ID NO: 21304 - DNA, 94 bp, Homo sapiens
  misc_feature 54: n=a, g, c or t
attttaggtgttggatctgagggggaaaaaaaagagagagggagagagagaganagaagagcaggaaagatcccgaaaggaggaagagggtggc

SEQ ID NO: 21305 - DNA, 202 bp, Homo sapiens
tttttagagagtggggtctcactgtggtctctaactcctgggctcaagctgttctcctgcctctgcctctacctactgggattacaggcgtaatccagctgggagccactgcacccagcctataactcttttttaccttttcaagcctcttttgaaaaaatatcctcacttctgttttgttctgagaggtcttctgccccag

SEQ ID NO: 21306 - DNA, 95 bp, Homo sapiens
tattagtttccttttattgccgattggagggggttaaagtcgccccggccaggccacgggctatcagtctctctattgagagctttttttttttt

SEQ ID NO: 21307 - DNA, 340 bp, Homo sapiens
  misc_feature 258: k=g or t
  misc_feature 267: b=c or g or t
  misc_feature 268: r=a or g
  misc_feature 269: n=a, g, c or t
  misc_feature 270: r=a or g
cctctgactttgtcttaaatattccagaaatgaggatgcattcttggtcaccaagatgctatgtatctattctagcatttagttttaagaaaccccagtgcatgggtaagagtgattagtactatcaagagcacatcatgttgtgcctggcaccatgccaagcacttacaacacatcttacctcatttactacaacagccccatgaaggtaggcactttatttataaagagagcaacacataaaaaggtgagtaagtkactctagabrnragcaagtgggcagagctggggttcaaactaaagtttgactggtttcacacctcaaccttttttttttttt

SEQ ID NO: 21308 - DNA, 102 bp, Homo sapiens
aatgagtttgagaggtttgtttttatagttgtgttgtattacttgtttaataataatctctaattctgtgatcaggtactttttttgtgggggttttttttt

SEQ ID NO: 21309 - DNA, 244 bp, Homo sapiens
aggcttgatctcccaaatcaaagacagtgtgccccgctcccttccaatagattatacctgagctacattttctttttttcttttctttttttcttttaagttccaggatgcatgtgcaggacatgtacgtttgttacataggtaaacatgtgctatggtgacttgctgcacatatcaacgcatcacctaggtattaagccccacatgcattagctatttatcctgatgttctccctccccctac

SEQ ID NO: 21310 - DNA, 380 bp, Homo sapiens
taacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacgggact

SEQ ID NO: 21311 - DNA, 80 bp, Homo sapiens
accgtggggaggtgccgccggggtcgcaggaattatccagactgccttgccactagatgaatggaagacaatgatttgac

SEQ ID NO: 21312 - DNA, 435 bp, Homo sapiens
ctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcact

SEQ ID NO: 21313 - DNA, 181 bp, Homo sapiens
atatatgtagcatagagcgtctggatttcatgaattgtgtttcctacttgccagattgtaatttccaagcatgctcttatctcattaacacaaagaggtctgtgcctgacctaggatctttcttttttttttagaaacttgtggtggagaatgttgatgtgttaacacaaatgaggaccaa

SEQ ID NO: 21314 - DNA, 188 bp, Homo sapiens
  misc_feature 132: m=a or c
  misc_feature 155: y=c or t
agaaaagaatatgtggcacatatacaccatggaatactatgtagccataaaaaaaaaaacgatgagttcatgtcctttgtagtgacatggatgaagctggaaaccatcattctgagcaaattatagcaaggmcagaaaaccaaacactgcatgtyctcactaataggtgggaattgaacaatgagaac

SEQ ID NO: 21315 - DNA, 92 bp, Homo sapiens
caacatggtaggtgttttggctcgaggccgccatcctccacaatcgtcccccatctgcagcttcccgcggtcctcagcccacagagaggccc

SEQ ID NO: 21316 - DNA, 380 bp, Homo sapiens
gtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggcttg

SEQ ID NO: 21317 - DNA, 230 bp, Homo sapiens
acacaagcgcttccttgccgagaggctggagctgcggcaccgcaggcctgagccaccccttctctgctgtctccttctcttcctcagggctcccgtgtctgctcgccctccgacgctgctcagactatggaaatgatgttagacaaaaagcaaattcaagagtctgaggctgcagtaagccgtgatcatgccactgcactccagtctgggtgccagagcctgtacccccc

SEQ ID NO: 21318 - DNA, 404 bp, Homo sapiens
tagatgtatcatgatttcatcttattccccttctgatggacatttgggttgcttactcttttgctcttataaacaatactttaaaaagtaaccttgcatgaatgcaattcagcacctgtgtaagtaaatatatctgtaagataaattcctagaagtggaattgctgggtcaaaagaataatttttcagaggatacatgtgaagcaataagggaggcagaataattcttttggcctagcaatggggtaaagaaaaggtacgattatttattgcataaatgaattgtttcctttggctcatagcctgtgtttatgggtaacttctgcttatgtgtacctcactatgatccctgtccttcctcaaggtctctggatgcatcctttcagctttcagttcctggggtaa

SEQ ID NO: 21319 - DNA, 216 bp, Homo sapiens
atgacaaaccacatggccacaggaagagtgaagaatttgggcctttaatgcaattttccaggcagtcagtgccacacaaccatgtctcgctataaggaaggctgaaaaataaaaacatttacctgggacatcactattgaaacaacacttatttatttcctacctttcttcttttttcttccttctttctcctaattatcttcttccttcccctcc

SEQ ID NO: 21320 - DNA, 108 bp, Homo sapiens
cctcagacacttagaacttctaggtcttttctccaatctgccagtgacttgaactagagagtccctgaacctggttcacaaacatctgagttccggagaacgcccacg

SEQ ID NO: 21321 - DNA, 486 bp, Homo sapiens
  misc_feature 446: n=a, g, c or t
atgctgaagctattgtaccatctggcaagagcaacggctgctccacgagacctttgctcctggcaaatctcacttaaaagacccacctctaacttggtattttacactcaatattaatatttaagtatatgctgtactgtagtgcaatataaatgcttgtcaaaaataagacccttgaaggcatacactatttccttttttccccttgcagtgtcaagtaattaacaggtgttaaataaccactgactagtcaactataaaaaagagggatgtgagcaagaatactagcaagaacaagtaactgttaccatgtcttcccacccaccaaactgtggaggaaaaaactccctcctctcaaatcaaggcaggctgcttacaaggagcaccacgtgaaagggaaaaatggccactctacgcaatatgcctattttgatatgaagggctgntctgtcgttagcacttcccaatcagtagcactcacaaata

SEQ ID NO: 21322 - DNA, 125 bp, Homo sapiens
  misc_feature 89: y=c or t
  misc_feature 100: w=a or t
  misc_feature 102: r=a or g
  misc_feature 109: w=a or t
aagtatacgaaaagttattcaacattcttatgaaatgttttaacatattgtattctttttttttgggagggtttcagactttttttttyctttggttgtwaraactttwattttaggttagggga

SEQ ID NO: 21323 - DNA, 166 bp, Homo sapiens
  misc_feature 158: k=g or t
tgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctatttttktttttttt

SEQ ID NO: 21324 - DNA, 339 bp, Homo sapiens
gagaagtttccgggactggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaa

SEQ ID NO: 21325 - DNA, 130 bp, Homo sapiens
agtaaaaaaaatcaacatgtacaaatatttaagaaattttaattaccatcatccactacagagtgattgagctctgagattaggtttctatgtaagcccagggagaataaagatttcaggcctcccccat

SEQ ID NO: 21326 - DNA, 180 bp, Homo sapiens
  misc_feature 147: k=g or t
aggattacaagtttttgtatttactaagatttgcatcccctaaaatgttcacactcctgatctcctaactgtcgaaacactattgactctaccccactgagaatgtaagtatgcaccatgtctgcatctctgatgacctcatgtgtkaatctcacattatccactcagctctgccccttc

SEQ ID NO: 21327 - DNA, 116 bp, Homo sapiens
agtttgggggaggggagaagagggcggcgggacctttcctggcgccgctcggaaactactaaagttcctggggaagcaaagtagaatttcataagaacaaaatggatggagagcgt

SEQ ID NO: 21328 - DNA, 265 bp, Homo sapiens
ctgtttgttttttcctaatgtgaaactgagacaagtgaatgagtcacttaatcaaaaaagtctatttttaaaaatagtcaacttttaggataaacctaagggatttatttctgtaacttctcgggtatatcctgaatcatttactaatcaggctagctattttctctacaaatacagtattacccagttggaagtgatgtttataaccttcaagaaatatctgaaaaaggacagtttttaatacactataatttacaaagaggga

SEQ ID NO: 21329 - DNA, 167 bp, Homo sapiens
attaaaacaacaagaacaaaaactcaatattggctttaacccctcctgcacgtgtgctgagctgccggcctttgtcatctgcagggcacgtgcagcccaagtgtctggactcagcgacatctcaggacagactctggaacacggctgttgtctctcctcccgcccca

SEQ ID NO: 21330 - DNA, 195 bp, Homo sapiens
cctctgtgtgttcttttggctttccttcttgggattttttctcatgaaccacagacagctgtcaatttcaaaagattaaacttgattacactggaatccaacttgtaatactttcaaacaagaacaagaacaaaattccaactaaaacattctgcctttttcaggaaaagcccgcttaggcccaccccggccctc

SEQ ID NO: 21331 - DNA, 412 bp, Homo sapiens
gagatcattccctcaccccaacaggaataacaaattgaacaacttgtcataccaaaaaagcacttcatgagaacccaaaatcagatgaggaatatagtacctggttttaacatcacattagagaaagatgtgctgaaaaaggtaggaaagacagtcttgaattgcctacactaccactcctccatgccccagcagtgcctgcgtggtccataaagagaatctgtgtgcttggaggagacagagtacagtgattgtggaaggttgcattggaactcagtgctaccctgtcacagcagaaagcaacatggggtggcactcatccattgcccacagagggataattgagatgagcctcagccagagacaaataatctatcctagtcatcagaatctgggttccagcaggccccac

SEQ ID NO: 21332 - DNA, 319 bp, Homo sapiens
tttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtgctc

SEQ ID NO: 21333 - DNA, 478 bp, Homo sapiens
  misc_feature 344: r=a or g
aaatatttttagtgttcaatataattaaaacacgagatatatatcctaccttctgaacatcagcatcatgtttctgttgcagtttaagcttttcttcatgaaatttagcttccatcatttttgttttcatgtccagcttcaagaaaaatatttcaagggtgttattaatttactttccctttggcaaaaaatacacaattaaactaaaataattccctataaaaaagacagttatcattttccacctttaccttgtagtcacagattctagcaatcacattacatataccaatatgtttatttcagtcctctaattactttcaaactagttaaaagtctttaarataaatttcacctggtaggcaaaactgacaatatgaagtacagattcactactctccccattctctcccgcacaaaagagaaaggcattttaaagtgatattttgcttttacatttaaatccacacagtatttt

SEQ ID NO: 21334 - DNA, 274 bp, Homo sapiens
tttaactcaaaggctaagacaggcatttttagggatgtggggctatttgctaaagttggcacttattttaggagacttttaactcaaatatagtctcccactacctcaaatagaaatatagtggaaatctcattgttggatgtttggaaccagggttagaaggatctaatcttgctctatatctttggacatgttcgttattccctctgagcctccgtatccttgtctgtagagtaaatgaggggctggataagatgctctctgggttccttac

SEQ ID NO: 21335 - DNA, 238 bp, Homo sapiens
cagcaccagccgcattctgggaaactgtctgccctgctcccatgccccctgtgcatgcatatgcggtgccttcaatatggcaccatgggagactaacttttgctacaacgggcctcacccttggcaccgaccattggtcaagaggtggacacctgatccaaacgggccaatcatagccctccccccaggatttgggaactgcaactgacaaaagaagtcagtctctctctgggtgtct

SEQ ID NO: 21336 - DNA, 247 bp, Homo sapiens
ccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaat

SEQ ID NO: 21337 - DNA, 363 bp, Homo sapiens
  misc_feature 244: s=g or c
ttacattgtaatatataaataattatacaactcaccataacgtagaatcagtgggagccctgagcttgttttcctgcaactagatggtcccaactagaccaggtgatgggagacaatgacagatcattaggcattagattatcataaggagcatacaacctagatcccttgcatgtgcagttaataataggttttgcacttctatgaggatctaatgcggcctctgatctgacaaggggcggastcaggcagtaatgggagcaatggggagcggttttcaatacagatgaggctttggtcacttgcctgcctttcacctcctgctgtgcagcttggttcccaacaggccacggactggtggtc

SEQ ID NO: 21338 - DNA, 400 bp, Homo sapiens
  misc_feature 322: k=g or t
gaaaatgttacaattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagtkaccacaatacaacaattgtccctcaccacaagcggcagtgcagcagtagatttatgtactatacagcagtctctctgc

SEQ ID NO: 21339 - DNA, 85 bp, Homo sapiens
  misc_feature 6: v=a or c or g
tttgtvatttttaggagagacagggtttcaccgtgttggccaggctggtctcgaactcctgacctcaggtgatccgccgcgccta

SEQ ID NO: 21340 - DNA, 121 bp, Homo sapiens
  misc_feature 25: s=g or c
attcatccgtggccgggcgcggtasctcacacctgtaatcccagcactttgggaggctgaggccgacggatcacaaggtcagaagttcgagaccagtctggccaacatagtgaaaccccat

SEQ ID NO: 21341 - DNA, 118 bp, Homo sapiens
gtcaatctggagctggaggcctcaaagtggggaggaggaggagggtgggataaagaggaaaggagcgtggaggacgtgtggttactcaaagaacagctaagaattttgcaatcggccc

SEQ ID NO: 21342 - DNA, 90 bp, Homo sapiens
atacaaaaattagccgggcgtggtggcgtgcacctgtagtcccagctactcaggaagctgaggcaggagaattgtttgaacccaggaacc

SEQ ID NO: 21343 - DNA, 231 bp, Homo sapiens
gcctcagcctcccaagtagctgggattacaggtgcgtgccaccatgctcagctaatattttgaaattttagcagagatagggtttcaccatgttggccaggctggtcttgaactcctgacctcaagtgatctgccctccttgggctcccaaagtgctgggattacaggcatgagccaccatcatgcctggcctagaaactcattttaaatgcttcatcaagagggccctgg

SEQ ID NO: 21344 - DNA, 460 bp, Homo sapiens
  misc_feature 331: s=g or c
  misc_feature 396: w=a or t
  misc_feature 397: y=c or t
ccattcttctgtgttggaggacacccattctgtcccctctgcccgatgcttttaataaggacctaggtatcctggaacctatgtcaggactgacaagtgaaattaggtaatccacaacctcccacaaatattctctgagcacctaccttgtgccagcgcattctgatgccatcagaaatttgcaaagtaatataactcttcctattcacaaatgagggacccgtgcttggagatggtcaggcagctctctgaggtcatggtacaaggtggaagctgacctcaaattccatcatgtctgatgctgcaaacctttgtttttttctactgagtsacagtgctcggtgtgatcctgactgttcccaagaactgttttgtttttcaagacatgagagtacwyagagacagctaagccccatgtaacaccttcagagaagggactggggaacttcagaagtgccca

SEQ ID NO: 21345 - DNA, 389 bp, Homo sapiens
tacagctgtgctttctgtactcaggtctggctgtttctccatcattttaaacatgttgcttccgtgaagcaccagtttgtggttttcatgagactacagcagcctgccaccctctttgagaaccaggccacttctgctcctctatttcaaaattaactttaaattacatattgattccagccctatgaaatttagcaaacagtgcattacatttaaataaattataataatcaagctccagtgtttgaattaaagctttttgttgcatgatttgactgaatactgtaaaaacctcatttaatttgtatgccattaatttgtaatttgtgataaaggaaaggcaggagaattggaaagaaaggggtgacctgactaaagggttttctttt

SEQ ID NO: 21346 - DNA, 169 bp, Homo sapiens
  misc_feature 128: r=a or g
tctttccttcactgccaccaaggtgatttccccagaacacaggtggcaccatgttgcttctctccagtagcctgtagtcagtctctgttgtctacagaactgtctgaatgcttgagccagttttcaargacctcctaggggctgtcctaaaccctctgcaccggcccat

SEQ ID NO: 21347 - DNA, 174 bp, Homo sapiens
  misc_feature 134: m=a or c
caggccttgttcggcatatttgtctctttaaaacacccattcttcatgattttaaggaaaagatcatgctcattattttcttccctcccaatctttctaacatgggcccacataaaacgtgtcccccttctgcmaacatcccttcacaccgcccacaacggccacccccactac

SEQ ID NO: 21348 - DNA, 103 bp, Homo sapiens
actaaaagatctctcaggggaagtaaaacacattaataaagacagtctttaaaaggaagtgttccccaacctttcagcagtaaagctgtctgaacagggcccg

SEQ ID NO: 21349 - DNA, 263 bp, Homo sapiens
  misc_feature 250: k=g or t
aagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtkaaaaggccccaca

SEQ ID NO: 21350 - DNA, 186 bp, Homo sapiens
gggagcaggatgggcaacatttgatttgtaaaaagacgttattcaaaaggaaccaatcaggagagagagggcaaatagggatagaagttctcgctttgggtcacaggtttcaggctttttgacttgaaggccgggcttcaccagggacccgcccctgtctgcctagagtttctctgccccctgcag

SEQ ID NO: 21351 - DNA, 191 bp, Homo sapiens
gaatactatgcagccataaaaaaggaggagtttatgtcctttgtaggaacatggatgaagctggaaaccatcattctgagcaaactatcgcaaggacaaaaaaccaaacaccacatgttctcactcataggtgagaattgaacaataagaacacttggacacaggaaggggaacatcacacaccgggcccg

SEQ ID NO: 21352 - DNA, 176 bp, Homo sapiens
agtggtttcctgaatctagcaaagtatgctgctttgttttctctcagattaattttgcctaattttaaagctttgattctctttttacgaagacgaaaataaatctctctagtctgggcctttttcgtttcccaggattatgattaaaattatcactaacttttagatagtccagc

SEQ ID NO: 21353 - DNA, 55 bp, Homo sapiens
  misc_feature 7: k=g or t
  misc_feature 9: k=g or t
  misc_feature 10: k=g or t
  misc_feature 11: k=g or t
gcagagktkkkacagcctggacaacaagagcgaaactccgtctcaaaaaaaaaaa

SEQ ID NO: 21354 - DNA, 305 bp, Homo sapiens
  misc_feature 197: s=g or c
  misc_feature 303: h=a or c or t
tggcagaactggttccttctgaagacttggggagaaagctcccatgccgctctcctaactgctggtggtcccggcactgctgggtgactctgggctcatagttgcgtcactcccatctccacctcctccttcccacggctgccttccctctgtgcctccctgagtcctcacatggccttcttgtcaagatgccagtsattgaatttagtgccttctcaaatccagtgtgacctcatcttgactattcacatctgcaaaaatcctgttttcaaacaaggtcacattctatggttctgggtggghca

SEQ ID NO: 21355 - DNA, 89 bp, Homo sapiens
  misc_feature 81: m=a or c
atttcctttctcaatctggatacactaaccccagaccagaatctactgagatattaggatgcaatggaaaaaaaaaaaaamccaaaaaa

SEQ ID NO: 21356 - DNA, 302 bp, Homo sapiens
tgttcctattctcagtgagcgccacctccatacctccagtccaagctacaaatgtggttaagtcctgaacccatctctccttcaccaatgtggcaaagtaatcaaatatattgcttctacctcctaaagtcttccaaatcgatttacttctttttccttttctactgcactaccatcatcagagaccctatctctcaacttgtgtttctacagtaacctacagactggctcattccagttcattttgcttactacacccaaatttatttcattaaaaagcaaatattatcatattatcctgt

SEQ ID NO: 21357 - DNA, 124 bp, Homo sapiens
ctttgtgccttgggtattttgagtgaattttagcccaatatatatcttgctggtttagagtaatgaaaacctactacattattcctaacacatttctaaaaagtaaactaattttggggaccca

SEQ ID NO: 21358 - DNA, 226 bp, Homo sapiens
tgtttttcaaaatgttctgttttgtgtaagcattcacttagcagatttattccatctgggcttatgcatgacaaagattctttacaagtttacagaatgatggactgagctatagcttccagaaaatattttttagttaacaagtgcaggaaatctttaggtccccattgaacagaagataatgtggatagttcaaccatatataagaccttctcctcccacccac

SEQ ID NO: 21359 - DNA, 272 bp, Homo sapiens
agttttgagtgcctttgagggaatttgcacttccgttcccacacagccttgcattgtgtgtgttagaggctgtgggccttgggcaggaggggtgagtgttggcacatacctcccgtctctcccagccttctctgactctgactttccctcttgaaggctaccggctctctgaccagttccacgacatcctcattcgaaagtttgacaggcagggacgggggcagatcgccttcgacgacttcatccagggctgcatcgtcctgcagaggcgc

SEQ ID NO: 21360 - DNA, 184 bp, Homo sapiens
gccccgcgtggcagaaaggagttcctcagctgctgtatctggtgggaaagcgaatgctttagcgaaaataacaggcatcccataaatacatagactagaaataagttttggtttcattaagagcccagaagaatgcctttgttgtccaaccccagtttgatgctctttgggaatctgacgaata

SEQ ID NO: 21361 - DNA, 312 bp, Homo sapiens
tagggactggttaaatgttacggtgattacaatcttgaaaggaagtaagtggtatcattactgccaaataacttcttctttagcctgtaactatttcagtgcgcattatgattgtaattagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaa

SEQ ID NO: 21362 - DNA, 164 bp, Homo sapiens
aataaagatgagagataatgaaatagaaaacaaactatagagcaaatcaataagcccaaaagtttgttctttgaaatgtttaataaaatttcttgatccctagcaagactgatcaggaaaaaaagataaagtacaaattaacaacgtcaagaatgaaagcggaa

SEQ ID NO: 21363 - DNA, 117 bp, Homo sapiens
gggattacaggcatgcgccatcacgcctggctaatttttgtatttttagtagagacaggatttcaccatgttggtcaggctggtctcgaactcctgacctcatgatccgcccgcctt

SEQ ID NO: 21364 - DNA, 186 bp, Homo sapiens
atctcagctcacttcaactcctaccctccagttccaagcgattctcctgcctcggcctcccgagcagctgggattataggtgcccgccaccatgccagactaatttttatatttttagtagagatggggtttcaccatgttggccaggctggtctcgaactcctgaccttgtgatccacccgccgt

SEQ ID NO: 21365 - DNA, 168 bp, Homo sapiens
tttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgatttt

SEQ ID NO: 21366 - DNA, 364 bp, Homo sapiens
  misc_feature 51: m=a or c
  misc_feature 103: y=c or t
  misc_feature 104: m=a or c
  misc_feature 136: s=g or c
  misc_feature 174: m=a or c
  misc_feature 210: s=g or c
  misc_feature 216: m=a or c
  misc_feature 252: y=c or t
  misc_feature 288: m=a or c
  misc_feature 307: m=a or c
  misc_feature 344: m=a or c
  misc_feature 345: r=a or g
  misc_feature 346: y=c or t
  misc_feature 348: y=c or t
acatggtcagctgctgaatttacttgaaggatgtagaatactgtttaacamatactaaaatttgtacaattagatcaaagaattgtgcaatcatttccttttymattttcaacatgttgaggctcataaatatttsacaacatcagatctaatagagcatagtgatactatttmatttaaccaaagtctctagtgaatatttcaactttsaatgtmaactaacaaataaacctgaccaccaaggagattgtytgcccagagttttaaagcacattgtctacaaatggmaattgacataatttataamatattgacgttactatgtttttcaaaaagttcctaamrytytcactaaatggatggc

SEQ ID NO: 21367 - DNA, 340 bp, Homo sapiens
  misc_feature 13: w=a or t
  misc_feature 225: m=a or c
  misc_feature 292: d=a or g or t
  misc_feature 293: w=a or t
  misc_feature 314: w=a or t
  misc_feature 316: w=a or t
ccattttgttgtwtttaccctttcttatccaatagatggaatgcacatgaaatgaccatattaagcctctctctatttacatcccaggctcactgggatgtggtctactgcagttacattttcttgtaacggtttctggattagaccctagggaaagtgagtaaggagccagtttctgtttaacattctagttttactcattttaggaaggctgtgaggcttgtmtcctttaaagtttcttctccaatggaaaccaagaacagacagaatttagagctcagctgtggtctcdwctcatcttctgctcttttgcwtwgaccacagtttttctactcttccc

SEQ ID NO: 21368 - DNA, 123 bp, Homo sapiens
tttttcttctttaccctctcctccccctttaattccacatttctcggagaaaaaatagaaaaaacaaaaaagaaacacctgaaatactgctgcccactgataacccctgttaaccttttgata

SEQ ID NO: 21369 - DNA, 59 bp, Homo sapiens
  misc_feature 23: k=g or t
aacactgagctgcctggcgccgkcttgatactttcagaaagaatgcattccctgtaaaa

SEQ ID NO: 21370 - DNA, 190 bp, Homo sapiens
  misc_feature 83: k=g or t
  misc_feature 155: w=a or t
  misc_feature 165: w=a or t
gtactaatacagtaagaattaattctcttcatggccgggtgtggtggctcacgtctgtaatcccagcactttgggaggccaakgcgggtggatcacctgaggtcaggtgttcaagaccagcctggccaacatagtgaaaccccgtctctactaawaatacaaaawttagctgggcatggtggcgggcgtc

SEQ ID NO: 21371 - DNA, 155 bp, Homo sapiens
attaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgt

SEQ ID NO: 21372 - DNA, 96 bp, Homo sapiens
  misc_feature 15: k=g or t
  misc_feature 24: k=g or t
  misc_feature 43: k=g or t
  misc_feature 57: k=g or t
  misc_feature 59: k=g or t
  misc_feature 63: k=g or t
  misc_feature 83: k=g or t
gatcttgttattgckccagtacakaggaattgtgtaaagtgtkaacagcagctgtaktkgttkaaattgtgtgtattgaagaktaggaaaaagata

SEQ ID NO: 21373 - DNA, 100 bp, Homo sapiens
tacaacagataaatgctaattgcttaaattatttccaaagcaattttacttatttattgctggagccagaacttaggtttcgttctaggcttcttgttct

SEQ ID NO: 21374 - DNA, 87 bp, Homo sapiens
  misc_feature 43: r=a or g
caattggctaaaaaaaaaaagtattaaaaacgaattggctgaraaacaattggcaaaataaaggaatttggcactccccacccccct

SEQ ID NO: 21375 - DNA, 209 bp, Homo sapiens
tggcccctgctggggtggagcacattccctcctgccttggcttggctgcatcacacacacggtgatggggctacacacaccaccagcaggcgaagtggtgccatagcctcagggactctcttccttgtcctccaatgccctgaggctgtctggctaggccaagcaaccatgagagcagtggggctaatgctcagagaccctgggctgcc

SEQ ID NO: 21376 - DNA, 206 bp, Homo sapiens
  misc_feature 103: s=g or c
aaaattcatgtaacataaaatttaaagtgtacaattcagtggcattgcatatatacacaaatgtttttagtttgaaaacatttttatcactcccaaaggagasctcataacccattaggagtcactcgccattttccctttgccctagcctctagtaaccactaacttgctttatggctctatggatttacttgttctggaccatg

SEQ ID NO: 21377 - DNA, 332 bp, Homo sapiens
  misc_feature 106: s=g or c
  misc_feature 114: k=g or t
  misc_feature 116: s=g or c
  misc_feature 222: s=g or c
  misc_feature 233: b=c or g or t
  misc_feature 242: b=c or g or t
  misc_feature 243: k=g or t
  misc_feature 283: s=g or c
  misc_feature 284: s=g or c
ctgctctcccttctctccctgcctcttccctgtcctctctcaatctctaacccctgggctctgctcttcgaaatgtcccctgataaaggtgaaggggagcttctasggacatckasctccctcgtgggcttgcagatgtggtgggcgatgcctaacgtaagatctctggcattcagactccctggttttggggccactcggaccctctgacatcctggagasttaaggcagabtggggttcbkcctagctcaatgttggggacagggtgggtgcccccaggcsstggtggatcaagcccaaccgtaagtgagctgtgccatctccaacctga

SEQ ID NO: 21378 - DNA, 289 bp, Homo sapiens
  misc_feature 87: r=a or g
  misc_feature 102: v=a or c or g
  misc_feature 108: r=a or g
  misc_feature 181: k=g or t
aacagttgataaagctgtgtccctgaagggctttttagccctgggtgcttcctgtaaaacttgtcagcttccactggatctgcgggrctgtgtccctcacavgctggrcacccggccctgtggagaggacttgattaaacaaggtataatgtacttctctttcccatccacagatggatckgtctgtagaaactctgttcagcttcatgcaggagcgccagaaaagatacgccaagtatgccgagcagatccagaaagtgaacgagatgtccgccatcctccgccgcaa

SEQ ID NO: 21379 - DNA, 93 bp, Homo sapiens
agacgcggggttctggtgtcatggaatctccgagcctttggcttgatcccgggaggagaatgagagggggaggagggagatagagtcacacat

SEQ ID NO: 21380 - DNA, 215 bp, Homo sapiens
actaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaagcagaagcctataaagacggaatggaattcccggtgtgtccttttcacctacttccaaggggac

SEQ ID NO: 21381 - DNA, 168 bp, Homo sapiens
agggcacaggttggtctgtcatgctccatgtgccaggcttagtggtgggtaacagctgatatttccaaaccaggggaggatgcaagaatcacggccaaaacagtcgcatcctggaggcactaccgggaaggcgccgtccccaccacccctcctcactgaccggcaacc

SEQ ID NO: 21382 - DNA, 215 bp, Homo sapiens
  misc_feature 19: m=a or c
  misc_feature 25: m=a or c
  misc_feature 26: m=a or c
  misc_feature 27: m=a or c
  misc_feature 36: m=a or c
  misc_feature 102: m=a or c
ttcactcagccattttagmgcaggmmmaagccagamgcaggtgtcagccagcaggtgtggctcataattcatatttttcacagaagcatcatttggaggggmaaaaatctgtctaagctggtttcaaagttaacttattagtataaattttttaaaaaagataggccagcctgggcaacaaagtgagacccctgtctctacaggaaaaaaaaaaa

SEQ ID NO: 21383 - DNA, 154 bp, Homo sapiens
tcttaaccttccatttatggtttgtaaagttttccctatttaagcatatttagattaaaatgagtagtaccaaaagaaaaatgctacacgtagaatgatgatacacaagtatggctagagagtggtgagtgtttggaagcccttgaagaccggg

SEQ ID NO: 21384 - DNA, 120 bp, Homo sapiens
acacacacacacacacaacatctagcttctttggttttgagattcattcattcacttgagtgtacaagtagtttgctcctttttattgctgagtaatgccattgtattaatatgccacac

SEQ ID NO: 21385 - DNA, 122 bp, Homo sapiens
  misc_feature 112: s=g or c
tgtatttttattagagatggggtttcaccatattggctagactggtctcaaactcctgaccttacgatccgcctgcctcagcctcccaaagtgctgagattacaggcgtaasaccgcaccca

SEQ ID NO: 21386 - DNA, 459 bp, Homo sapiens
  misc_feature 390: n=a, g, c or t
tacttttctagtttttttaatttttattttttgcatttcttgatcatttcaaagtgaggtcagttacagagtgaatgggttcatcctgtcattgtaaataacagttttttcgtttaataatggcattttgtattaccaagaccttgcttcacattaggtgttttgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacactaacctangaatttccctgtggatcactcacccccaatgatggcatgtcttgctctggacccatgatataatgatct

SEQ ID NO: 21387 - DNA, 141 bp, Homo sapiens
  misc_feature 122: b=c or g or t
tgagacggggtttcaccgtgttagccaagatggtctcgatctcctgacctcgtgatccgcccgcctcagcctcccaaagatctgggattacaggcgtgagcactgcacccggccagaagctbattcatttattcgtccagc

SEQ ID NO: 21388 - DNA, 234 bp, Homo sapiens
tatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacaga

SEQ ID NO: 21389 - DNA, 121 bp, Homo sapiens
aagaaaaagcgagaccaaactgcaagtgcccctgcaacccctctagtaaataagcaccgcccaacttttacaaggtccaataccatttccaaaccatatatttccaacaccctgccgtcta

SEQ ID NO: 21390 - DNA, 203 bp, Homo sapiens
caatctttaagaactgtaacactcactgcgagggtccatggcttcattcttgaagtcagcaagaccaagaacccactaattctggacacattttggcagcccagatgggactatcgcctatcaccaagcgatgggaaacactcaggcatcaacaggctcacccttgaaatgcatcctcagccattgggaccaatttgacccac

SEQ ID NO: 21391 - DNA, 271 bp, Homo sapiens
ctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccat

SEQ ID NO: 21392 - DNA, 341 bp, Homo sapiens
  misc_feature 145: s=g or c
  misc_feature 336: m=a or c
acacggccgtcatcagcctctgctcaggaatgctgggcacattccggtctcatgatggggattattttattgaaccactacagtctatggatgaacaagaagatgaagaggaacaaaacaaaccccacatcatttataggcgcasgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggmccggc

SEQ ID NO: 21393 - DNA, 154 bp, Homo sapiens
gtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgccgcc

SEQ ID NO: 21394 - DNA, 443 bp, Homo sapiens
  misc_feature 102: k=g or t
atatataaacccaggcattcgagctggcaacagcagcccccctttgggtcccttccctttgtatgggagctgttttcatgctatttcactctattaaatctkgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttccatggttctcttctgtgacccacggcttctaatagaactataacacttaccacatggcccaagattccattccttggaatccgtga

SEQ ID NO: 21395 - DNA, 433 bp, Homo sapiens
ttcttagttgatgtgatttaaatagcctctccttggatctgtggtctttactgaacccagaagttacctcttaaatgcatttatatcttgagagagttaaaatcagttgggaaatcttttttaacatgatttcaatacatcaaattcctatcatggatttaaaagttaccaaacatctttccttcaggcccctgatagatattttacatactagcatagtgcagtattcaagtgtattacaaaagtacactacaaagtaagaagtagcaagatctgttagtgtcttttgataaattgtaaaatgtgtcacctgacttttcttccatatctgtaaccattagatactgctagtttccttattcacaattacataagccaagtgaagtattaagctcaatttggtggttccaaagagagtaagagtctttgctgt

SEQ ID NO: 21396 - DNA, 58 bp, Homo sapiens
  misc_feature 3: k=g or t
atkctcttgcttcagcctcccgaatagctcggactataggcgcccgccaccgctccca

SEQ ID NO: 21397 - DNA, 88 bp, Homo sapiens
  misc_feature 2: r=a or g
  misc_feature 72: k=g or t
araaaagtaaacacaaatagtttgcaaattttggtgaaatcaggtagagagaaagacaaatgtttcaatttkgctcacaaaagtatct

SEQ ID NO: 21398 - DNA, 307 bp, Homo sapiens
tgcatacagatgataaagcacaaacaagtgtagagtatttatccaagctccatgtagcatggtgttcattttgtgggctaattccaggtgacaaccttactggcagcgtcacttcctgtggatttcagaggaacctgaagacattgatgttgtaaccactgcctccagctagacagctgcgatgttagttcattggtggttaactcattttcagcattgctacctgcttttgatgatatctgataatagttttccagggaaattcatcattgaagcccacccacaattcctgagtaatgactccaca

SEQ ID NO: 21399 - DNA, 119 bp, Homo sapiens
tttgctgttgttcagccatgtttgtatgactgaatgtaatttaggaaatcaggagttagagatgaaaaatacaaacatgtcaaatggttgtaattgctttttttgaacttactggcaag

SEQ ID NO: 21400 - DNA, 252 bp, Homo sapiens
gagatgtgatttctccttttgggagagaatgtcccaaaattgattaggctgagccttgggaatagtttggcaggtttaacatcccaaggctaacctaacgtagttggggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcgg

SEQ ID NO: 21401 - DNA, 289 bp, Homo sapiens
  misc_feature 74: k=g or t
  misc_feature 106: w=a or t
  misc_feature 115: k=g or t
  misc_feature 127: y=c or t
  misc_feature 135: k=g or t
  misc_feature 169: y=c or t
  misc_feature 225: y=c or t
  misc_feature 239: y=c or t
  misc_feature 251: k=g or t
  misc_feature 278: k=g or t
agccctccatctccagcagcaacttaaaccccagggaggccatggaaactgtgatcttaacctgtgatcctgakactccggacacaagctaccagtggtggatgawtggtcagakcctccctatgaytcacaggkttcagtctgtccgataccaacaggaccctctttytatttggtgtcacaatagtatactgcaggaccctatgattgttaaatacggaactyagggagtgccagcygcagtgacccaktcaccctgaatcttctccatggtccakacctccccaga

SEQ ID NO: 21402 - DNA, 95 bp, Homo sapiens
  misc_feature 2: b=c or g or t
  misc_feature 3: k=g or t
  misc_feature 5: d=a or g or t
  misc_feature 6: n=a, g, c or t
  misc_feature 20: y=c or t
  misc_feature 28: s=g or c
  misc_feature 74: d=a or g or t
cbktdnctcccttgccagtytgcctgtsttcctccccgtcttccctgcccggcctcccccttcttcccccgctdgccccctccccggaggataat

SEQ ID NO: 21403 - DNA, 170 bp, Homo sapiens
  misc_feature 16: k=g or t
  misc_feature 23: k=g or t
  misc_feature 32: s=g or c
  misc_feature 33: r=a or g
  misc_feature 77: k=g or t
  misc_feature 89: k=g or t
  misc_feature 119: w=a or t
  misc_feature 131: r=a or g
  misc_feature 141: r=a or g
  misc_feature 148: k=g or t
agacctcccgcaccakggctctkgtgaacagsraatgctccacgctgggacgggccattgcctgatgcctgtacatkgtgggcactgakagacaagattcctgggccctgccttccatwcactccccacgrtctcggaggragctctkaggaccccgctgagaacccaca

SEQ ID NO: 21404 - DNA, 385 bp, Homo sapiens
  misc_feature 103: s=g or c
  misc_feature 355: m=a or c
  misc_feature 357: s=g or c
ttgtcaaagaattcccaacgccaggacccacatccctttggtattgatttcacagtcagctgctcaacggaatggcctctccacaccagggatccttaggcasccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacmtstgtgtgagggcagttctggagatgagca

SEQ ID NO: 21405 - DNA, 202 bp, Homo sapiens
cacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcc

SEQ ID NO: 21406 - DNA, 163 bp, Homo sapiens
tcagactatttcctttcaatgcctttgaaacatccaaatttttactactgtagccaaaaatggggagatgagtacatgctagccatctctgatcaaagaatggaaggaacttatcagtttaaagaaaatagtgattacaaagttatttgagagtttcccgtct

SEQ ID NO: 21407 - DNA, 378 bp, Homo sapiens
  misc_feature 70: s=g or c
aatttagaagaatgtataactagaataaccaatacagagaagtgattaaaggagctgatggagctgaaascaaggctcgagaactatgtgaagaatgcagaagcctcagtagccaatgcgatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacgtctgattggtgtacctgaaagtgacggggaaaatggaaccaagttggaaaacactctgcaggatattatccaggagacttccccaatctagcaaggcaggccaacattcagattca

SEQ ID NO: 21408 - DNA, 362 bp, Homo sapiens
  misc_feature 24: k=g or t
  misc_feature 228: s=g or c
gcatttttaggtctgacataagtkgtttgaaacccaatcatacctgatctttgtactagttaaaataactcctccccgtgtggtggagatatagcccacttgtttctcatcctgctaatcccaaacccaaaacaccccacagctgctaaccgtgataaaacctaatgatcaacaccagagtcatataaataagtttcccccttctggcgtgttttccttaaaccagcsaatccacaactcctgttagaagaccggaggataatacccatataccttaataaaggtgaactcccacagctgctctctcactccctacccactgctgagctccctgccacctccagacttatctgcgcccccca

SEQ ID NO: 21409 - DNA, 187 bp, Homo sapiens
ccagttgttttccaacctcttcctttggttcagtgaaagattgagagggatgcagtgggggaagaggaaggaaggaagatggtttctacactttatttccaaatacctccctcctctaaacacatacccaaactcacctacacattcgtaagctcctcacacttcaaggctggggccacccgtgcac

SEQ ID NO: 21410 - DNA, 104 bp, Homo sapiens
  misc_feature 76: y=c or t
ttcttaaaaacttttgaaaatatagaaccattaagcctgctatatctgagcaaattagtgggtacctttttttttycttatttaaagcacaagaggcccatatc

SEQ ID NO: 21411 - DNA, 266 bp, Homo sapiens
  misc_feature 253: w=a or t
aattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagtwgatatggaatcac

SEQ ID NO: 21412 - DNA, 296 bp, Homo sapiens
  misc_feature 223: s=g or c
  misc_feature 224: n=a, g, c or t
ttacctgggcttcccaaaggacttgggattgcaggcgtcaggcatcaatacagcctgaaaaaattacattttcgggctcagtgtgatggctcgcacctgtgatcccagcactttgggaggctgaggtgggccgatcatgaggtcaggagttcaagaacagcctggccagcgtggtgaagccccgtctctgctgaaaatgcaagaattggcctggctcagcctsntgagtggctgggactacaggtgtgtgccaccatgcctgtactttcttttttgcttttttcagtggagataga

SEQ ID NO: 21413 - DNA, 287 bp, Homo sapiens
  misc_feature 211: n=a, g, c or t
  misc_feature 265: d=a or g or t
ctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgtnctgaaagaaagggcaccagaagttctagcaaaattcagttgtgttctgtgagcdagcactttttcctctgacccaa

SEQ ID NO: 21414 - DNA, 255 bp, Homo sapiens
ccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggaggaacccgaagagggctcgcctagccggccacccgctccgaacttgcccgggaaactagtgcggagggaggggccgggccctggccgcggcgggaggaggggctgt

SEQ ID NO: 21415 - DNA, 397 bp, Homo sapiens
cctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctgaccaggggctgtcgatagtggaagaagcggtacatgcggtggggaaaaggcatatatagaaaattcgtactttccactccgttttgctgtgaacctaaaactgctctaataaataaagtgtat

SEQ ID NO: 21416 - DNA, 441 bp, Homo sapiens
  misc_feature 273: b=c or g or t
caggtttatccactttgggactacttttagaaaagaaaagtccaaaaatacgttcatttttatgtgtgcagcatatggtcaaagatagcccatttgacatttttgggggtcgtaaaacaaacaaacagacaaaatattagcaacattaacaacaaaaaaactaactcatttacaacacatccttctgaggagatgtggtcctacagttgtctgtgggacaataagcaatcagtgagtggtatttagattcccctggctttgtgaaagcatatbatttttctgaaaacttctccaacctaagctgagagccccatagatactaatctgaagttaataattaacataattaatatgtactatgcctaaatatacatctcccctcttccaaatgtttgattcaaaactagcattttcaccagcctgggcaacatagcaagatct

SEQ ID NO: 21417 - DNA, 201 bp, Homo sapiens
cattttgagttgttagtgtagaaaagggcagagttttagcagaaagtaaaggttcaggaatccagctagactcaccagagcccgtgttagtcatggatgatccattcagcccctgcaggaggctgaacagtacccagggggactttctacttgtgcatgggcttggtttatacgaattgccattaaacatcgctgcacctg

SEQ ID NO: 21418 - DNA, 322 bp, Homo sapiens
  misc_feature 234: k=g or t
tctttttgcttaggagtgctttggctatttgggctctttttttcattccatatgaattttaggatagtttcttgttgttcttaaatgcattttataattaacttgtttagctctaagaaaaaaactttattttgtattggaatagcattaaatttaatattttttaaaaatgtttcatctactaacttactgcaaagagttttataaagttgcctgtaatgattttttaatgtktttcttcatttttataaaggaaacatccttgtgaccacacccgggtcaaggaatagaactttatcaatcatcccagaagcgcccccca

SEQ ID NO: 21419 - DNA, 175 bp, Homo sapiens
  misc_feature 94: w=a or t
ctctatgaatttgtgatccattttaaagtctctcacaatctttccttacctagaggcaatgaatcacatttaccatcttttcgaccctgcccawgttattagcctccttgagccttcatttcctgtctgtaaaatcagcataacagcacttacctcaaggatatgtggtgagaat

SEQ ID NO: 21420 - DNA, 152 bp, Homo sapiens
acagagacgaaaagagagtgtggggctaactctggagaaaccctaacttttacaggcctgattcaagggagtgatgccaccaagattaagaaaggctggctagaggtccataataaaagagagtccagtgtcatagcatctatgtgaggagc

SEQ ID NO: 21421 - DNA, 222 bp, Homo sapiens
tcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagc

SEQ ID NO: 21422 - DNA, 235 bp, Homo sapiens
tttttttaaggtctgacattagaaaatggcagatttagggaaagcaagttatttaaaatatcatgagtacatcagtttggaatagaagaaagatgaggccagattaaggaggattttaaaggtcaagctaaagcattttgagtttatttggcaagttattcccatcacctgccattgaagatttttaaggagtgaagacgttaagtgggttttaggaagataaagctggcagcac

SEQ ID NO: 21423 - DNA, 92 bp, Homo sapiens
accgcctgctttcgcttccagccgcgcgctccgtgccactgccgctctctgcagccccgcgtccccgcagcctccccatggccagcccgcaa

SEQ ID NO: 21424 - DNA, 419 bp, Homo sapiens
ttaacatcccaagcgatcataatgtgccaccaggatggagaaaactgcggtgatgcggcacttcccaaacactaatgtcgtgcacgtgaacgtcaaggacctgttaacatgaagattttgatttggtaggtctgctgcgcataatgaaatcctgcttttctaacaggctcctgggtgatgcggatgctgctgggaaatgttagacatgcagaatcccaggcccccacccccaacctatagaatcagaatcttcatcttaacaaaatccccagatgatttacaagcacctcaaagtttgagaagaactgttctggggttcctgtggtgtgacagccatggtgcttgagggctcaaaggtccaaatccctggtgcgggacccttcagataactcagttgttaccctaatgtaggagcacat

SEQ ID NO: 21425 - DNA, 206 bp, Homo sapiens
agatggtcattatggatatttatgatctgggaccttatcagttgaacaaaatgaatccaggtgggtaaacccaaattaagcttgaatctctaagcccccttttggctggctgccacccaagggatatatgaaacaaaccatcctgagattgcttttgggaaaaagaaagaagcaagataaccagggttgggccaggcagaatcccc

SEQ ID NO: 21426 - DNA, 117 bp, Homo sapiens
gtacaaaataacaaacacatgcaaaagtagagaatagtaacatgaatcctcatgtacccatccccagattcgataattaaaactcatagccaatcatgtttaatctatatccccaca

SEQ ID NO: 21427 - DNA, 441 bp, Homo sapiens
  misc_feature 33: r=a or g
tagaatccacgttaagataactgattcatggaraggtccttccatccagagaatgttggggtcatggagataactttggaatcccgacccagaaataaaaggtacaaatgaggctgggaagaggtgacaagggagagcgtgttagttatccaaaagactatgtagagataaagggagcctggggatactcttacatccagatgtcacaataacaaagacaaagctctagggtttaaaagtttggactataatttatcctctatcactaattttctgggtagcctcaaaaaatgtcatttaactcctctgagctttaatgctttatttgctcaatgaagatgttgaagtacatgacatgtgactgtggtcacctcaagcactaaggtctatatgtctctacattagatgagggcatccaaaatatattccatttaacagtta

SEQ ID NO: 21428 - DNA, 366 bp, Homo sapiens
  misc_feature 159: y=c or t
ttcatctagattttaaatttatgattcattttagatctaggaatcatggtgctgttaggaaaatagttttagaggttatttaattttgcattaggagtatactgtgcctgagctttcattttaagcttgatattaagaaattcatattcagatgcagtyctacatttgctagaactgtccagagacaaaattatgcttctcccgaagggcattattacttacttgaaacagaaaccgagtatgtgcctgttccagtaatggatatgtcagggtggaataatcaccctaacagaggcagccacccaaagtttttgtgttttgactagagaaaatgactcttagcgatgcataagacacccctcaaaa

SEQ ID NO: 21429 - DNA, 262 bp, Homo sapiens
  misc_feature 213: n=a, g, c or t
  misc_feature 214: n=a, g, c or t
  misc_feature 215: d=a or g or t
  misc_feature 231: b=c or g or t
  misc_feature 232: b=c or g or t
acttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattnndgtcacatttgtaaaabbaattttaatagttaatcatctctgagagac

SEQ ID NO: 21430 - DNA, 235 bp, Homo sapiens
actgaggggtttgcaaaggtatgtgaggagagagaagggaaggctcgtctggttttggtgaagtcaagaacggcttcctaaaaaggtgaatgaacaaagtctagaaggctgaaggctgagcagaagctgcaaggaaaagtcacccgaaattaaacgagcaaggcaggcgagagcatcggagagtgagagcttccaggagccggatgtgcctggggacggggcttatgtcaaggac

SEQ ID NO: 21431 - DNA, 329 bp, Homo sapiens
cccttctagtggtagtatggcttcattgctttatttagatccctgattcgtttggagtttattttggtttatggtatgaggttttccaaatgaggttttccagtggctagccaattattttaacattgtattaatccattttcatgctgctatgaagacatccccttgactgggtaatttataaagaaaagttgtttaattgactcacagttcagcatggctggggaggcctcaggaaacttaacagtcatggcagaagaggaagcaacatgtcctttttcccatgacagcatcatggagatgtgccaaacaaatgggagaacagcccg

SEQ ID NO: 21432 - DNA, 441 bp, Homo sapiens
  misc_feature 167: n=a, g, c or t
  misc_feature 400: b=c or g or t
aatgtaagccatacaaatgggaccagctgtgcaaatgacatttgcaaggcaatgccttgtctcccactcaaactccatttctccacctaggaggagaacttgaccgctagatgtggtttgtgttcagaataatcaggggcgggttacaagctcccccatcacgcacntagtgtccacaagtgtgcacatctccactaagttccccagctgcaaggaagcagcttgtatttgcagtaaaagctgtagttggcagtgtcagctctttttgccagcctaaagcttgtgagagacactcaactcaattccacctgagtctgatgaatttaatggaagaaaactgaattcccaggaagtgtggtggtctaacaaattccatcaataggaagcattttcttgagtbctgtacttcaaatatgctatggaagcagccacattccttgt

SEQ ID NO: 21433 - DNA, 92 bp, Homo sapiens
aaaattcacgggcagaatgtcccctttgatgcagtggtagtggataaatccactggtgagggagtcattcgctccaaagagaaactggacgc

SEQ ID NO: 21434 - DNA, 152 bp, Homo sapiens
caactgatacaccatatagtcttagagctcaatcttagtggagagacatctcctttctacttttgtctttgactattcagtagccatttgatcttgggcaattaacttcacttgggttagtaacttaattctttgtctcagtagccacacca

SEQ ID NO: 21435 - DNA, 98 bp, Homo sapiens
  misc_feature 32: s=g or c
cagggggtgaggtctctgcaccctgggggggscttaggacctggactcagcctctgagatgttgggagaggctactcccaccccctggtgaccccagt

SEQ ID NO: 21436 - DNA, 115 bp, Homo sapiens
  misc_feature 2: b=c or g or t
tbaaagaggtttaagtgatgcccagttctgcatggctggggaggcttcaggaaacttacaatcatggcagaaggggaagcaaactcgtccttctttacatagtagcaggagagcg

SEQ ID NO: 21437 - DNA, 262 bp, Homo sapiens
tgtatcaaatgtttacatagttatatttgaagaaatgagacaaagcaagagcaagagcaaaagagagagataggatttaaggaatgaggcaaacatttaaattgttagagtaagattactggaagaaatagacgtattgttttaaataaaagcagtaatttaaatcaagctaatctttttggccagaaatacctgttttgaaagatttttttttattaacacttcatctgagaaatggaaagcttatttaaaaaaaaaaaaa

SEQ ID NO: 21438 - DNA, 586 bp, Homo sapiens
ctactgtaatcaatgaggaagactttttcttatcagatttattaaactcatttaccatacaaatagcattataacattaaagaaaattttttaaaaattctgtaccataaaacaattactggttccttcctacctgtttttaggtttgcagatgaataatgtgtggatttttggcagacacactgctgaaaatttttcactttgttgggtgagcatctcaccctatctccatttgtctccctgctctgagttctagagaagaccaccaataagcaagtgaaattctttggccaagtcactgatatcagaattccccagaggcaccaagaactttgatttccagaaattgtttaggcacagccactcattcaaccttatattttgtatctcagagttaaggttgcatttgggctacctagcctgtagactctattttaagacaagcaggcatttaatagttgttggttggttgattagagcttctagccaatttttaaaaattatttgaatagataaggcattcactggttcaaaaaaaattttttaatcatcacttccacccatccagttatcactactgaagtaa

SEQ ID NO: 21439 - DNA, 349 bp, Homo sapiens
catctggcccaagtaagattgagtttttgtgaatgactagattcttttggaaagaaaggagaacttctgcattctgaattgtgcacgtgtcactccctactacctaacatctgtccactttcattggtttggcaaaggggttgaggtctgttgctgcctggactccctgtgaatgtgtgtctcccacatgttagtagtgcccggtactcaatcacaccatctttgtgtcactccagtgtccatttctaagctgcccctttgttgatttcaaatccgccatgggctgactcgaaattctcacgccttgggtctttattctcccttcttttgtctggtcctgtccctcctg

SEQ ID NO: 21440 - DNA, 203 bp, Homo sapiens
  misc_feature 203: n=a, g, c or t
aacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagggn

SEQ ID NO: 21441 - DNA, 217 bp, Homo sapiens
  misc_feature 33: s=g or c
  misc_feature 119: r=a or g
atcgagtgtttgccagatgttaagacactgggstaaggactttaaatgtattaactcattaaagcttagaataatcctatatgctagataagattatttacattgtaaaggaaacagaracacaaagatattaagtaacttgccaaaggactacatggctggtaagtgacagaaacaaggcttaaaatccaaactgtctgattgcagagcccaggaa

SEQ ID NO: 21442 - DNA, 319 bp, Homo sapiens
  misc_feature 243: k=g or t
tgagaattaatccgaatagaattcctataccctcccaacataacatctgcctccttcctacatctggacccaaaaccctgctctctccccacaaccccattaatataaacgaactgtctgtgcttctatgcaaagccatctacttcccttgggccctgtaccccatcctttctctattattcaggacatcactctagcaattgtcccttttgtttctccatcatcaaattttccttctatackacataattccctctaaataataacatttttatttctcacaattcaaaaacaaaacaaaaaatgatcacatgacccc

SEQ ID NO: 21443 - DNA, 461 bp, Homo sapiens
  misc_feature 432: w=a or t
ttatcaaggaaacactgcaatggatgtcagtcttcacagccatttaagaaaaattattatcaatcttgtaatttttctatgataaagacactggaagctcgagaacaaaagcattatagttgcctatgtgatgttgctttacaaataagaatatttctgtaaatgctcctaccttctgtcagtaatctctgtccatcattagtttaagtgttatataatccttcaattttaaattataaaaattattgaactaaaattttagcaaaaatgaaatggaatatgcctcttcttttctgaacaacgctaaatatgtctctatttatctttaaatatgaattataaaacctaccagagagagttgctctaaggattaaatgagattctgtgtgtggggtgtgtgtggtgtgtgtgtgtgtgtgtgtgtgtgtgtgwcacccaataaatggtggtaggcactatat

SEQ ID NO: 21444 - DNA, 205 bp, Homo sapiens
  misc_feature 115: y=c or t
  misc_feature 141: y=c or t
  misc_feature 146: k=g or t
  misc_feature 182: k=g or t
aaaagaagaggaaaaagaagaaaataaaaacaatgcagtgaatcacagatgtctcctgaaagaactcttttagatgaaatcattctactcaaatgtaccttaatttttttttttyccctgagtaaaagcaagaaatttctyccttkggaaaaaatatatatattaaaaaaccacttttagakggttttttttaaaaaaaaaaaaa

SEQ ID NO: 21445 - DNA, 120 bp, Homo sapiens
taacaaaatatgctttgggttgaatatataaagtttctactttactcaccctgcagaataccccactatgtatgtttattcttcagagggaacattaatcttgttttctttttttttttt

SEQ ID NO: 21446 - DNA, 300 bp, Homo sapiens
  misc_feature 53: s=g or c
gtccactcgcccggggtgctgaatgcagcagcggcggccgcggcgccggcggsgagatagccgagagcctccctcgctgcaagaaccttgtttccagttctcggacggtcagctcgccgccccgccacctcccttccagcaccacccctttgggaatcgagccagtgggggcagcggcgggtgctgagcaacggcggaagacgagacaacacctggcagcagcctggaatctgatttgcttcctctcggcttttataagagatatatttatatacggttttggggagtcgcgaggacacc

SEQ ID NO: 21447 - DNA, 115 bp, Homo sapiens
gcattggggtactctgggaaacagtctctgagctacactggacaaaatccatgcataaaaaaaatttttacaaagattttttaaagccaagacactttcaaattgaggaaaagaa

SEQ ID NO: 21448 - DNA, 117 bp, Homo sapiens
tacaaacttagaagagcaattagaacagtttagagaagaactggaaaataagaatgaagaagttcaacaattacatatgcaattagaaatacagaaaaaggaatctactacccgcct

SEQ ID NO: 21449 - DNA, 374 bp, Homo sapiens
  misc_feature 343: r=a or g
tactcagaaatgacaagcatttgttacatatgttcagctgacaatgagtcagtgtcacatgaaagacaagtaaaaaaattggattaattttgttataaagagatttacattttgctatttctaacatgtcttttggagattgatgaataagaaatgagataagagagcccttcagaaactactattgctgaatatggtagaaaaattgctcttgctagaagatgtatcaagtttttgtcaggtaaagctagggaaaattctcttgtgttatcaactaatcttaccagagagggaatattatgcaagatgaatgacattgctttctccctctctcagaagtcargcggttgtgcactatgccaatctaacaagat

SEQ ID NO: 21450 - DNA, 250 bp, Homo sapiens
caacaatctcccttagattctaatcgcttcccattatttgcagtattttatctttctcctccctcctaatgcttcggccgcatgtttctctgatttttctctgcagaaggctcttaccgctgggcccttgcacatgccattcccactgtttgcacctcccacatcctcaatcttcacctagctaacacctttgcatttttcaagtctcagtttaaacgtgacttcttccagaaggcactccctgcaccca

SEQ ID NO: 21451 - DNA, 115 bp, Homo sapiens
  misc_feature 11: k=g or t
tttcttaagtkatgttcccagtagaaaccagcagaggggcatggggaaatgggtgggaagagaaggaccagaaatcctgcgtcccaagccaagtcctggtgggtcagtgtgggtc

SEQ ID NO: 21452 - DNA, 143 bp, Homo sapiens
acttccacggctcagcgtcaggcaagttggcctctctgttgtaaattagtggttaaggttatctattattgccacttttccagcgctaaaggctgttttggaaccagtgttgcttgttccgcgggtgattggctttttttttt

SEQ ID NO: 21453 - DNA, 366 bp, Homo sapiens
  misc_feature 11: w=a or t
  misc_feature 12: w=a or t
attatacctgwwaagggatttgtatctagagaatgtaaagctctgcaactcgaaggacaaataatccaattaaagaatgggcaaaggatttgagtaagtatttcttcaaagaacatacccaaatggtcaataagcacatgaaaatatgctcaacatcattaactagcaatgcatataaatacaaataaaatcatggtgagatacgacttcatacccactaggatggctatactggaaaagacagataataaccagcattgggaagaatgtggagctgttagaaccctcatgcactgccagtgggaatgtaaaatggtgagccacattggaagagtttgggagtcctaagataagaagttaaacata

SEQ ID NO: 21454 - DNA, 109 bp, Homo sapiens
attaatttttgtataaggtgtaaggaagggatccagttttagctttctacatatggctcgccagttttcccagcacaatttattaaataggtaatcctctccccatccc

SEQ ID NO: 21455 - DNA, 312 bp, Homo sapiens
  misc_feature 270: y=c or t
cacttagaaattgtatattgagtgctcactatgtgccaaacattattctaggtactggaggtaaagcaattaacaaagcatatgaaatttctatcctcgtgaaacttatgttttggtgggacaagatagacaataaacagaaaaatagataatttggcaatgaaaatcagtgctacaaagaaaaataaagcaaattcaggggtgatagtgctgagtgtgtgtgggtggggtagtgtgggtgtggatgaagggcgtgtgtgcatgtgtgtycaattttaaataggactgtcagggaaggtatcacatacgagc

SEQ ID NO: 21456 - DNA, 146 bp, Homo sapiens
atttccgggaggggacgaaggggtagttctttcacctcggctgggcgcctagaaaagcctagaaacagctccttttttcttccgcctccgagtcttcgcgtcaggtcctgcgcagggcccttggggcgaatcgcggtgcgcgtcgt

SEQ ID NO: 21457 - DNA, 369 bp, Homo sapiens
  misc_feature 13: s=g or c
ttctgcagcagtsagttatcctgctaaagcataaagcaactgtgttattcctctgtggagaaccttctatctctctgagctgaagctaaaatgttagagggcctgctggccttgtactttctcttactgtttccttccattctctgacatcatctccttctactcctctctttattgactccactctctgctctgtcctcattgctgttccttgaacctactaacctcttttctgtctcagggactttgaccttgaggtccaactgtctggattgcttttcgcaccaggaatcagcatagctcattcccgtctctcttttcagccttgacttaagttgtctcagtgaggacttgctgaccacaacacca

SEQ ID NO: 21458 - DNA, 265 bp, Homo sapiens
ctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaaccca

SEQ ID NO: 21459 - DNA, 440 bp, Homo sapiens
  misc_feature 375: r=a or g
  misc_feature 379: n=a, g, c or t
  misc_feature 384: w=a or t
  misc_feature 386: s=g or c
  misc_feature 427: w=a or t
taaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggcgggcagatcacctgtcaggagtttgggaccagcctggccaacatggtgaaaccccgtttctaccaaaaatacaaaaattagccgggcgtggtggcgtgtgccactgtagtcccagctattcagaaggctgaggcaggagaatcacttgaacccgggaggtggargttncagtwasctgagatcacgctactgcattcctgcttgggcgacagagtwagactctgcctca

SEQ ID NO: 21460 - DNA, 254 bp, Homo sapiens
aattcttatgaaagcagttcacactttaagacatactgctaaaggcattttaaaatttacatgcaagaatagattagcattcagtcctatttacaacatactggagcagttgctcatctgatttctacctatggcatgaaggcttcagaatgaaataggtttgctgatttttgtagtttttaggtttttcattatttttgtacacttttggtcttttcaatatgttcatatagcacaagtttataattgcattc

SEQ ID NO: 21461 - DNA, 122 bp, Homo sapiens
catatatttaccactcattaaatagaagtggatcttcttaaagatcttcatcctcatcttcaggttgaataggctgaggaggacgagggagaggagaggttggtcttgcagtctcaagggtg

SEQ ID NO: 21462 - DNA, 330 bp, Homo sapiens
ttttgcagcttactgtttcatgtaatactggtatgtgtcattgaatctgcccttgtgattccatatagaccatttacataatggcatcatggtattcattggatgcatgtaccatgatttattgtttgatttatttatttttttgatttatttattttatttatttattgtgtgatttatgtattgtttcctttgcttttgtacatttagattgtgtccaacttttctctattttagactaaactgcactgtgcattctacgtacacatctttgtatattcatgctagtgttgctctgcaataaaatggtagaaatgggctcctggtaac

SEQ ID NO: 21463 - DNA, 147 bp, Homo sapiens
  misc_feature 123: r=a or g
  misc_feature 126: r=a or g
ctgaggtgggaggattgcttgagcccaggaggcagaggttgcagtgagccaaggtcacgtcactgcactctagcctgggcaacagagtaagacaaaaaaatatatatatattgaaaatcaaargarggcaaaattttgacaaggaag

SEQ ID NO: 21464 - DNA, 451 bp, Homo sapiens
  misc_feature 128: y=c or t
gatggaatgttatatggcttctgaaaatgaattacagttatgtataacaaatagatgaatcttagtgatactattgaggagaggaagagggaacaagtcccagaagattacatatagtcagatacccytttaaaaatacctctttaatgtattaccgttaataaagttttgaaacaagcacaactaaatgtattatttacatgcacataaaattgagaatattggttaattcttgaaatttcacatgtgtccaaaaatgaccaagagatagggatagggagaaacatttaataagatcgttttggtaatgttctagttcttgggcagtgagattacagttgttcattttattattaaagaaaatttttgaaatgtaagaggacaacacatggaccagtgattaagttcatgtatatgacagtatcagcatttatccaattattcattctca

SEQ ID NO: 21465 - DNA, 434 bp, Homo sapiens
  misc_feature 282: s=g or c
  misc_feature 283: v=a or c or g
  misc_feature 284: m=a or c
aatgatagggtttctcccatagtaaagacaaggtatcttagtccagtatgaaggatttagtcagagattgatataaggaaggtggtggctatgaagtaggtaaagtagaagaaaatcctattctctttggcttggagaattacgggaaaggggtagaagagctcaagaaagacaccagaaacatttttactgttcccaccctgaagatgtagggtgaggggttgtggctttagaaatatccagattggtgtgggaaaactcaaggacagagaaattactttsvmaattctcagatatctgggaagatatcaggctgagcaggaaccacattccagtaaccttgaacagggcggagacagggtaggcattgactttccagagtgctgtaagtttctatgtactgttgagactcagaaaacaatactcccctcctc

SEQ ID NO: 21466 - DNA, 232 bp, Homo sapiens
catgcaaatattagatacagattcctaagcatttggaaatggacagaatatggagatcattgtaagctgaatttgtcaaagtagtaaggcttacataggtcttgaagaaagcattatagtttagattatggaaggattaaggaggctattttatgaagctggaaaggtgtgaaaaaagcatggacattggggatatccagagttatggtttcctgtgtaataactagtgaag

SEQ ID NO: 21467 - DNA, 375 bp, Homo sapiens
  misc_feature 256: m=a or c
  misc_feature 257: w=a or t
agatgattcaaacactgctgtactttaatggttactgcaaaataccacagttcacgatgattctacagcgatactctagaactgctgtaacgttcgagtagacatgagatcactgggtgggattgtgtttttaccaacatatgaaactgtaattatccatgagcaccgtactgcctttggagacactgctgggactgtgactcagacctcccttgagacaactggtcattaggagtcacagtgatgtggaatcaamwttgtctttctgaaaagctggagatattcatcatagcctggactgcctgggatctacatgttttctccgtgttgtaatgatgtgaaacactttattagcagaggaagacatttttagga

SEQ ID NO: 21468 - DNA, 342 bp, Homo sapiens
  misc_feature 118: m=a or c
  misc_feature 120: r=a or g
  misc_feature 137: y=c or t
aggggaggagcctgctgttgccccagcaacaaccacggaaaccaagacgagcgcggtcgcggaagtatcgcggcttacatatctcgcagccaggcgggtcctgggagaggcgcgagcmargcctggtcggcgcccgyggagaaaagaagcagtcaagcccatgaactacaaccccggttgccgctttctcctctcctaaccgttaagtgcgctaagggccatggctgaggtgcacgtgatcgggcagatcatgggggccagcggtttctcggaaagtagcctcttctgcaagtggggcattcacacaggggcggcatggaagctcctgtcaggcgtgcggga

SEQ ID NO: 21469 - DNA, 146 bp, Homo sapiens
  misc_feature 98: m=a or c
  misc_feature 122: r=a or g
  misc_feature 125: w=a or t
  misc_feature 130: r=a or g
ctgaggtgggaggattgcttgagcccaggaggcagaggttgcagtgagccaaggtcacgtcactgcactctagcctgggcaacagagtaagacaaaamaatatatatatattgaaaatcaarggwggcaraattttgacaaggaag

SEQ ID NO: 21470 - DNA, 141 bp, Homo sapiens
tttatttttttcatggattacttttattttgtgcttatgtgctaggaatgtttggcttggtttttgtccctggagagtgcagttgagaactgacaggttatatgaagttgaaaagaaatttaatgagttgtaaaaaccagt

SEQ ID NO: 21471 - DNA, 68 bp, Homo sapiens
  misc_feature 25: n=a, g, c or t
  misc_feature 33: d=a or g or t
  misc_feature 34: m=a or c
ctctctctctctctctccctctatntctcttcdmtctctctctctccctctttttttttttttttttt

SEQ ID NO: 21472 - DNA, 356 bp, Homo sapiens
  misc_feature 275: r=a or g
  misc_feature 276: n=a, g, c or t
  misc_feature 277: b=c or g or t
  misc_feature 278: h=a or c or t
actgtatttactacttcatatatcgccctttaatgctatcttgcaaaggatacaatcgagtgtaatgtgacatagaaaagtgtaagggttgattttttttgttttgggggtctctaggaaaaggatgaagatgtgtaaaagataccttaactccaccaagaggggctgctgagttggttgtgtaatggagatttatttagtcattgtccttgagtttctgtgtaacctgggtagaaagagagctctgagaacacaaaaagatggggtggagtggrnbhtaagagctgaatggttgtgaaaaataaaatgcattaaaaaggcattaaagaagacatagttatcactgaaaggctata

SEQ ID NO: 21473 - DNA, 108 bp, Homo sapiens
  misc_feature 25: r=a or g
  misc_feature 32: r=a or g
  misc_feature 46: r=a or g
  misc_feature 47: s=g or c
  misc_feature 82: s=g or c
  misc_feature 84: w=a or t
ttagggtccttacctctggtaattrttaggartttgtaggaaatgrstgtgaaaccatgtaactggcagtgttgtagggtascwtcagtattaagttctcttcgcctc

SEQ ID NO: 21474 - DNA, 156 bp, Homo sapiens
cctgcagagaaataagctatatgtcaccttcgttggggaggaagggctggattacagtgggccttctagagagtttttcttcctggtatccagagaactctttaacccatattatggcttatttgaatattcagccaatgacacatacacagatat

SEQ ID NO: 21475 - DNA, 220 bp, Homo sapiens
attcatctttgcctttcattatattagtccatctttccgtcggaagcaccagcactcgccaggctctccccctccctgctcccagtctgggagcccatctacctggggacccccggccctgctccccaggaaggtccttgggaagaaagagtttcgctcttgttgcccaggctggagtgcgatggtgtgatctcggctcactgcaacctccaccccaaaa

SEQ ID NO: 21476 - DNA, 191 bp, Homo sapiens
aaagtatgaatagtatgaatatttttgtaattctctttctgcacctctatggagactgggccactgaagaccccagcttacactagggataaacacaaaatgagcatagcaaactttctctatgcccaagaatgaatcagttgctggcttacctcacccacagataaactctcttgctcttcctgtgccac

SEQ ID NO: 21477 - DNA, 355 bp, Homo sapiens
  misc_feature 308: k=g or t
  misc_feature 310: n=a, g, c or t
  misc_feature 311: k=g or t
  misc_feature 353: v=a or c or g
taggagtcatggttcctttctgtccatatggataccctttattccagcaccattagttaaaaagcacttgtcttcattggattgctctggtgtctttgttgaaaataaccacgaagtgtgggtctatttctgggttctctattctgttccattgatcaattaatgtatacttacacaaatgttacactgtcctggttaccatttttttttctttgagacagagtctccctctgtcacccaggctggagtgtagtagcgcagtgttggctcactgcaacctccgccttctgggttcaagcgattctcgkanktcagcctcccaagtagctgggaggaggcgagtgccaccacavgg

SEQ ID NO: 21478 - DNA, 56 bp, Homo sapiens
  misc_feature 8: w=a or t
ctgttttwaattttatttccaaaaggcagcttgaaatgttggtcctaatcttaatt

SEQ ID NO: 21479 - DNA, 334 bp, Homo sapiens
  misc_feature 245: n=a, g, c or t
  misc_feature 246: n=a, g, c or t
  misc_feature 311: n=a, g, c or t
  misc_feature 313: n=a, g, c or t
  misc_feature 314: m=a or c
aagaccggcttccaggtggccccaccacctgtgctgggcccctgctgggctcacttgactgtccctgagcccatcactcacccttttggagcaatttttgaaacagaccgctaagtacccagggtattagctggtctcatccctaccatgccggggaacagcatttggatcaccgcagtagcagcccaaggagacacacaagtagctgctttctcggactgtattattttctgaaacacatccannaggagctggacaaggagctgggggagagcgagggcctcagtgacgacgaggagaccatctccacnanmggtggtccggcggcgggtcc

SEQ ID NO: 21480 - DNA, 256 bp, Homo sapiens
  misc_feature 128: k=g or t
  misc_feature 129: n=a, g, c or t
  misc_feature 179: w=a or t
tctttaaaagttgagtaaattccattcgttgcataatttggaaatcttttcctcccaagaatcatttacactcaactttcataatataaccgcaccattcctacatcattctcatgttctgaaaaagknttattaatgaccgacacttattagactcagtgacaatccaagcaagcaawttatctggtgcttacaagctcaggggcaaaattaaatcagcttcagtgtgaaaagatcaacatccaggaggccaaat

SEQ ID NO: 21481 - DNA, 413 bp, Homo sapiens
  misc_feature 318: n=a, g, c or t
  misc_feature 319: r=a or g
  misc_feature 324: k=g or t
  misc_feature 326: n=a, g, c or t
  misc_feature 331: r=a or g
  misc_feature 332: n=a, g, c or t
ctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcagaggtgaatgtgtattnrgggakgnggggrnggcatattacaacaaagctgtatttaaaataacacaatcatatcatgctataaacaatagcagttccagaatggctactaa

SEQ ID NO: 21482 - DNA, 232 bp, Homo sapiens
  misc_feature 126: k=g or t
aaaaggcacttcggagccgagttggggcagcggtggagcggggacttcgcgcccccaggggaacgggcgcccctgcgaaaccgtcgccagccacgcgtccttgccgtccgacgccccctcacattkggaggaccccggatctctcccgcctccttcgggtcgctctccgggctttctcagggtaagacgacctctggatgctcaccctgccctcttcacctctcgtcccctc

SEQ ID NO: 21483 - DNA, 354 bp, Homo sapiens
  misc_feature 95: r=a or g
  misc_feature 257: s=g or c
atggacgagtcgagcctcctgcggcgccgcgggctccagaaggagctgagcctgccacgccgaggacgtggctgccgcagcgggaaccgcaagarcttggtggtaggaacgccctccccgaccctctcccggcccctgtcgccattgtcggtcccaacggcaggcagcagccccttggatagtcctcggaatttctcggctgcctctgccctaaatttcccctttgcccggaggtgagtgattgccggctttgggasacagtgcgggcaccacgggcaggggttgggcaggggcacgtgctcggtggctagacctggctcctcattcatttcattcaccttttcccctccccta

SEQ ID NO: 21484 - DNA, 500 bp, Homo sapiens
  misc_feature 445: r=a or g
  misc_feature 495: r=a or g
caagattacactccagaaatatctcaatccattaaccctccatcagtttagtccaaagagattcttacaaggccctgatgatccttcgaagcaccactcagctagagttttagttcagagacaaggctgtaccccaaatgtcagctctagtccactcttgattgtcttaattaataaaaactttgtgaggactaagcccatgagtcacaggcccaaacctacttagtgcttctccaattatgtgtggagatggatttttttcttaaaagactgcaacctatagactaatacatttgtaaaatactataaaaataacttactagaaaaatgaaataaagatattgttttagtctgttttctattgcttataacaaaatacctggagttggttaatttgtaagacattaaatgtatttccttcagttctggaggctgggaagtccargtcagggggtgcatctggtgagaaccttcttgttgttcagactctctgargagtc

SEQ ID NO: 21485 - DNA, 94 bp, Homo sapiens
catttgcataccggagaactgagaaaaattaaaatacagtccatattaattcttaggactctggaggcccccacactatcaccactgaatgtct

SEQ ID NO: 21486 - DNA, 344 bp, Homo sapiens
  misc_feature 331: d=a or g or t
  misc_feature 332: b=c or g or t
taaaagataactttcagtatagtgcaagccataatattggtgcatttgaaaatgcagataaggccgggtgctgtggctcatgcctgtaatcccagcactttgggaggcggaggcgggtggatcacctgaggccagccggaaactttaaaccagaggtttaaaagccttgttttggccatagtacatttgagaaaccagatagactatttttatattatttgagtgaatatttagtaaattgtccactagaagagaccagaattgctttgtgttctgtagaagagcagatccacagccacaaatgtcaagtttacacagaggtgcacttcadbccagcccacgaa

SEQ ID NO: 21487 - DNA, 385 bp, Homo sapiens
ttcaacaacaacaaattggcaaataatgtagcctcttaggtgcataagactgtggtggcataaaaagctttaaggagcttttaactgaataggcaaaaaccacatgtgcataccatgaccaatgtgacctttccaagacataaatttaatcgcaccatggcagagccatttaagaagctttgcaatacctttaggagataagatccatactcctaatgtggccatcaaagccttttatgatgtaacctctgatttctcccacactcatcacccaccaccattccttaacttcattcatgccaggctagtaataataatgatggctaagctttgttgagctcttaccatacagctgagtactttatgttcttgtttaacagcctac

SEQ ID NO: 21488 - DNA, 84 bp, Homo sapiens
  misc_feature 73: h=a or c or t
tgtgcacaatgtttgctgaatgggaatgagtaagtgaatctttctatgatgtatcatcctggagaaattgaghgcgatctgaga

SEQ ID NO: 21489 - DNA, 190 bp, Homo sapiens
gataaagagctgggctgagtcatctgtggaggagaaaagtcacatccagctccttcatgttgctgccgatgtgggattttcctggcttcgtcagccaagcaattggctgcctttgccgggggctttgagaaccaaggcttgaaggccggcaggagcatccagggggaagcttggcttcagggaggaacct

SEQ ID NO: 21490 - DNA, 468 bp, Homo sapiens
  misc_feature 272: n=a, g, c or t
  misc_feature 273: n=a, g, c or t
  misc_feature 343: v=a or c or g
  misc_feature 344: n=a, g, c or t
  misc_feature 450: m=a or c
tgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaannaaacagggacttcagaaagccgcacagaaagatcaccttctgatggtgtgatgtgctcctgacattcggvngaggtctgtattctgaaaaagatttaatggcctgtgaaacacgtggattctgttgcactggatttgtaataaatgacgctgaacttcctgcttccaagcagctcamcctgatgctgaactgaca

SEQ ID NO: 21491 - DNA, 127 bp, Homo sapiens
ccaaaaatatatgtgttattatgtgaaaatatcagacaagccctacttgacggatattctataaaataactgtctgctactcttctaaagtgttaagagcatgcagtagactaaggagctgtcccct

SEQ ID NO: 21492 - DNA, 173 bp, Homo sapiens
  misc_feature 49: n=a, g, c or t
  misc_feature 51: r=a or g
  misc_feature 54: r=a or g
agtaacaagtgagagcgctccaccccgcagtcccccccgcctctcctcncrtgrgtcccctcggctctcggaagaaaaaccaacagcatctccagctctcgcgcggaattgtctcttcaactttacccaaccgacgacaaggaaccagcctcaaccttttaatgcacaggccc

SEQ ID NO: 21493 - DNA, 230 bp, Homo sapiens
  misc_feature 204: k=g or t
  misc_feature 205: w=a or t
gtcggtggatgtcttttaaggtcgttggagggaagaggacgggaggggtgtgccgaggggtaggtggagagaggcaccgagtccagagccgggatataaatgcaccaggagccggggagcagaggagcaaatgagtgggggaaagtgtgagaggaagagttggagaaaagtcgggggaaagtagggacagggttaaggggagakwggaggatgagggcggcgaggaaaga

SEQ ID NO: 21494 - DNA, 134 bp, Homo sapiens
  misc_feature 85: k=g or t
  misc_feature 121: n=a, g, c or t
  misc_feature 122: k=g or t
  misc_feature 123: n=a, g, c or t
tgattagcacccagcatgggctgggtggctaggtggttggaatgacagtggactgcacgcttggtgcatcgtgcatcgtgaccakcctggaagcactgcgggtgtcgccaagccctttccnknagacctgcatc

SEQ ID NO: 21495 - DNA, 267 bp, Homo sapiens
  misc_feature 47: r=a or g
cccatttatcctgctttctttgggattgctaggcaaggtctggccargccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataat

SEQ ID NO: 21496 - DNA, 208 bp, Homo sapiens
gcgcgtaactttgttgataacaggtactgctggctgctgggtctcttgggcaagacacaggtatccatttcccgaaagaaaagactcttttccgtcccatgaaactgaaagggcattcgaaggcttccacataaatatgcacaaattacctgataattaaaaaggggaaatagtaactatcgtagagaagctccgcagacaccatata

SEQ ID NO: 21497 - DNA, 468 bp, Homo sapiens
  misc_feature 2: n=a, g, c or t
tnctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcat

SEQ ID NO: 21498 - DNA, 343 bp, Homo sapiens
tcatcttccaaaaaacagcaaccatgcccataccctattgagacaaggctaagggtatataagagtatctgccataccattccccagcctgggcctaatccaaggatgcaagccactcccaatgtggcatttcataaaaattgcatgtgacacatggaagcccctcattagcaggtggtcccattgaccagaatcccagcacagagggtagaaaaaaactgcaaatgatgcccctgcttcttgggtatggttttccagaagaagcaaaagctgtcattagccagttgattcctttgtgggatcctctgaaggcttggtgtccatttttttactgatcgggcct

SEQ ID NO: 21499 - DNA, 255 bp, Homo sapiens
cttcctcctatccgcatacgtagaatgccattttgaggagacgttcgaggagtgcagagtgatttctttgggaaccgtttagagtactgtaatacaaatcggaaaaacgcccaatgactactgagtgttacaggtctctactattacaaaaggtgaaataaatagagatgtgaaattggaatgggtgtgttgtcagggaaaacacatgaggaggtgttttctctttcaacattcaggatgagttgatggggaaaa

SEQ ID NO: 21500 - DNA, 208 bp, Homo sapiens
  misc_feature 13: v=a or c or g
gattatatttgavaagaatgtgtccattaagaagattaatcattttttgttagtgaagctttatttttaggagaaagattggtaaacaattaatatgttttcaagtacatacattatatgagctagctggggggtctgaatatgatgaagcaaatgtcaagctgggttttttaaaggcagacttgacagttggttgtgttaatggggc

SEQ ID NO: 21501 - DNA, 191 bp, Homo sapiens
cattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacacgt

SEQ ID NO: 21502 - DNA, 367 bp, Homo sapiens
gtgtgtgtgtgtgtatgtgtgtgttttaaacaagggttgctgacttgagaagaatttgttctcaagttttttctgattattgctggcgtagttgtatatgtagtacttgcagggaaaaaaaaagcatttcaaaatcaatttggaaaggaagtttgtgagattgaagacatttttagtatgcctgttacactgtgcatgaagtttggatttaggttctcgcagtagttgctgagtgaccagtgggataggctgtggcaacatgttatgtattccagtggactacctaggggagcattatattaggtgacacttgattttttcttacagggaagttacggagttccctgtaaaactttaactttttttt

SEQ ID NO: 21503 - DNA, 510 bp, Homo sapiens
  misc_feature 327: n=a, g, c or t
  misc_feature 328: k=g or t
cagattgctgggctcatggtcagagttcccagttaagtaaatcaggaaatttgtatttctaacaagtttataggtgaggccaatactgctgttttgggaactatgctttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacaankgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagctt

SEQ ID NO: 21504 - DNA, 179 bp, Homo sapiens
tttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaacga

SEQ ID NO: 21505 - DNA, 144 bp, Homo sapiens
ctctaagttttagggtacatgtgcacattgtgcaggttagttacatatgtatacatgtgccatgctggtgcgctgcacccactaatgtgtcatctagcattaggtatatctcccaatgctatccctcccccctcccccgaccct

SEQ ID NO: 21506 - DNA, 79 bp, Homo sapiens
tttaaattacaattttgttaaatctgattttgctcgcataacttctagtgatgtttgtcatattttatctaacgctgca

SEQ ID NO: 21507 - DNA, 279 bp, Homo sapiens
aaccacaaaggatgatccagcccaaatgtcacttgtacccatgttgagaaacccagatatagacatagcgttctttcttatggtaacagattccatagtgtaaatgtaccatcatttaaccactcacttactgatgagcattttaggatatttccaattctttactgttgcaaacaatgctgcaaggaacatccctgcataagcatccatgcctcttcatgcacatgggcaggtatttcccgaggacagatagccagcagagggtcaaaagaggacgcc

SEQ ID NO: 21508 - DNA, 138 bp, Homo sapiens
gtagagacggggtttcaccgtggtagccaagatggtctcaatctcctgacctagtcatccacctgcctcggcctcccaaagtgctgggatttacagacatgagccaccatgcctggcctttttttttttttttttttt

SEQ ID NO: 21509 - DNA, 350 bp, Homo sapiens
  misc_feature 314: m=a or c
  misc_feature 315: n=a, g, c or t
ccgctcagcgctggccttgcagcccttactaaaagacttgaaagtccctgggttcaccccctgagtgaattaaaggccagaggggccccgaaggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaamnccggctgagctcgatttttacctaaatatcagtct

SEQ ID NO: 21510 - DNA, 258 bp, Homo sapiens
gtcacatgttataaatactccattttatttctatctttgctactttatatggctaaatctactggattttcccttcattattccatttcttttttatttttttcaacttttattttaaattcaagaaggtacttgtgcaggtttgttacctgggtatatggccatgatgctgaggtttggcatacaaatgatcccatgatcaggtactgagcatggtacccaacagttaatttttccaccctttttaacccctcgccc

SEQ ID NO: 21511 - DNA, 102 bp, Homo sapiens
tgtagaaatttagtggaggcaaatttaagagttaggaaccttccattctgtcaactgtaggggaaggaggaaactaatattgactttgttttgttttttttt

SEQ ID NO: 21512 - DNA, 306 bp, Homo sapiens
catacagtggcaagaatgttgcctcttggagcaatagggaatgaaagaaggccaggacagctggagctgaaggaatgaggggaagtgtggaatagttcctgctttgtagaggtaggcagatacagcagaaaaccacccaaaggatatatgactcttttgtgcaagtgttcatatattctgaagaaaagaggcattaaagtgatagaattgtgaactttgcttggaattctatttatttttattattttttattacaggcagagacttttggagcaggaaggggccacagagagagtaacctcccaa

SEQ ID NO: 21513 - DNA, 413 bp, Homo sapiens
  misc_feature 138: r=a or g
taaaattccttcattggatcatttaatccaacataaattatttccctacacctactttatacttgctccctgatttcataccagtgagtatagcctgatgtaactaaacattctgaattttcagtgatacccagagargagtgtgataaccaattctctcaaaagcgatttactgcagatgttttcatttgcagtaagtccttacttaacattgtggatatgttcttggaaacagtgactttaagccaaacgaggtactgtgtggcttcataactcaactctttttcctatcaattagactatgggaaaactggtttcgtatgcattatgtccttttgcttgaagtggtagtttccaagaacctatcaatgacattaagtgaggacttattgtaatctgatatccgcgggtga

SEQ ID NO: 21514 - DNA, 207 bp, Homo sapiens
  misc_feature 133: r=a or g
aacgcgaggaggaaggagaggaggagcggccagcagtagccacgaccgccaccaccaggcagaggaagagttcgtggggaggaaaagacctctcctcccccttggagcgccttctctctgcttttggagaaargggaatacacgataaagaaggagacggaaagaagagaaaaagtgaggcgggagacagagggaaaagggcgtaag

SEQ ID NO: 21515 - DNA, 204 bp, Homo sapiens
  misc_feature 148: s=g or c
  misc_feature 188: y=c or t
tgttgtttttaacgtatacattatttttattaagtcatttcataaaagataagatatatactaatagacccttggttttctcctaatttaattatttcaagtcaagcaaaattgggcaattttctttcaggaaaaaaaaaatattgascatgattttgaggtaaaactgattatttacagcatctttyctctaataggctaaaa

SEQ ID NO: 21516 - DNA, 106 bp, Homo sapiens
catccacttcccccacgctggcaacaggtagtctatttcttgtctgtatggatttgcttatgctggatgtttccatatccctggaatcctacagtatgtggcctta

SEQ ID NO: 21517 - DNA, 436 bp, Homo sapiens
  misc_feature 329: n=a, g, c or t
agatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagtgnttgaaactacagttgaaatcatggatacatcaacaaatctggatattggagcccagcttatcgtggaagagtgtcccagcacttatagcctaactggcatgccagac

SEQ ID NO: 21518 - DNA, 234 bp, Homo sapiens
agtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggtt

SEQ ID NO: 21519 - DNA, 257 bp, Homo sapiens
gaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccaca

SEQ ID NO: 21520 - DNA, 271 bp, Homo sapiens
aaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgttacaaattgagggagattgagaatattttaaatcaagggcgca

SEQ ID NO: 21521 - DNA, 154 bp, Homo sapiens
gatgtagatgatccggcagccttctccagcttggttcccctctgccatcagctctccaggtgactttccctgtgccctgcactctccccttctgctttcatctccttaagaaagtgcccagaaagttaaacccacacacaaacacacacacccc

SEQ ID NO: 21522 - DNA, 61 bp, Homo sapiens
  misc_feature 58: s=g or c
gagctaggtcctcggagtgggccagagatggcggcggccgacggggctttgccggagsggc

SEQ ID NO: 21523 - DNA, 308 bp, Homo sapiens
  misc_feature 233: n=a, g, c or t
  misc_feature 283: k=g or t
attatataaatactgattacatgaatagtgactaattaggataatgatgacacttctttaggtcctaaagataaggtggtttatttcaactaaagtaatgatttttttttttaaatttttaccagtatgtaattatagttgcagagttactaataattttcaaagattttcaagtatgtcttttgggcagttaggttaagttttgtttttgttgttttgtttctgtgtttaanaagcaacttactatgagacatattctttctcaggaacttcaaagactgtkggcctttaaaattaatcccctcacc

SEQ ID NO: 21524 - DNA, 177 bp, Homo sapiens
ctcagcgaagatggcggcagtggagaagcggcggcaagcggtaccaccgccggccggtttcacggacagcggccgccagtcggaacccgggaggccggggttgcggtgagccgagatcgcgccattgcctgggagacagagccagactctgtctcaaaaaaaaaaaaaaaaaaaaaa

SEQ ID NO: 21525 - DNA, 355 bp, Homo sapiens
  misc_feature 232: y=c or t
ctctctttctttctttctttttttttgataggacctcactctgttgcctaggtgggagtgcagtggtgcaatcacagctcactgcagcctccgcctcgccagctaggtttttggattgtttgcagatatgggttttcaccatgttgcccaggctggtctcaaacttctgggctcaagcaatccacccaccttagactcccaaagtgctgggattacaggcatgagccaccayacccagccacaaatagaaattttccaatttccattatgaatgagaaaaatgaataaaacaagaattataaaattaaatttttcaaacgctaattaaaaatacttgaaaagtttaccagcctaa

SEQ ID NO: 21526 - DNA, 249 bp, Homo sapiens
  misc_feature 98: s=g or c
  misc_feature 175: r=a or g
tttaacttttttttacaataaacatgcataattttatgataaaaattttaactaatttgttaaaaaaactagaagaaaatttacaaaatatgattgtstttaagtaatgggatttggaaagattttttgatgtcttctttcagcttttctatgcttcctaaaattcctataaaaragcacttgtttctttttattggtgggggcgaagtaaatttatttcaatgagttgatgcatttgaaagcgctctc

SEQ ID NO: 21527 - DNA, 208 bp, Homo sapiens
  misc_feature 46: s=g or c
ggtccctgagcggtgtggagagggcggaaggtggactccagcgcasttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggaggccac

SEQ ID NO: 21528 - DNA, 297 bp, Homo sapiens
aatgaagagaaggagggccagtcctggactgttgatgacaagtggtggcttatgtggttgtacatgctggttgtatatgaagaatattacatatctgaaactttgaggtccaaacacaaatagaatctagttcattcctgtgtttaaagtgatgtaatagacagataccggaaatatacaaggagtttgtgattagtcttgtgagcatgaggtttaaaaagattgtaaaagtggcaatagcagaataagcaaatacatgtacaaataaaataaaacaaataaaaatgaagaggacaa

SEQ ID NO: 21529 - DNA, 383 bp, Homo sapiens
  misc_feature 18: n=a, g, c or t
  misc_feature 178: k=g or t
acagacgtgtcgggggtncggggcctgtcgcggttgccaagcgctcggcgcctggcgctggcgctggccaaggcgtgttgcaaacaggaacccgaggtgttcacttcactgttgaaggaacgagagggcatctgctaaagtttcagattccatttctgctcagtatccagtagtggaktatgaatttgatgcagtggtggtaggcgctggaggggccggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcgga

SEQ ID NO: 21530 - DNA, 269 bp, Homo sapiens
  misc_feature 124: y=c or t
  misc_feature 125: y=c or t
  misc_feature 145: m=a or c
  misc_feature 158: w=a or t
  misc_feature 165: y=c or t
  misc_feature 166: d=a or g or t
tcaggttacaatattgaattgtgtctgtctcctctcaaggtctttggtagcctgagatagtgtattctacctactactgaacagagttttaatttcataaattacttggaatgtcatatatttyyataatttctacgatttagamagttctaattaawtacaagydatctcctctttgcatatataaacaaaataattctcagagtagaaatcgaagtgaacattctactgtgtctgtggctgcagttgggggtgttgttgaggataac

SEQ ID NO: 21531 - DNA, 157 bp, Homo sapiens
  misc_feature 129: m=a or c
  misc_feature 144: m=a or c
  misc_feature 145: m=a or c
aactctaactttctataccatagtcacagtattctctcaatgattccaactaaaacaaccctgagtgtccatctgtctcattctatttagaactttcatcaaaccaagaagatgccgtgattgtggagmaaccagaagtgattmmattaacagagga

SEQ ID NO: 21532 - DNA, 306 bp, Homo sapiens
tggaatggaatgtaatggaatcaaattgaacagaattgaatggaatggactggaatggaatgaaatggaatggaattgaatggaatgtaatttactcgaatggaatggaatggactcaaatggaatagaatggaatggaatggagtggactagaatgtaatggaatggaatggatttgaaaggaatagaagggaagggaattgaaaggaatggagtggaatggaatggaatcgaatgagatgaacacgaaagcaatggaatggactcgaacggagggaaaggaatggactcgaatggaccggacat

SEQ ID NO: 21533 - DNA, 104 bp, Homo sapiens
  misc_feature 76: v=a or c or g
gagactgtctgaaagctctgcgatccgaatgtgtgttatatttcactgaaaagaggagagagcgagagtgcatctvcctctctcccaggagtttgagggggggg

SEQ ID NO: 21534 - DNA, 348 bp, Homo sapiens
  misc_feature 308: m=a or c
  misc_feature 309: w=a or t
tacagaagtggaggaacatttggtgatggcaggaaatccagaccagcaggaggacaatgttgatgaacagtaccaggaagaggcagaagaggaggtagtaaggattgaatcccagagactgatcagattggtctgtcacacacactaaccttaaacaaacctcagcagtattgactttgacatgccttccacagaaatgttcagaaaaatttaagcaggataagaaagggtggtttaaagcaaaaatggatcatggcactggagacatttggttagaagataacaaaagcagggtaatagaatccatmwctttggttctcacctgaaattttgaattaagaaggcatg

SEQ ID NO: 21535 - DNA, 157 bp, Homo sapiens
  misc_feature 116: v=a or c or g
tattctacatattctattctttgtgtttttaataaacttaaaactgtatagtattgtttagtggttgacactaatttacagaataacctttaataaaattttatttacagattttvctatttgtattacctagattaaacttaaaacaaggggcgga

SEQ ID NO: 21536 - DNA, 129 bp, Homo sapiens
caactacacatggagtttttaatatttttagtgagttgtgtgtactctgatgacaagaaaaattcaaaatgccatgacaaattggacagacaggccagtatatagtttgggaccagaaaggacatgcct

SEQ ID NO: 21537 - DNA, 166 bp, Homo sapiens
tttccagaaatttctacaggatgtgagaatgtatgatgatgaaaaaatcatcaaactcctccttctgacatctattacttaattggctgtcaagtttagaagaaaagaactttaatattatatgaagaaaagattttacaaactgtaatcaattgtttaggagtct

SEQ ID NO: 21538 - DNA, 109 bp, Homo sapiens
tgtctggtgtgggtgggtcccctttttttgtgtgtggtattttgctagagtaaggtagttatttcctaaaacttatctgtcctgttagttttccttcttaagtacctcc

SEQ ID NO: 21539 - DNA, 173 bp, Homo sapiens
  misc_feature 145: n=a, g, c or t
  misc_feature 164: v=a or c or g
ttcactgtgttagccaggatggtcttgatcttctgacctgaagatccgcccgccttggcctcccaaagtgctgggattacaggcgtgagccaccgcgcctggccttgatcttttctttttatactttcagtaaactgatccaagncttaactgttgtacctgtvtgatgaagc

SEQ ID NO: 21540 - DNA, 202 bp, Homo sapiens
aattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccgcc

SEQ ID NO: 21541 - DNA, 126 bp, Homo sapiens
  misc_feature 45: k=g or t
  misc_feature 47: k=g or t
aattttatttatttatttatttatttatttatttatttatttatktkggtgagatggagatttgctcttgttgcccaggctggagtgcagtggcatgatctcggctcaccgcatcttccgcctctc

SEQ ID NO: 21542 - DNA, 362 bp, Homo sapiens
  misc_feature 127: n=a, g, c or t
  misc_feature 252: m=a or c
  misc_feature 272: w=a or t
  misc_feature 275: n=a, g, c or t
  misc_feature 276: n=a, g, c or t
  misc_feature 314: w=a or t
  misc_feature 317: y=c or t
  misc_feature 318: m=a or c
tgaagaattttgtgataaaagaaaagaaaatagaaaagcgatgcaattttttatgggtggtatttttaacatacttcacatacttgctaaacatgctatttattatatccaaaaacaatgaatgaanagcatgacatcttactatcaccaaaaaataatatttagatatatttttgggggactcaatgatggaaatggccacagtagcaacattggagttcgattttgagaattaaaatgactatgcacccmacatgtgctatttaaaaatwaanngtggggagcagatatatcttcccacaatataattatawtcymtgtgttatttatcacatcttaacagaaatattttgggggagtca

SEQ ID NO: 21543 - DNA, 421 bp, Homo sapiens
  misc_feature 37: r=a or g
  misc_feature 38: w=a or t
  misc_feature 50: s=g or c
  misc_feature 65: k=g or t
  misc_feature 123: v=a or c or g
  misc_feature 141: r=a or g
  misc_feature 150: r=a or g
  misc_feature 171: m=a or c
  misc_feature 179: w=a or t
  misc_feature 180: r=a or g
  misc_feature 220: m=a or c
  misc_feature 298: v=a or c or g
  misc_feature 314: b=c or g or t
  misc_feature 361: w=a or t
  misc_feature 362: r=a or g
  misc_feature 372: m=a or c
atccgaggacggaggctgtcgttatacaacgcgcaarwgtggtctctgtsacagatgtggctgtkgcagagagtgctgcctcctctcccgtttccagcagatgcttgggaaccttcagaagtvttggggattttctcccarcaacgtagrccatgccaccacgagtgaatmcttaacgwrgaccagcacgggcacctcagatgccaggaccggcgtgatmctgcaggacgctggcatcggattcatcctggtgatagaccggcgacgggacaaatggacctccgtgaaggcgtacgtvctgcgcatcgcaaatbagaggccccatatctgctccgatgcccacaaccttcatcgttttggwrcaagcctgtmcctgagccgtggttctcatcgaagtctttaggatgaagcatctccttgc

SEQ ID NO: 21544 - DNA, 111 bp, Homo sapiens
agatgtttccaagcttgatcataagaatagtatttcctgctggcgtgattgtgtgtgtgtgaatattttggattagttttcaaaacattttacatttgatgagacccaaaa

SEQ ID NO: 21545 - DNA, 442 bp, Homo sapiens
  misc_feature 64: m=a or c
  misc_feature 314: k=g or t
  misc_feature 413: y=c or t
  misc_feature 414: y=c or t
tactaagttttgaaattgggaaatgtgagtcctcccactttagcttttccaagattgttctggmtattttggatcccttaaaattccatatgaatattagaatcaacttgtcaattcctacaaagaagtcagttgaatcaatttcatagggattcattgaatctgtagatcaatttggggagcgctgccatcttaaaagtattaaatttctgatttatgaacatgagatgattttctattaatttagatcttccttaatttctttcaacaacattttggagatttcacagtataaatttggcacatcttttgtkaaatttatttctaagcattttgttcttttttgtgtcatggggttattttcttaattgttaggttattaattccaagtgtatagaaatatgattgatttyygtatattggtcttatatcttgccacctc

SEQ ID NO: 21546 - DNA, 174 bp, Homo sapiens
aaaattaaataacaccacgggagaggagagagggagggggaggagggaggaagggacaagagagaagagagactgaaacagggagaagaggcaggagaggaggaggtggggagagcacgaagctggaggccgacactgagggagggcgggaggaggtgaagaaggagagaggag

SEQ ID NO: 21547 - DNA, 236 bp, Homo sapiens
acaccgcagccggacgggaacgatgccgccgtgtttggtgtgagagcttcacagtggagtgtggcccccacggccttgtgcccccgcgatgccgtagaactattgtcgagtgatgcgatgaaagaatataacagggctcgagtctacctggatgaaaactacaaatcccaggagcacttcacggcactaggaagcttttattttcttcatgagtccttaaaaaacatctaccagta

SEQ ID NO: 21548 - DNA, 478 bp, Homo sapiens
acttacggtaaaggatattctagagttgaatcgtgggatagaatcgactgaaaaggtaggtggaggtaaatgaggccaaggccatctgcccttccttttccagctgcctgtagtgatggtacccatgaatcaaaaacagtacattatcatttaccagaaaggtgaaaaatgccttgctggaggttaaaagaagtacaatcaactatatttctaaatggctacagattttgagacagccatgaaaaagtcacaaacatgtctcatgattgggattttcaaattacttttaaagtggtggaaaattaaaagaaaatgttcaattttagatgaaagaatggaaaaggtcatttctctgtgggatttaataggaagtcttatacgtgctttctctggcacctgtgaagactggtgaagattagttatagcttcaaaacacttgatccgttttatttgcagtacagatattatgagggattca

SEQ ID NO: 21549 - DNA, 386 bp, Homo sapiens
  misc_feature 283: d=a or g or t
  misc_feature 284: v=a or c or g
atttttttcgagaaccttccattacactcccttccattccagtgcattccattccagtctcttcagttcgattccattccattcgtttcgattcctttccattccaacccattccattccattctattcctttcctttccgtttcattagattccattgcattcgattccattcaattcaattccgtgctattcaatttgattcatttccatttaattccattccattggattccattccgtacgattccattccttttgaatccattccattggagtccatdvacttccagaacattccattccagtcgaatccattcgagtacattccattaaagttcattacattctaatacattccattccattgcattccattccatccct

SEQ ID NO: 21550 - DNA, 433 bp, Homo sapiens
  misc_feature 385: w=a or t
tttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtgccttttcttwctttttttcttttcttttttgaagcggagttttgctctagagtgcaat

SEQ ID NO: 21551 - DNA, 288 bp, Homo sapiens
  misc_feature 181: s=g or c
  misc_feature 221: r=a or g
  misc_feature 222: n=a, g, c or t
agaatttctgcctggcattattccatcgacattaaaaagacaaactatgtggtctttctgatggaacgatagaggaagagtaggcttcctgaatgaggaaagcaagctaacatggtaggccaggcacagtggctcatgcctgtaattccagcactttgggaggccaagatggtaggatcgsttgagcccaggagttcaagaccagcctgggcaacgtagtrngaccctctctctaaggggaaaaaaaatggtgaagagggagaaagaaccaaaagtaaataccatgcc

SEQ ID NO: 21552 - DNA, 260 bp, Homo sapiens
  misc_feature 178: r=a or g
  misc_feature 193: k=g or t
  misc_feature 199: y=c or t
  misc_feature 206: r=a or g
  misc_feature 242: y=c or t
aacatagactgtgctcatgtcagggacttgcagtgtgaaagacctcatggggacttttgaagaaccattacctgatcctcatgagagatatacatttaagtgaatactacagaaaaaaaaaagcactggaagccagccatggatagcaaagataaagcttcataagaggagaaactargaaaatattattttkgatttyctacatrgacaattatacctctgtgaacaaagacagtttattycttccttcccaagacccg

SEQ ID NO: 21553 - DNA, 184 bp, Homo sapiens
ggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagc

SEQ ID NO: 21554 - DNA, 281 bp, Homo sapiens
  misc_feature 249: h=a or c or t
  misc_feature 250: k=g or t
atgtttgttccctccaaatctcatgttgaaatgtgatcctcagtgttggaggcggggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcachktccaccatgagtggaaacttcctgcagtcca

SEQ ID NO: 21555 - DNA, 181 bp, Homo sapiens
taccttcttataggctgggtggggtggctcacgcctgtgataccagggctttggggggccgaggtgggtggatcgcggggtcagaggttcgagaccggcctggctaagttggtgaaaccccatctctactaaaaatgcagaagttagcggggtgcggtggcgggcgcttgtagtcccagct

SEQ ID NO: 21556 - DNA, 427 bp, Homo sapiens
  misc_feature 385: k=g or t
  misc_feature 415: w=a or t
cctatattgctcattatgaaattaacttatgacaaatctttgttcattttacatttttctaaagactgttagcttgcattcatttggcttgaagtttctatagactaggccacagttattttttctttctcttgatttttcagatatgaatttgaattgattcattacttttcagccattatgttagatgcattccaaacagtgccctgcagggctatccagaaggagttttggtaaaaggagtgagtagttattgaaagctctattcctttatatgttataaaacaaaatggatttgctaaagccttccatctgttcctttatcattctttgcattaaaaaaaaaagcttttagaagatgcagacccagtctgaatcttttatkgttcccatttcaactgacataaacaaaatwattcagcgaata

SEQ ID NO: 21557 - DNA, 282 bp, Homo sapiens
aataaaagtataacctccatggcagaacatagaggttttattttcctagtgtataggttgaattgtgtccctcaaaataatgtgttgatatcctgactcctaggacctcagaatatgaccttatttcaaaatatggctgttgcagctatatttaattaatatgagtttatactggtgtagggtgggccctttaatcctatatgtctggtgttcttataaagaaaggagagacagatacagagaaatgaaggcagaggcaggaattgggattatgctgctact

SEQ ID NO: 21558 - DNA, 498 bp, Homo sapiens
  misc_feature 462: y=c or t
  misc_feature 463: w=a or t
aaagaaaacatttatctgtagctgtcattttcatatacacatatctagtgtatacaagttagtaagtacataattctcaaaagttctacctgtctacacatctacacagaaaaattaggaaagtcttgtccagacttttccatcatcttcagtataaagcatcttctagctattggaatagaaacaagctagattcttgactcctttctatttgattatttagatctgaccttcagacgacatccagaatctgagaacacgcaccacctctactgctctcatcctggtccaagtcattgtcatctcccacctggattaatgccagagcccccttcctggtcttctcacttctagtcttgaccccctagggcaagaataattagcttagaaaaccaccccagagccttccagcattactctgagtactggccagagttggacaatgtttaaggccccgtgcgywtaaagctgtccctgtcctgtcctggctgtcactca

SEQ ID NO: 21559 - DNA, 459 bp, Homo sapiens
attgagtggagagtgcagcaagtgcaggtcgtcctccggtgtcagagccgtgatttgtagacaatgccgccctgtcagctcagtgctggttcagcagcatctttccaaacatgtatttggcaagaatttaaaggccacctcttgtgtaatttgtggagtcttggaaaaggagcctctgcctttcttttcagaatgtacgcaaccatgcagaattttgtactcagaatctgtgtctcctgccttctgcctgacgtgctcatgaggaagtttgtttccatgcccgtcacctggaaggatgctaacagttctctgtaatctgttggggatatggagagggccacccagagctgtgttttgtttctgccgtcttcataaattagcactgatggggtggagtaggttgtactgcatgaggaaatgcaggcattttgttcattagtgagatacttctagctttta

SEQ ID NO: 21560 - DNA, 236 bp, Homo sapiens
cccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaac

SEQ ID NO: 21561 - DNA, 261 bp, Homo sapiens
tttgaggacaagtactctcgtaaacagagctgatgataactataaaatctgacctagaaatttgactaatgcaaaaggttgagtctctgtatattattagaacagctttgcaagtagcattattgacatgctataatcttagagctttgtacctttgcatgggaaccctcaaggtggaggagaaaggatcacaaagcatggtgaggggagctatgagatgacctatgtcctttctatgttcaacatgtgaccgaagctata

SEQ ID NO: 21562 - DNA, 311 bp, Homo sapiens
gaatcctctctgtaccatgtaagatcctgcagacaaataacatctagtctgttgttctaaatgtctgagactagtgaacttttattcagttcaagtttctgttgaggcccaacaggcaaagctctgttctagtgactctgagggaaacttggtgatagtagccagtacccgctctgaggggcttcaagaggagtctgctcctaatagaacctgtgctatctataagtgacagcatcaagagcagggagtaggggccgtgcatggtggctcactcctgtaatcccagccctttggtaggctgaggcgggcat

SEQ ID NO: 21563 - DNA, 345 bp, Homo sapiens
  misc_feature 248: d=a or g or t
ttcagcataatataaggcacattatgcataaattttaaaatgatggattttaattacacatgctggtaatactttggagaaacgataaatcctcaaggacttgcataaggacataaagcggattttctgattgtgcagttaatgtttattagcctaatctgattattttgagacttaacacatcaggacaaccttcgttatttcaaaatattgtccctctgggaatatatgcactttttgtttataadgtttctcttaaatatttttgtcatttttgtcatgtcacggaacctaatttcctaaatttttgtaattctaagatgaagtcttgaaagttcactggga

SEQ ID NO: 21564 - DNA, 344 bp, Homo sapiens
taacaaggagatgaaagatttttgcacataaaactagaaaacattgataaaggaactgaagacacaaataaatgaaaagatctcatgttcataggtaagaagaattactattgtaaaaatgcccatgctatccaaagtgatctatagattcagtgaaatccctatccaaattccaatggtatttttcacagaattagaacaaacaaccctaaaatttacatggagccacagaagaccctgaatggccaaaacaaccttgagcaagaaatacaaagccagaggccttggacatcttgatttcaaaatatgctacaaagctatagtaaccaaaacagcacagtatt

SEQ ID NO: 21565 - DNA, 109 bp, Homo sapiens
gagctcacctacaaggtgcccacccggcacagcatgagccagatcccccccgtcctcacccctttaaggcttgacttcaatttcggggccgcaccattcaaggcccact

SEQ ID NO: 21566 - DNA, 224 bp, Homo sapiens
attctgtcatttgtcaaaaagaaaagtttaaatacatgtatattattctatgtcatagaagcttttattatgattgattccttctgaagcagtatactgtgcagatgctttattcatgagttgttatttctgcaaaaactctgtgggttcctatttcattttcctcagctgaatatgccatgatttttttttgttgttgttaaatttatccttatacaggcaaa

SEQ ID NO: 21567 - DNA, 202 bp, Homo sapiens
caatatattttctacaattcatctctgatagaggagaaagttgttttgtgagggaaagccttggggaattacttgtgttctagataaaagtgtcatttaagaatttattatggaaaatttcaaacaatcaagagagtggatagaatgaactgacttgtaccttacttatcttcaataattatcaatattttgcccatcttgc

SEQ ID NO: 21568 - DNA, 153 bp, Homo sapiens
  misc_feature 149: d=a or g or t
  misc_feature 150: s=g or c
tcacccaggctggaatgcagtggcatgatcttggctcactgcaacctccgcctcccgagttcaagagattcttctgcctcagcctcccaagtagctgggactaaaggtgcgtgccaccacgcctggctaatttttgtatttttagtaadsaca

SEQ ID NO: 21569 - DNA, 197 bp, Homo sapiens
actttctagctagtgtttgtgttcaagtagtcacattctgcctcactgaaggaaacagtcttcctgtgtacacctgttcatagtttgttattgaaacaatgtatactgtaacttttttttcaaaaagaatttttagtgattatttctctgtcagcatggagctgatctattaggaaatcagttgtgtggtggggtat

SEQ ID NO: 21570 - DNA, 165 bp, Homo sapiens
  misc_feature 80: s=g or c
  misc_feature 146: r=a or g
ggatgtgagggcgatctggctgcgacatctgtcaccccattgatcgccagggttgattcggctgatctggctggctaggsgggtgtccccttcctccctcaccgctccatgtgcgtccctcccgaagctgcgcgctcggtcgaagrggacgaccatccccgatat

SEQ ID NO: 21571 - DNA, 254 bp, Homo sapiens
ccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatct

SEQ ID NO: 21572 - DNA, 346 bp, Homo sapiens
  misc_feature 86: s=g or c
  misc_feature 279: w=a or t
  misc_feature 280: w=a or t
  misc_feature 281: r=a or g
  misc_feature 345: m=a or c
cacttcacgaagtagccacggggggacagctcatcccatttttggataaggaatttaggcacagggcgcacagtgcggtgcggtascaggtacggcccagcctgccagaccccgacactcacactgggcccccgttgcccttgagctttaccccacagtgttcgtgtagcctctccagggtggagttactcttcctcaacatgggaaggccccagtgctgcagggaacagctgaggcttctctggcttcagcatccagcggggctcctgagctatagcwwrtgtggctcatttgcaccctggtccttaagagagaagtcctgaagacagagcttacatacgccamc

SEQ ID NO: 21573 - DNA, 68 bp, Homo sapiens
aaagagccctccctcaggttgtgtgtgtgtgtgtgtgtgtctctgtgtgtgtgtgtgtgtgtgtgtgt

SEQ ID NO: 21574 - DNA, 112 bp, Homo sapiens
cacatagttttagcaaattggaaataatatattcatttgtatggcaagataaatgcagtcatcttaatactagtctatacatttttgccaaatggcgcaaatatacctccac

SEQ ID NO: 21575 - DNA, 284 bp, Homo sapiens
cattatttgtgatgtcatggagaaaaaaatgaggtaaggatttctgattatctcaggtttgaggttttgaagagattgaataatgattttggggtacagcttgtgtctaaatgtatttacattttcaaaggaccagaatatccatagattaaacttaagggcataatggccatatttgttaaaaagctaaaaacaaaattaccagtttatcctaaacttaactaaaggtgctctaaatacacagaaatcatcattttgccaagtcaactgcattctactatttt

SEQ ID NO: 21576 - DNA, 262 bp, Homo sapiens
ctctgacatgcactaggtatgtgcagatcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggagaggaagcgttcaccgccgct

SEQ ID NO: 21577 - DNA, 324 bp, Homo sapiens
  misc_feature 2: n=a, g, c or t
  misc_feature 3: n=a, g, c or t
  misc_feature 7: n=a, g, c or t
  misc_feature 8: n=a, g, c or t
  misc_feature 119: v=a or c or g
  misc_feature 159: n=a, g, c or t
  misc_feature 160: d=a or g or t
  misc_feature 290: k=g or t
cnncaanngacttttaactccaaagaaagaatacatagttttaaatgactaatgtgtgaaatattgagaacaatacatgattatagctaatccctcacactgcctaacaatcagttgtvaacgagtgagcagagagaagtatcttcagttaggcacagndagatcggtggttgtttattcactgaatgagacctgctatgcctgtttgtgcaaagaattttactttccagaataggcacagatcttgattccagtccagtggcattaattaacgtgagtccatctatgtktatcaagatgttcacaccccagagttttttcttc

SEQ ID NO: 21578 - DNA, 415 bp, Homo sapiens
  misc_feature 240: b=c or g or t
  misc_feature 241: b=c or g or t
  misc_feature 290: n=a, g, c or t
  misc_feature 291: n=a, g, c or t
  misc_feature 292: m=a or c
ctgcgtcacctgcaggcccgggccgcggggttggtttccaccctggaggttgctgacaccctgtgccctcggctgacttccagccggtggcacagacgcctccagggggcagcactcaagcgcatcttaggaatgacagagttgcgtccctctcggttgccaggctggagttcagtggcatgttcatagctcactgaagcctcaaattcctgggttcaagtgaccctcctacctcagccbbatgaggacctgggactacagtaacagcgggaacatgaagccgccactcnnmggtgtttattgtgtgtctgctgtggttgaaagacagtcactgcgcacccacttggaaggacaaaactgctatcagtgaaaacctgaagagtttttctgaggtgggggagatagatgcagatga

SEQ ID NO: 21579 - DNA, 121 bp, Homo sapiens
acctttaaaagtctctctgagggaggctcctctacataaccaggccacttttgctggccaaacctcttccctgctctgctttaccagaatctaagcccccattctttctataaccccaaaa

SEQ ID NO: 21580 - DNA, 364 bp, Homo sapiens
  misc_feature 89: b=c or g or t
  misc_feature 90: h=a or c or t
tattaataggatgtgtgccctatgtcagacagtgtgctaagcatattaactatattatctcatttaatcatcacaacaatctgctggtbhggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagcta

SEQ ID NO: 21581 - DNA, 201 bp, Homo sapiens
  misc_feature 123: m=a or c
agatcgacccatctgagcaaaagactctggccaatctaccgtggattgtggagccgggccaagaagccaagaggggcattaataccaagtatgaaaccacgattttctgatactcgccgtccmtcctgtcctcgcggtgccttgctcgccaagcggtcccggagcaggctttccttcgcgcctccgcgtccacccaggccc

SEQ ID NO: 21582 - DNA, 285 bp, Homo sapiens
aagtgtaatatagttattgtcctttagcttggctcccccacccccacttagtaatggatttaagtgctgtccatgtaagtgcagagaagctcatcaatttggttagtgagtgtgatgatatcgccctctttaaatcccaactccccttcattttcaggttcaaagtcgtacagagctcggcagcagggctgatccatttggacacctgaaggtttgggagtgcctgtgcgggagagacccccattgggctgagtactgtctccagttggaaactccaggctcatt

SEQ ID NO: 21583 - DNA, 343 bp, Homo sapiens
  misc_feature 120: h=a or c or t
agcaatttcaagccatccgcccaggaagcgccgcaaccgggactcgggaggggtggagggggcgaggcagaggccgcggccccaggggatccttggccccactgtgcaccacacactcchtttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtaagaagaggcccagaagtcaagggccagactgtgaaggtgattagaggtcaaagaggtaaggaggtcc

SEQ ID NO: 21584 - DNA, 413 bp, Homo sapiens
  misc_feature 116: r=a or g
  misc_feature 128: m=a or c
tcatcctcccaagtagctgggactacaggtgcacactacaacacccagataatttttgtattttttgtagagatggggttttaccatgttgcccagactggtcttgaacacctgarctcaaagctatmtgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtct

SEQ ID NO: 21585 - DNA, 319 bp, Homo sapiens
ttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagcgta

SEQ ID NO: 21586 - DNA, 117 bp, Homo sapiens
aaccaggagtttggcgtgaccatggtgagagaagacggtccaagaagggacgttatcaggccactttttgggtggagaaggaggggaagcaaaagaaaacaaggaagtatgcgaccc

SEQ ID NO: 21587 - DNA, 467 bp, Homo sapiens
  misc_feature 121: w=a or t
  misc_feature 124: y=c or t
  misc_feature 219: d=a or g or t
  misc_feature 431: h=a or c or t
aagtcatagacatgcttcagtgagaggatgaggatttgcccagatgggaagcttcaagtgcagaggcacttgtacatctacttatcttgagtctcaatgatgctgtttatgagtgaagctwatycaaatggaggaagaaacccacggagaaggagaaataacaggtcggagtgattatgtacagaaggataggctctagcaggagtccagtgggaaagdaggaagggaatacaattaagaattattaatggcagatctctaatgatttcactggatccaaaggaacagggcaatactgagtaagaaacacttgatatacgaaaaaagcgtgagtgcgaaggaaaatacatcattctacagatgttgacggactctgacggtgggaaagcgtccctcaagattgaattggagtagaagctgaccctcccachtgcccagagatcccctagctggatacgatttcagca

SEQ ID NO: 21588 - DNA, 269 bp, Homo sapiens
cactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaa

SEQ ID NO: 21589 - DNA, 465 bp, Homo sapiens
  misc_feature 271: k=g or t
gacagatattcaaagatggaatgaaagaggtttggtgactggatataagcaacgaaacaggaagaattgaatttgggtctgatatttcctggatgcaagatcaggaggatgttggcaccatggcttagtggggaaactggggaccgattctggaggtataccagcatggtgagtttggttttagatgggttgtgtttgacatagggctagcaattctaagtgaagatgtctaaagaaagatagaagtgactcagctctgaagttctgaaakgatcagccgtcagcgtggcatgaggaagacctaggaacagacagactggggagaagacacagagccaagcaggacctggcctgcagcccaaaccctgtggaatccctacattcaaggaccaggttgaagtgaagccattgacaggaactgagatgcagtagtgatactccctggcctctgagagctgcagtcca

SEQ ID NO: 21590 - DNA, 264 bp, Homo sapiens
  misc_feature 223: m=a or c
atgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcamtgattttgagtttatctctgatcacttgtagaacgggtacc

SEQ ID NO: 21591 - DNA, 164 bp, Homo sapiens
tcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccaa

SEQ ID NO: 21592 - DNA, 296 bp, Homo sapiens
  misc_feature 278: m=a or c
cccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccmgaatgcaccatgacccct

SEQ ID NO: 21593 - DNA, 325 bp, Homo sapiens
  misc_feature 314: n=a, g, c or t
  misc_feature 315: n=a, g, c or t
agtgaatgtgagtcattgtcatcccaattgtcagcctgattcttgtgctctgtttatatcttggggtaaagacttcaagcttctggccaggttacagcccgggaacttcatctcagatcacataccactgaatcctaagtgcataaaataatgtgtgccatgtagtaaatattactacattaatccttaactactcgaaatgcaatttcctcactacttatggccacagcctgcatctagtcttcatccagacaactcaaacaataaaaatcttcaagtctgatattctcctcaagatgacctcttgtcagttnntttcctaatg

SEQ ID NO: 21594 - DNA, 457 bp, Homo sapiens
  misc_feature 7: h=a or c or t
  misc_feature 179: n=a, g, c or t
  misc_feature 180: h=a or c or t
  misc_feature 310: b=c or g or t
  misc_feature 313: n=a, g, c or t
  misc_feature 316: k=g or t
  misc_feature 328: k=g or t
  misc_feature 333: d=a or g or t
  misc_feature 360: r=a or g
  misc_feature 361: r=a or g
  misc_feature 406: h=a or c or t
  misc_feature 407: n=a, g, c or t
ctaccchcttgtaatttatttcccatcctatcttatttattaatatttctcactttaagatcttacttcatatttacagcaggacaaaagtccagacactgagcttggcatttgacacctttaatgtgatactaccaacctcccatcttttttttacactagccaaagttggtcaatanhactctccacgtctttgactgtaacttgcttatttctgcttttgcttcattttcagcctttgtttcttttcccatctttataaatcctattttgtaaatctcatgaacttctttcttaacgttctctaagbaangckcttattttatgkatgtdttatctataatcacgttacctgcctgrrttgtatagcttttcttgtaatcctcatataggataatacctgcghntttaacaaagcccagatttcagtagcttagcattctagtttctcattcat

SEQ ID NO: 21595 - DNA, 271 bp, Homo sapiens
ctttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaatt

SEQ ID NO: 21596 - DNA, 249 bp, Homo sapiens
agttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacca

SEQ ID NO: 21597 - DNA, 378 bp, Homo sapiens
  misc_feature 7: s=g or c
  misc_feature 205: w=a or t
  misc_feature 206: m=a or c
  misc_feature 292: n=a, g, c or t
  misc_feature 293: k=g or t
  misc_feature 294: m=a or c
  misc_feature 296: m=a or c
tagtaasttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgwmaggcataaaaaggttaaaaaagaaaatccgagagtcccaattccctgtataacagcattaaaataatctgcctggaaagatgagankmamtgttgcacaacccaaaatgtgtctttaatttgtgaaaaattaccatggtgagtcagacagtcattttaaacagctgaacaga

SEQ ID NO: 21598 - DNA, 323 bp, Homo sapiens
agcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaaccccca

SEQ ID NO: 21599 - DNA, 283 bp, Homo sapiens
  misc_feature 178: n=a, g, c or t
  misc_feature 179: n=a, g, c or t
  misc_feature 214: r=a or g
atttattttaccttttttagaaaatgaaaatcattacacttaaattcaatgtatattatatagagaacataactgatttataaccatgtaaaatatcttgtcttactaacaaaacgttcagtttttccttctttgtgaaaccttgagtcaaaatgtactagtgaggatgtttatattnnagtggtgtagctgaaccagacaggtctgcagcgcrgtggtttatttttagacctgcgttgccatttttatcctgcaaaaatattcatcagtgtcttgctgactt

SEQ ID NO: 21600 - DNA, 84 bp, Homo sapiens
gtaattgtgtgtctaaaaaattgctttttgcattccccaatagcatgacaactggaatagtaatttgacttaaaaaaaaaaaga

SEQ ID NO: 21601 - DNA, 238 bp, Homo sapiens
  misc_feature 137: b=c or g or t
  misc_feature 138: v=a or c or g
aaaactttatgcctaggagagcaaacataatgcagcatgcagggtctctggactgtaagaaggccatttggctggagtctatagcgtaactgtctttcagctttgagcaagtctctgaacctctcttgggcctcggbvacataatttgtaaaatgagggaatttggaattgatgatgtctgcagtactttatagtgcttaaaatgagttatttgataaatatgaggcattggatagtt

SEQ ID NO: 21602 - DNA, 232 bp, Homo sapiens
aaatcattctactataaagacacaagcacacatatgtttattgcagcactgtttacaatagcaaagacatggaaccaacccaaatgcccattgatgatagactggataaagaaaatgtggtacatatacaccatggaatgctatgcaaccataaaaaagaaggagctcatgcaggaatatagatgaagctgggggccattactttagcaaactaatacaggaacagcaaacg

SEQ ID NO: 21603 - DNA, 67 bp, Homo sapiens
  misc_feature 22: r=a or g
  misc_feature 39: m=a or c
  misc_feature 46: w=a or t
aatgaagatcaatatgattcaratgatgaaaaacaaaamtgtatgwcctttgagttcccaaaccaaa

SEQ ID NO: 21604 - DNA, 148 bp, Homo sapiens
tgggggcttgaagattggtgtttgttgaaggtctgttgctttcaaaagtatatatgtggtgacataaacgtatatatatacattttacgacaaatattctaacgtgtattacatgaaatgtaattacatgttctaacatgaaagaggt

SEQ ID NO: 21605 - DNA, 161 bp, Homo sapiens
aattagtaaaacccacactaaacactactgcaaaagctaaaaataaatgtaaaaaagagaaaggaaacagaagactctattgggatggaatgagaacagcatctttcatccacccatgcatacccacacacaggtaattatgatgtaactccccgggaacc

SEQ ID NO: 21606 - DNA, 61 bp, Homo sapiens
aaaataaatacatcctcatccttaattaatgaatggatgcaagtatagaaacaggtagcta

SEQ ID NO: 21607 - DNA, 343 bp, Homo sapiens
  misc_feature 13: s=g or c
atagcgcacagcscgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattctttttggtacactttgtataactgaatcctttaaaatgtattgagatttgttttatggtacagaatatggtctatctaggtaaatattatttgtgcatttgaaaggaacgtatgtccgctgttgttggatttattattattatttgagacggagttttgctcttgttgctcgggctgt

SEQ ID NO: 21608 - DNA, 134 bp, Homo sapiens
  misc_feature 105: m=a or c
  misc_feature 129: r=a or g
gatgctgagtgcttttcagtgaggagtcagggaggtgtgtgtgagagagagagagaaaagagagagacagagacggggagagagagagggagagagaagagaggmaggagggaagaagaaaagacggargggga

SEQ ID NO: 21609 - DNA, 189 bp, Homo sapiens
ccttaaatgaagacatgtcattccagtcaaagacttggtaaaacaaccagtttctcccattgccctgttgcaaaagaaagcattcttattgcacttatgcaaataactatattgccataagttaagaatactcacaaattggctgggtgcagtggctcacgcctgtaatcccggcactttgagaggcca

SEQ ID NO: 21610 - DNA, 232 bp, Homo sapiens
aaaaacctccctggaaacacacaccggagtggagaggattccgactcagagactgcgcaaagcgacacggaaacccaggcaggctgaagcctcgaagtattcagccaatggagatgggatacctacagccatttggctttgattccctccatgcttcttggtgcttccatgcatacttcccctgggatgctcttcttttggtttcaaaagctgcttacaacgtgagagttgc

SEQ ID NO: 21611 - DNA, 120 bp, Homo sapiens
  misc_feature 4: r=a or g
  misc_feature 41: d=a or g or t
agarctcgtcatgctctttgtagcgtggtgcttctgttgcdtcacagagtctcgctctggccagagattttctaaataatggtcaggaatctgcattgtaagtcttactctttgaggtgc

SEQ ID NO: 21612 - DNA, 178 bp, Homo sapiens
tttatggggtattccttctcttcactccatttttggtaacaatttcctcgtcggtaaaatggataatagctgtctgaggttttgtggattaagtgaaagtacattatttagtgtaatgcctaatgttagtcctctttatagcatattttatacaatttctattatttaacaggcctca

SEQ ID NO: 21613 - DNA, 213 bp, Homo sapiens
atagaactgcaaggagaaaaagatgtatctactattataattggagacttcaacaattctctatcagaaatggacaggtcaagaaggcagaacatcagtaagcacacagttgaatgcaacaacactattgaacagctaaatatagttaacttctataaactacttcatccaacaacaacagattacacattcttctcaagctcatatggaacc

SEQ ID NO: 21614 - DNA, 225 bp, Homo sapiens
ttaaaatacagtaaaattaacttttaaaattggtgtatagttctataaatttgaacacatgtgattcatgtaaccaacaccaaaatcaggatacagaacagttccgtcaccctgaataactccctcatgctacctttttgtagttacaatctctcctcatccctaacctcagcaaccactgatttgttctctgccattatacttttttccatttgagactgtccg

SEQ ID NO: 21615 - DNA, 140 bp, Homo sapiens
  misc_feature 138: s=g or c
  misc_feature 139: r=a or g
taactctttgctgtacctggggaggagccccagtcttggctttgctcataactatccacatcatgctcaccactcttcctctgatccagcctggtggagtctgtgcattggcttttgtcctcaatggggccagccgcsra

SEQ ID NO: 21616 - DNA, 102 bp, Homo sapiens
tttcttaccaaaggagtcttcagccctataaaaggattcctctatagtgtatttctctagtgtatttagtgtgtcgtcaaaattttgatttatacagagcac

SEQ ID NO: 21617 - DNA, 483 bp, Homo sapiens
  misc_feature 115: r=a or g
  misc_feature 185: s=g or c
  misc_feature 186: w=a or t
  misc_feature 187: m=a or c
  misc_feature 327: n=a, g, c or t
  misc_feature 328: b=c or g or t
ttgagtcagcagcggccggcgaggaagttacccagtctcctcctggacccgacggaggagacggttcgccgtcggtgccgagaccccatcaacgtggagggcctgctgccatcaraaataaggattaatttagaagataatgtacaatatgtgtccatgagaaaagctctaaaagtgaagagacswmgttttgatgtatcgctggtttatttaactcgaaaatttatggatcttgtcagatctgctcccgggggtattcttgacttaaacaaggttgcaacgaaactgggagtccgaaagcggagagtgtatgacatcaccatgtcnbagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaatta

SEQ ID NO: 21618 - DNA, 344 bp, Homo sapiens
  misc_feature 223: d=a or g or t
  misc_feature 224: d=a or g or t
  misc_feature 225: n=a, g, c or t
  misc_feature 265: k=g or t
  misc_feature 271: y=c or t
  misc_feature 275: y=c or t
  misc_feature 288: y=c or t
  misc_feature 293: k=g or t
  misc_feature 298: y=c or t
  misc_feature 326: d=a or g or t
  misc_feature 329: w=a or t
ttaatttccatgtatttgtataattttgagagttccttttaaaggtgatttctagctttattctcctgtgatctgagaagttgatatgattgtgattattttaaatttattaagaattgttctgtggcctaccatatggtttatcttggagaatgtttcatgagctgatgagaagactatattctgtgttttttggatagaatgttctgtaaatatctgttaddncagtttgttctagagtatagcttaagtccatttttttttkgtcttyctgycttgatgatttayctagkgctgycagtgccacgttgaagtccccccgcatdacwatgttgctacccacc

SEQ ID NO: 21619 - DNA, 432 bp, Homo sapiens
  misc_feature 84: m=a or c
  misc_feature 340: r=a or g
  misc_feature 363: n=a, g, c or t
  misc_feature 364: k=g or t
  misc_feature 365: m=a or c
  misc_feature 366: n=a, g, c or t
acgatggagttgccctgtcagtgcaggtggaggccccggcggggcaaagtggcaggaacctcttaaagggcgagagcggcgcgmaccagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaaaacaaggagcggacatcagaragcagaggactttcacgactatnkmnatcgtttctcaaaaggcccaaatctcaggtgtccgaggaagaaggcaaagaagtagagtcagatta

SEQ ID NO: 21620 - DNA, 175 bp, Homo sapiens
tttttgtttttcgatctaaggatatccaattgcttcaacaccatttattgaaaaggctattcttcctccattgaattacttttataccttggtcaaaaatcagttgattgtacttggatgggtctattttgaggttctttattctgttcgatctatatgttttttcctccaccgt

SEQ ID NO: 21621 - DNA, 395 bp, Homo sapiens
  misc_feature 116: k=g or t
  misc_feature 122: w=a or t
  misc_feature 124: k=g or t
  misc_feature 208: r=a or g
  misc_feature 310: n=a, g, c or t
  misc_feature 311: s=g or c
  misc_feature 312: k=g or t
  misc_feature 349: v=a or c or g
  misc_feature 350: n=a, g, c or t
  misc_feature 351: n=a, g, c or t
tacctgttgaccccagaatttgttagattttttaaaaaacaatttctaaatagtttctgtttgaaactagttgcgtccagttcagatcaaggtctgcatgctttctagtctttatkatttawtkggaaaacttcggtacctaatacaaaagtttgattgtttcagtgtgtacctggtaaagaatcagtgaccttttaccttaacatcraaatgtagtttaaccagttaatgtatttttcagttttctttccttatgtcatctgtgaacatcttgagctgtgagctattaagtgcatgcttccctcaaggnskctggtccattctggactaatgttgaaagatgggatgvnngggcatggaactgttggggtgatcagacccaacaccgggctgtg

SEQ ID NO: 21622 - DNA, 358 bp, Homo sapiens
  misc_feature 344: w=a or t
  misc_feature 345: s=g or c
  misc_feature 346: k=g or t
  misc_feature 358: n=a, g, c or t
aactgtgcttggaaacttggggagttaccacgtctggctaaagtggtattgtcttaaggaaaacctatgaatttgcctgcgttggcttggtgctgaggaaagtggaagagagaggctggggtacacctttcaacatgaatggaactgaccactggagggaaagaacaagaaacagcagtgagaacaaggaacaaagaccatccagcccatcacccacctggggggaagtgaggggagatgggcagggtgacaacgtggccaacatctaaagtgtgaagaggggcttttaccaagtgcccaccccttcccgagcagggggcaaccaacagcatctggcgggtctwskactgggctgcgn

SEQ ID NO: 21623 - DNA, 260 bp, Homo sapiens
  misc_feature 7: y=c or t
  misc_feature 158: n=a, g, c or t
ttaattyccatgtatttgtataattttgagagttccttttaaaggtgatttctagctttattctcctgtgatctgagaagttgatatgattgtgattattttaaatttattaagaattgttctgtggcctaccatatggtttatcttggagaatgttncatgagctgatgagaagactatattctgtgttttttggatagaatgttctgtaaatatctgttaggtcagtttgttctagagtatagcttaagtccattttt

SEQ ID NO: 21624 - DNA, 133 bp, Homo sapiens
ccatttccggctcccctctacctaagggagactggatggcatatgagaacagaaagaaaatccttaaggaaacatagcctcccaccaattaattcttctattcactcgttaacagatgagttattgaggacca

SEQ ID NO: 21625 - DNA, 482 bp, Homo sapiens
cagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttacc

SEQ ID NO: 21626 - DNA, 392 bp, Homo sapiens
  misc_feature 2: n=a, g, c or t
ancccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttgaagcggagtcttgcaacagtgcatcccgacagcagcaacctgatccccaagctttttcga

SEQ ID NO: 21627 - DNA, 157 bp, Homo sapiens
tgttgtggtgttggcatttgtcattcattctgatgttaatttttaaaatatctgtcagcaaattaaagtacacattacatgctgattttgtttgtttgtaatatttatgctcagtggtcacagtgtacgtctgatgtggttttgaacttttcctttc

SEQ ID NO: 21628 - DNA, 489 bp, Homo sapiens
  misc_feature 63: s=g or c
  misc_feature 264: h=a or c or t
tttccgctactgcgcaaagatggtggaggaggagaacatccgcgtggttcgttgtggcggcasgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaathaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtca

SEQ ID NO: 21629 - DNA, 304 bp, Homo sapiens
  misc_feature 297: r=a or g
aagatttgaccaggatttgtttttgaattttttggagcgatggaaacgttctgcatcttgattgtggtgatggttacattacagtgtacatttggtcaaaactcatagaactgtacaccaaaaagcattaattttactttatgtaagttaaaaaataatgctttaaaaataaatgtagtggccaggcgtgttggctcatgcctgtaatcccagcactttgggaggctgaggcgggcggatcacctgaggtcaggagtttgagactagcctggtaaacatggtgaaaccttgtctttrcggaaaa

SEQ ID NO: 21630 - DNA, 238 bp, Homo sapiens
caggcttcctgagagcactagtaaaggagcataagccgaatttgagtgattagaatccttttctcagcactgatattcattagtgtgtaatggggtctttccattacctcctttgcttccttgccttttggctaaagtcaggttaaatatatatcacttctgattatgtgccctcctcaacaaagacatttctgtttgtctacatgtcacgctatgtgattgacaccacacgaccctc

SEQ ID NO: 21631 - DNA, 207 bp, Homo sapiens
atagtatgcacctgacgcttccactggctaaaaaagtccaagaaggagtattgattttgttcctactgtggaattagttctgtgggggttaaaaagaagaataaaacaataatttttgtccccaagaaatgcgtgatccagtaggttagagggtcaggtcagtcaccagagctgagacaggtctactgaggccagaagtgggggcta

SEQ ID NO: 21632 - DNA, 120 bp, Homo sapiens
tttatttaccatatgaaagtttacattgtcagcaaggaaagtcagtaatttttccactcaacttttagacagtgcaactttcagcagatgtctagttaattgaaaccctcccaccccgta

SEQ ID NO: 21633 - DNA, 109 bp, Homo sapiens
tattattttaaaatagctgtggaaaaactatacaaaggcctcccaaatgtcaatattccttaggcacctttgaaatatttataaacttaatctttggactaggcatccc

SEQ ID NO: 21634 - DNA, 284 bp, Homo sapiens
  misc_feature 164: w=a or t
cacataaaatagtagatgtcaaggaggacaggaatgtgattggctatttcctacatctgctccctttgcctgaacacctctcatactatgtctgcttagcagtgtagcaacacttaaggaaatatgtagcaagcaatagacagtgtcaagctgtcacattaccwgagataatttttaagacttaagacttcacaatatgaacttaataacctctttgccctaattattctgcttccaatgtaacaagttctcagaggcagaatctcaacctcctatcatctaga

SEQ ID NO: 21635 - DNA, 109 bp, Homo sapiens
aaggaaaatactgtgaactaagatacatattttcccattttaaaaaagtcaatattaaccaatggaaaattatttttaatcacattggaatcacaaacagtagcccccc

SEQ ID NO: 21636 - DNA, 197 bp, Homo sapiens
tcctttttattactgaatattcctttgcatcagtctatcgcagtgtggagaatctacttctgctgatggactccagggctgtttccagcttttggctgctttgaacattcttggacaagttttcttgtgaatatatgcttctgtttgccttgagtaaacacttaggagtgggactgttgggctgcgtagtaggtgga

SEQ ID NO: 21637 - DNA, 285 bp, Homo sapiens
  misc_feature 262: r=a or g
caagtgggccgggcgtgatggctcacgcctgtggttccagcactttgggaggtcgaggtaggcagatcaccgagcccaagagttcaagacaatcctggccagcggcgaaactctgtctctacaaaaaatatacaggcgtgttggcatgtgcctgtggtcccggcttcttgggaggctgaggcacgagaattgcctgaacccgggaggtggaggttgcagtgagctgggatcgcgccattgcactccagcctggctgacagarcgagactgtctctaaaaaaaaaa

SEQ ID NO: 21638 - DNA, 347 bp, Homo sapiens
tggacaggcattaagtgtcaagaacgggcattagacttgagggtctagtaatgagcaaaaataaagtcatggtttctgccctctttgatatctgtatttgttcgttttcacgctcctgataaaggcatacccaggactgggtaatttataaagaaaaagtttaacaaactaacagttccacatgtctggagaggcctcacaatcatggcagaaggcgaaaggcatgtcttacatggcagcagacaagagagaatgagaaccaagcaaaaggggtttctccccttataaaaccatcagatcttgtgagacttattcactaccacaagaaccagtttccatggtggaaa

SEQ ID NO: 21639 - DNA, 171 bp, Homo sapiens
caagcatttatcctttgagttacaaataatccagttacatactttaagttattttaaaatgcacaattattattggctatagtcatcctattgtgctgtcaaatagtaggtcttaattcattctttctatttgtttagtacccattaaccatccccacctcacccccaacc

SEQ ID NO: 21640 - DNA, 292 bp, Homo sapiens
  misc_feature 257: k=g or t
tgagttcaggatatttcttatttaagattttccttatatgtaaaaagaagatacaaatttaggttgaaggctatgggatataggtgatcaataaataggagccattattcctgatgccctggtatagcattagtgagacagtcccacttgagaaatgtgatggagcactcagtgtgtagtaggtactgcctccagacatgggaattcaggaatgtgaggcatgcctcctgccctcagtgagtctctaggctggtgakggagtacaggtagtaaataagtacatagagagtat

SEQ ID NO: 21641 - DNA, 79 bp, Homo sapiens
aatcaatttttaaaatatcggtgagaaacactacatatgtgatagaggactggaattgccaggtagagatgggagatgc

SEQ ID NO: 21642 - DNA, 186 bp, Homo sapiens
tttgtttttctggacgtggggaggtggtttattagcgatgttgaacatagtttttgtgcttatcaaccactggtatatgttaagtgatccgttctggatatgtagcacctgtggccactaccaaactgcttatgtgtaaaatgtatctactttttacacatcatcatgcaaccatcactaccaccc

SEQ ID NO: 21643 - DNA, 249 bp, Homo sapiens
tgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaa

SEQ ID NO: 21644 - DNA, 191 bp, Homo sapiens
  misc_feature 136: w=a or t
acggtaaacagattcaagtgttatcgggccacctgcagtgggtttactgctgttccatctccccagactgcagcatgctgtgctctgcagctggagagaagtcggtctttctatggagcatgaggtcctacacgtwaattcggaagctagagggccatcaaagcagtgttgtctcttgtgacttccccccc

SEQ ID NO: 21645 - DNA, 431 bp, Homo sapiens
  misc_feature 126: r=a or g
  misc_feature 132: y=c or t
  misc_feature 377: w=a or t
ttagagggaggtctgatgaaatgaacgagacagtcagagagctactccattcccgtggaaaccaggagtcccttggtgcagacagctcttcctactttcccatgcagttcttttgtacgactttgrgggggytcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagwataacaaatgtatctcatgtgtgaaccctgaagacaaatgacatttatcttccc

SEQ ID NO: 21646 - DNA, 136 bp, Homo sapiens
  misc_feature 136: r=a or g
gcacctgtatccttttctgtttgttgttctcactttactgttttgcccttgaagtctaactgctttactaattattctgtgcgtgttactcctactatagcttctgttttgactctgctgcttccttccatcctcr

SEQ ID NO: 21647 - DNA, 152 bp, Homo sapiens
tgctgtaggctataccatctaggtttatgtaagtacactcaatgatatttgcacaataatgaaatcacctcatgatgcatttctcagaacatatctgatatggtttggctgtgtccccacccaagtcccatcttgaaattgtagctccctag

SEQ ID NO: 21648 - DNA, 344 bp, Homo sapiens
  misc_feature 4: y=c or t
  misc_feature 21: y=c or t
  misc_feature 39: s=g or c
  misc_feature 43: m=a or c
  misc_feature 107: s=g or c
  misc_feature 127: w=a or t
  misc_feature 305: n=a, g, c or t
  misc_feature 306: m=a or c
  misc_feature 341: v=a or c or g
  misc_feature 342: n=a, g, c or t
cacygcccctcgactcctgtyccgttggaggggcctgasgcgmgcctgagtgcgctgttggccggagggaagccggaggagaccgggtcgactgggcagagcggcasagggtcgaggagcctgctcwgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcnmggagacatggcttcatcattcctgcccgcggaggvnta

SEQ ID NO: 21649 - DNA, 179 bp, Homo sapiens
  misc_feature 11: m=a or c
  misc_feature 176: s=g or c
  misc_feature 177: s=g or c
tgaagagagamagtccttgccaccgatgtttatattctgttacggagaggagggatgacttacaataaaccctcactggtggacaaaatactttagggttaaagtagtgaatgaacttattttatgtaacctactttctactgtgcacataagatataaattttagagtatgccassgt

SEQ ID NO: 21650 - DNA, 51 bp, Homo sapiens
atcttcacgcgcacgctaggccctgagcccagcctccacgtctcgccacaa

SEQ ID NO: 21651 - DNA, 462 bp, Homo sapiens
  misc_feature 301: k=g or t
  misc_feature 302: w=a or t
  misc_feature 353: s=g or c
  misc_feature 418: n=a, g, c or t
  misc_feature 419: k=g or t
aatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggttgttatcatcctgtttactaatggaaatattaagactactcctagacgkwaaataactggccctggtcatactctcaagagacagtagcacctagttctgsttgatattccataagccttcacctacagtgctatatcgcttccttttaaattatatttatgtggnktttttgaaggaggtaattgtctttgtctattttctgctgctgt

SEQ ID NO: 21652 - DNA, 424 bp, Homo sapiens
  misc_feature 183: d=a or g or t
agaccctttccccaaggaatggaaaatcctcctttcccccaggcagttgcatgggctgctcactttgaacacttactcgagtatcaacttcaatgagatattaacccactaccaccacctctgcccagtactcttgcccctttacacggcttaattcttcttcaaagcactcatcattacacdagttatcttttaccattttctaaagataaaaactccacgaggaaagggatctgagtctgtactgttcactgttgtttccgcggcatgcagatcagcacttgccatacagtagaagtgcaatgaatatttgttggtaggcccctaaggatcatgtcctgttctgatttgcatgtcctacaacattcagcacaaaaatttgaacatggtaagctttaaaaaaattcattgaaaacaacagctc

SEQ ID NO: 21653 - DNA, 123 bp, Homo sapiens
tcagagatggaattgtatttttggacatttcctttcctctttaaagatcttgagatctgttcagtactaatagatctaatgcttctttcttatgcttccagttagtttgcacttgttaccctt

SEQ ID NO: 21654 - DNA, 73 bp, Homo sapiens
  misc_feature 2: n=a, g, c or t
  misc_feature 26: y=c or t
anacaagtagcagcggtatgcctggytcgctcttctctttctaaccacactatttctcttgccttccttccca

SEQ ID NO: 21655 - DNA, 277 bp, Homo sapiens
gtctaggccccgcctccttgctgctgctgccgccgccaatcctggtccggttgcccgagttcccggaggtctctcgcgggacctctctcaccgccaccgctgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccacccccgga

SEQ ID NO: 21656 - DNA, 255 bp, Homo sapiens
  misc_feature 118: k=g or t
  misc_feature 121: k=g or t
caatgcctctgctcctttgaatataatcagtgatatttgaggttccagggttaaatgccgcatttttctttctgacgttcgtaccttaaaatatttgaagaaaataaactatttcatkgtkgtcagaaatgtagttcttttattttcctgcccctctcccctttctaagtttctagaatgtcaagtaggtagaacatagatgctccttttaggatcttttgctgtgaaatggtccacaggtgaatggcagcaacg

SEQ ID NO: 21657 - DNA, 412 bp, Homo sapiens
  misc_feature 109: m=a or c
  misc_feature 112: m=a or c
  misc_feature 116: r=a or g
cttttcttaatgctggaaactgttgtcagctctgcctggtacccccagggttccagggggctttttggacctggggtgggttccctcggattccctaccccctccccamcamacargcccagctggcgggagcgaccagcaggtggccactttaattagctcctgcctggagaagtggacaccgtggagctccgtacagcgtgtccctgggagaccagggaccatagggggcggggtttgagggggaaccgagggtttgacaacatcggagcagcccacgatggtctcatttcacaggtccccagacaggaccactcagtcccctgtatccatcccaggacccctgacctcctgtgtgcaatccctaccccaccttggggaaacgtctttcaaaatacttttgatctaatta

SEQ ID NO: 21658 - DNA, 380 bp, Homo sapiens
  misc_feature 249: w=a or t
  misc_feature 297: k=g or t
  misc_feature 298: w=a or t
  misc_feature 299: w=a or t
gttaacataaatgattatattttaactaaaatgactatattttaaagcaatgtagtaagaataatggcactgtttttgcaaatttctttaatatctggcttaagtgaatacagctgtgttgtagtcttttgacgtcacaattccatgtagcctctggaaaactccactgtacacttggagaaagagtgaaaaagataaataatatcttgatgtcattctgaaatagttttgacctgctgcctgcatggwgtggagttttatattctttttaaaatttttagtcttttttaaattctkwwtcttttgctctaggatacatatcatgagattttatattcttagacaatttcaaagtagatgtggtttgtatgcattttact

SEQ ID NO: 21659 - DNA, 271 bp, Homo sapiens
agatgtgtcagcttttcctaacaactcgcagagtgattaaagaattttaaagcaagtaatttcactgtgactcccctaggttatgagcagcccaagaggaggaacaatggtagctccagaagttctaacaggaagaggaaagggtcagagattttattaagaaaagaattttggaggagtaatcagcggatttgacttgaaacaatagctgcagaatatgtttaattttgaagatctacacttttatttcagagaagtatggagaggcaca

SEQ ID NO: 21660 - DNA, 67 bp, Homo sapiens
  misc_feature 35: r=a or g
  misc_feature 60: k=g or t
tatggggagtgtgtgtgagtgtgcatgtggggtgraggtgtatggtgagtgtgtgtgtgkggtgtat

SEQ ID NO: 21661 - DNA, 396 bp, Homo sapiens
actctgggtcggtctctgatgggcactgagcacacctcacctcactaactcttcccagcctcctgggaaggaggtctgaccatagtcactttacagatgaggaaaacgaggctcatagaggtggagtgagttgcccaaggtcacacaagccatcgatggcagggctggaatttgagaccttttggggttagcagattggctcctatgcctcacaagcaagccataggtttggccactcttcccccgtgccctgcttctcctcctgtgctgtgatcccaggtctagcacctctcccagcagtcacctcctggtggacatcacagtgagagctatttgcttattcagggtgcctgccctgtactagcgagagatcactccctcagctattgctgggat

SEQ ID NO: 21662 - DNA, 187 bp, Homo sapiens
atcgtcatcttcattggcagcctgtgcgggctgtgcaccaagtgcgctgtgtccaatgacctcacccagcaggagatacagaccctggagatacaacagagaaatgcataatgtccagtcaatttattaaagttccaaagtcggtcgcgcgcagtggctcacgcctgtaatctcaacacttcgggga

SEQ ID NO: 21663 - DNA, 301 bp, Homo sapiens
  misc_feature 288: y=c or t
caagtgggccgggcgtgatggctcacgcctgtggttccagcactttgggaggtcgaggtaggcagatcaccgagcccaagagttcaagacaatcctggccagcggcgaaactctgtctctacaaaaaatatacaggcgtgttggcatgtgcctgtggtcccggcttcttgggaggctgaggcacgagaattgcctgaacccgggaggtggaggttgcagtgagctgggatcgcgccattgcactccagcctggctgacagagcgagactgtctctaaaaaaaaaagaytcaagcggaccct

SEQ ID NO: 21664 - DNA, 203 bp, Homo sapiens
  misc_feature 14: s=g or c
  misc_feature 15: s=g or c
agttcgcgcgggassgggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaatt

SEQ ID NO: 21665 - DNA, 399 bp, Homo sapiens
  misc_feature 4: b=c or g or t
  misc_feature 302: n=a, g, c or t
tgcbttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaangtctggtccggtcccggattcggggcgctgacatcgcccagggcaccactctgactttcctcgacagccactgtgaggtgaacagggactggctcca

SEQ ID NO: 21666 - DNA, 107 bp, Homo sapiens
aaaaatccggctgggatcccgggtcgtcatcctggactggaatgcgaacgaaatggggtaaaaggaaggaacagatttgcaaaaaaaaaaaaaaaaaaaaaaaaaaa

SEQ ID NO: 21667 - DNA, 112 bp, Homo sapiens
aataatcctcttcatagagcaatacaacaaaaatgtgttgtatcttggagatttacattataaatgtagtaacatttatgagcttaaatttaatgaaacctttttttttttt

SEQ ID NO: 21668 - DNA, 180 bp, Homo sapiens
caataaagtgagtcacacatagtacaagcagtgtacaaagcacatccagagagtaagtttagcatcctaagatagttttatcttactgtaccagcaatattgtcacagtaaagagaattaacattggatggcccccaccccatacccttcgctgttgaacgtatagaaagtacccagccc

SEQ ID NO: 21669 - DNA, 146 bp, Homo sapiens
tataaaaaataaggcaagagagcttaggcagatggaaagaaaacaaaacagaaacttttttagcacatgtcatatttagtggaggtctcccagtctagataatgacatcatcattggtttccctttgacaatttttctcccacacg

SEQ ID NO: 21670 - DNA, 228 bp, Homo sapiens
ttcatattaatttctagtacagaaaatcttgacagccatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtata

SEQ ID NO: 21671 - DNA, 458 bp, Homo sapiens
  misc_feature 9: m=a or c
  misc_feature 43: n=a, g, c or t
  misc_feature 44: b=c or g or t
  misc_feature 84: s=g or c
  misc_feature 85: y=c or t
  misc_feature 382: d=a or g or t
  misc_feature 383: b=c or g or t
atgaataamtgtcacaagccccacaacagcagaggagggaatnbgtggcaaagagaagaccccacaactacaagtccctggagsyggaagccccgcaccagccttctccataaccggagcccacctgtgaatgcccccagagcagcccaggcgctggccatggggtgaggggcagggaggagtgcctgaccaaccaccatctctcacttggactattgcagctgtcttctacccagactccctcctccacctttgcttcctctgacacagtttccatagaaaaaccaaagtgatcttttgaagaggatgcagtactttggtgtattcaacatcttttccaacctcctcccagtgtgcctttctctcctgcagaagctggaadbcttcctcactgaagtagaggtaacggctcccctggtgagtgagctctgcagtgacactctgcgaattcctcctca

SEQ ID NO: 21672 - DNA, 199 bp, Homo sapiens
agccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagcaa

SEQ ID NO: 21673 - DNA, 188 bp, Homo sapiens
  misc_feature 139: d=a or g or t
  misc_feature 188: n=a, g, c or t
cagcaataattaaaacacataatactggtgattcttaataggactgtacaaggacagtagcttcctttttcacttacttttgcctcctttctggagcattgggttttgtgatgattcatagactctttaaggtagggadagggtttggcaacgttaggcttttgaagctaggaagatagcagagcggn

SEQ ID NO: 21674 - DNA, 411 bp, Homo sapiens
  misc_feature 103: w=a or t
  misc_feature 296: k=g or t
  misc_feature 298: s=g or c
  misc_feature 352: n=a, g, c or t
taatatagggcttctggtaaaagagaatagaatgaacagacaaatacctgtttgtctactccttactctccttcctgttgaaatgacagtcaatatataagawtgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgckasttcaaagtgtgagttggtagctggacagaaagcaggccagttaactgaaggaantttgtacagatgctttacaggttaatatgatttcctaaatgatcagatgcatcatatga

SEQ ID NO: 21675 - DNA, 337 bp, Homo sapiens
atacttgtggggaaaggcaacttaatatatggaggctatagtaggtattttcttttagatctatactgtttagaattgaactgcctgcttgtttcgaaagatcttttcggagtatctgttaccgggtttaggccttttcttggtaggagggggtcttccccactggttttacttgtttttagccaagtgatagccattgtaggctcctatataccagatagcatgctaaaagaaaggacactggatttagagtccgaagtactaccttgtcgcctggtaaacatgagatttagggcaagtagcttcttcagaacctccaattttcatatgtggcccc

SEQ ID NO: 21676 - DNA, 393 bp, Homo sapiens
  misc_feature 192: s=g or c
  misc_feature 193: n=a, g, c or t
  misc_feature 194: w=a or t
  misc_feature 356: w=a or t
  misc_feature 360: k=g or t
  misc_feature 364: w=a or t
caaaggacatattattcttttatggctatgtagtattacatagtatatacactatgtatatacatagtaccacattttctttatccagtctactgttgatgggcatttaggttgattccatatctttgctattgtgaatagtgctgcgatgaacatgttgtgcatgtgtctccggtagaatgatttatattsnwttgggtatatgcccaataatgggattgccatgtcaaatggtaattctgctttgagtttttgggaaatcatcaaattgcttttcacagtagctgaactaatttatcctgccaacactgtataagtgttcccttttctctgcaacctcgccaacctctgatttwttgktctwtttagtaataaccattctgactggtatga

SEQ ID NO: 21677 - DNA, 294 bp, Homo sapiens
atatactttctagaacattccccaaccccacctcagtgtgtgcgccttagtttcctatagttgctgtaacaaatcaccgcaaatttagtggcttataacatatctttattatcttacagttctggaggtcagaagtttgaaatgggtttcactgagctaaaattaatatgtggatagggctgtgttccttctagaagcactaggggagcatctgttcccttgccttttttcagcttctagaggccacctgcacttttggcgcatgaccccttcatccatctttaagtcacccaa

SEQ ID NO: 21678 - DNA, 253 bp, Homo sapiens
aggtgtggaataaacttgttttttgttaattttaagctttttattttattctagaatatgtattctattcacaagactcaacaaaaaaaagtatcggccgggcgcactggcttacgcctgtaatcccagcactttgggaggccacggcgggtggatcacctgaggtcaggaattcaagaccaccctggccaacatggtgaaaccccatctctacgaaaaataaaaaattaactgggtgtggtggcacgcgctc

SEQ ID NO: 21679 - DNA, 446 bp, Homo sapiens
ggtccccattaacaattgcttgaaattccatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagct

SEQ ID NO: 21680 - DNA, 151 bp, Homo sapiens
taggagatagaggtgttttgattttatgggaaaattacttcctcaagaacacatttcttgaggttttagtaatcacatttgactccctgaaattggcaattttattcaatgtaggaatattatcatggtatattatagtgaggagcagcgg

SEQ ID NO: 21681 - DNA, 208 bp, Homo sapiens
caacgtattttcaataacatagaaaagttgtgctcctatatagctctagactcccaaccccagaccatgttcacataggaacatattatatcctcataaattgtgttaccattaacccagatgtgtggtgattgttttatgtatttgtcttttaaatcatatagaagaaaaatgagttagaaaccgaaagtataagaatagtgactga

SEQ ID NO: 21682 - DNA, 371 bp, Homo sapiens
  misc_feature 371: r=a or g
tttcaatttataatttttattaggattttactgatactgtatctttttggtactggaggtctcagaggactgacctggttctacttgtttgctcttgggatttagaacgatagtttctattgtgttgagccagcaacattttgcttattttcaagaggcagagtggcagagtactaaattgcaaggttgtgcagaccttaaataagtgtatggtgagctataaagttacaatgttaaattagtttctggctggcccacattgtttccaaagttgactttgcattttaaaagaccttactgatttaaaaagcgaatagagaactgcttggaaacacatatcatctgagagacattcgaacatgcgggggtar

SEQ ID NO: 21683 - DNA, 130 bp, Homo sapiens
  misc_feature 125: w=a or t
ttgttaggaaatcttgatgctttcttctttctctttaaatttttgtaatcaagcaacagacttgatccagcagtgtcgaattccaagcaagttatgatgattcttattgtagttcaagtacagawgagta

SEQ ID NO: 21684 - DNA, 330 bp, Homo sapiens
ctctttcaaagtcagtattgtgtttgtgaggttcatctttatcacatagagctgtagttctttttcgttgtagcattgtattctattatatgatgatatcaccaattatttactattgtacaattaatggatatattggttgcttccagtttttggctcttacacaaaacggtagttgcacatatacatgagtttcactaagagttaatccaggaatggaattgctaggttatagggtagtgtatctttaattttaccagatgatgccaaactaattatacaagtttacattcccaccagcagttgaagaatttccttgccctgccaggc

SEQ ID NO: 21685 - DNA, 111 bp, Homo sapiens
  misc_feature 9: y=c or t
  misc_feature 39: k=g or t
acgtaagcyccccgcggatcctcagacagctctggagakgggtcccgggggaaggtcactgcgtccagccggccagcaggcagctagagcccccgagccccgagccccact

SEQ ID NO: 21686 - DNA, 194 bp, Homo sapiens
tacgattaactatgagagtaagacatcaaagctgaactgacttcaaagcctgtaacacttatggtttccagctattactgtaaccagccgcttcaccctgacagcaattcatcttacagagctgcctcgctaggttccacccctctgcttcctgccttccccctttacaaacctatcaaattaaaaactaccca

SEQ ID NO: 21687 - DNA, 180 bp, Homo sapiens
tgttctctcactcgcacagtagcacaacaattacaattcttgttttacatgtgaggaaactgaggctcagaaaagttaagtaacctgagtacagtccaagtatgcctggctctgagttccgtcggaccacccagtcgtccctgtggtgcgtctttcagagtatgggcagatgcagccaca

SEQ ID NO: 21688 - DNA, 199 bp, Homo sapiens
cagtaatacaaagcttaaagtcattacatatatcaagagtacaattcataaacctctctcctttaggactacttatccataataatgatgaaaactattatttttagagccatatcaggcattgtgctagagatgcactttatacagatgtcacatttaatctgtagaacaattctcaaaggtaaacagtatcatcccc

SEQ ID NO: 21689 - DNA, 431 bp, Homo sapiens
  misc_feature 21: s=g or c
  misc_feature 38: d=a or g or t
  misc_feature 39: y=c or t
  misc_feature 72: r=a or g
  misc_feature 356: s=g or c
  misc_feature 357: k=g or t
  misc_feature 358: n=a, g, c or t
  misc_feature 377: s=g or c
actggcccctggcaggcaggsagcagccaggtggggtdycagccagagcacgcacgcacggagccgggagcrggcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaactggagaggatgtaacacgcccccagccgggagtgaagccctggaggagctcctccccccttcgttcccaccctcaagtctgacgaskncaccctcgtagctattgtsattttccactggggcatcttgaaaaacaaaggtagaagctgaagttgttctgta

SEQ ID NO: 21690 - DNA, 257 bp, Homo sapiens
tacttgaacttttcttcctttaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgc

SEQ ID NO: 21691 - DNA, 311 bp, Homo sapiens
gtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaact

SEQ ID NO: 21692 - DNA, 235 bp, Homo sapiens
atttatgtttatatctctaggctccatcttcttgatctctagtctggtttaactagcactttacttggcatctttgtttggatatgtgataggttttcaaacataatgtgtctaaaaatggaaactttaatttcttgttccttgtccgttgagctgtctctgcatggcacgagaagaatagatttttcttacaatgctcttcatcaataaatagaaaatccttgcttccggttga

SEQ ID NO: 21693 - DNA, 142 bp, Homo sapiens
aactgccgcagcggagttcagagggcccggaggtgggagacttcccacacggtgactgagatgtcgtccactgcggctttttaccttctctctacgctaggaggatacttggtgacctcattcttgttgcttaaatacccga

SEQ ID NO: 21694 - DNA, 212 bp, Homo sapiens
aactgtcctaaattgtttaggaaaggaagtactggcgtgattggctcctacagtgtatcaagctgtttaactgtcatctgatagttatcatctgatacaatcatctcaagaacactgtgaggttggcactattattatccccattttacagatgaggagatcgaggctcagagaaggtaggtaattgtccaaagtcacacagctgggatgac

SEQ ID NO: 21695 - DNA, 376 bp, Homo sapiens
attcagcagttaagtcacttctgtattttatttttaacggaattaagtaaacattttatcttgttatctttaaaattagcacgcacagagtccataaccgtgtggacctgttaaatccctgtgccacgattttatcatcagtaccataactgaagagacaagaaagcgttccgtaattcctcagtattttaccaagaggagtgagctttctgaccagtgcttatgtgccctgtatttggtcaattcctctcagaaccagtggtttttaagtgggagatgacaccacggtccggcaatagagtggacaccagggccaattcagctccttgatcactgatcccagaagcatgtcacaaccctgacaatcacagcagcc

SEQ ID NO: 21696 - DNA, 138 bp, Homo sapiens
  misc_feature 77: r=a or g
  misc_feature 82: r=a or g
  misc_feature 83: s=g or c
attcccattccctcatccttctaggacagaagtggcggttgctgacgcctggaaattcccctgaaggtggagcaccrcccarsccccctgggtcccaccctccctcaaggcctcctccacctccacctccaccccgct

SEQ ID NO: 21697 - DNA, 397 bp, Homo sapiens
  misc_feature 225: w=a or t
  misc_feature 282: r=a or g
  misc_feature 283: r=a or g
  misc_feature 284: r=a or g
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataawagaagaaaatggaattgaatatgatgtcagcatggaacaatctaatgattcattaarrrgtcaaccataatgacggtgaagagtcaaaaaccagtgctcaagtatttgagcatctaatctgtatggactccagggattcttcctttggacaaaatgattctcctacagtttt

SEQ ID NO: 21698 - DNA, 405 bp, Homo sapiens
  misc_feature 105: k=g or t
  misc_feature 115: r=a or g
  misc_feature 122: k=g or t
  misc_feature 127: w=a or t
atgtgtcacattttccagtaaaatgtatcagaaatcaatgccttctgaatttcaaaatgattcttagaaataagatattgtacaactctagcaaacatacagagktacagctaartcttaaktatawttcactatgtaaaaggctgaaacttcataattatctgttccttctatctttttttgagtcaaaaagtctattaaatttttctgttgttgttccaactttggtgaaaaaggttatggcaatactttaactttgttttgttacattgtttttgttcttggaatggctcacaagcagaatttaaaaggcagattttcattaactataaatggctgaaaaaactgaatttactatctagctacagaaattatttttctatggtgtgaaactgttcccagact

SEQ ID NO: 21699 - DNA, 179 bp, Homo sapiens
  misc_feature 146: w=a or t
ttaatcatactaaagccagttatgttaagaatttttcctttggattttataattaagagttgcttataaatacttatgacattgagctcttactgttttagttgtcttaaaagaatgggacatgtcatgaactggttttttttttwaaaaaattcttgatgtgaattccactgttacct

SEQ ID NO: 21700 - DNA, 156 bp, Homo sapiens
  misc_feature 42: n=a, g, c or t
cgtaaatctaactttcttcccacaacactggagcacctaggnatataaagcaaatattattagagcttaaagagagaccgcaataaaatgatatctggacatgtcaacacccccgcttttcagcactggacggatcatccgacagaaaatcaacac

SEQ ID NO: 21701 - DNA, 261 bp, Homo sapiens
gacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaac

SEQ ID NO: 21702 - DNA, 129 bp, Homo sapiens
tgacatggagtctagctctgtcacccaggctagagtgcagtggcgcgatctcagctcactgcaacctctgtctcccagcaattctgtctcaggctcctgagtagctgggattacaggcatgcgccacca

SEQ ID NO: 21703 - DNA, 394 bp, Homo sapiens
cacagatgccctcacagttgcatttaatcctcatggtttaatcatccaaaagcatgttacaatattactggctctccacgattagggacgtcatagcccctgaaacttatttagaattatttaccattttgaaattttgaatgcttgttccaaatagaagatttcgtaggatcaatagttacaactggtttgtcttttaataaacattaattttcactttctgctcactctgtgtcctttttctaaggattacttagcagttttctgatttttgatgggccatttaggctctgaaagccaactcttgaacctattgtgctttgtcagacaaacctaacacctgtccatgtttgttactgcttttaatatctgttatagaaatatgtgtgcacat

SEQ ID NO: 21704 - DNA, 135 bp, Homo sapiens
caattcttcctcttccaatgtggccaagggaagccaaaagattggacagtcctgctttagagcctgccatactaaaaatagtaatcctcataaaacctgttctttcttaggtttttgatagatgtgtctgctttt

SEQ ID NO: 21705 - DNA, 170 bp, Homo sapiens
ttttggtttgtaattggtattcattacaggtcactctttgggatggacagtgctgtggtttttgacaaatgcataatcatgggtccatcatcccaggaccacacagaacagttctgtcacccttaatctcctccatgctgcccttgtagttaattcctgtcactctccca

SEQ ID NO: 21706 - DNA, 77 bp, Homo sapiens
actattgtgcggctgcaggaggtgtcgagcggcgttatttttttttgcggtttgcctttttttttcttttttttttt

SEQ ID NO: 21707 - DNA, 77 bp, Homo sapiens
  misc_feature 65: y=c or t
actattgtgcggctgcaggaggtgtcgagcggcgttatttttttttgcggtttgccttttttttycttttttttttt

SEQ ID NO: 21708 - DNA, 184 bp, Homo sapiens
acgttgttggtgtttagaaatgctactgatttttgtatgttgattttgtatcttgaaactttttgttggttttttgagacagaatctcactctgttgcccaggctggagtgcagtggtgtgatcttggctcacggcagcctctacctcctgggttcaagcaattctcatgttttagccccctaa

SEQ ID NO: 21709 - DNA, 434 bp, Homo sapiens
  misc_feature 141: m=a or c
  misc_feature 316: n=a, g, c or t
  misc_feature 317: d=a or g or t
  misc_feature 318: r=a or g
  misc_feature 350: r=a or g
  misc_feature 356: k=g or t
  misc_feature 357: s=g or c
attgattaaggcaaggatcatatgttttccattggacatttacatttagtaaaatgttttcaagagcagtatacttacagagtcctaatgttttaccccatagattagttattacaaaagagaaatgtgtctaaaatggamcaccatttctcaccaccataataagcaagatcagacttttcattggcatattatctcagagaatctgacattgtatgtgcctcctaaggtggtgcagtaggagttacacaaatcacctctgtttttaatgctggaaatatttgatttgaatttagtcatgagacaatactcctgndracactgctagacaactggcctggactcatcaragtatksagtgtcttgaagaacaaagagaggtaaatggaattgttgtagattggatgaggctaaagagacagacatagcaatca

SEQ ID NO: 21710 - DNA, 257 bp, Homo sapiens
  misc_feature 53: m=a or c
ttttcggattctggacttcgggttccgctgaggacggatttcggaataggcamgtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaac

SEQ ID NO: 21711 - DNA, 387 bp, Homo sapiens
  misc_feature 52: s=g or c
  misc_feature 324: s=g or c
  misc_feature 326: s=g or c
acttttcctcgcggcgccccctcggttcctcaaccctgcctccaggcgccastgagagcaccttgcaccgcccctcctcactgcagggaggttctctccggagcgcgggcgagggaggaggcacccagaggtgcagcgacttgcccaagccatgtcagagccaggcgtacagcagcgcttccccttttcaacccgactgccctgccccttggggagggtagatggagggaggttcgactcagaagccccaacgttgaccaagatccagacacgaaaaggagaaaagagttcccggctagcacggcgacgctttcataccgagasgsccccctctcccgctgcctcggctccccctaccaccgcccgtactctcccagatttctcagt

SEQ ID NO: 21712 - DNA, 104 bp, Homo sapiens
aaaatatttctatgtaaaggcagtctattcctttctccgaagcgggaatcaaataatagactgcagaaatgaacggagggctcgatcccagcctttatgtggtg

SEQ ID NO: 21713 - DNA, 121 bp, Homo sapiens
taatgtattcatatttatgtcatctttagcattttggtggattatagagttgcaagaaacttggaggacatctgtttccacttttatgtgttgttttcattatgttcaataaaccaccata

SEQ ID NO: 21714 - DNA, 89 bp, Homo sapiens
agtttctgtggcgttcgagttccatcggctcccatccgggctatcctgccgccttagcgctgcttctccccaggatgcgggcagggggc

SEQ ID NO: 21715 - DNA, 314 bp, Homo sapiens
  misc_feature 182: s=g or c
aagccagcccgcagcaactctgcagggaagaatatagggaaataaacgccttcatctctctcttgtcccacccgcagagctccttctgggattctctattggctgaactcagccagaagctgccaagggagacccccacaactggatgcagcccactgaagtcagcttcctggggtgcgtastgaaggtagcagggagcaaaaagaatctgaaggggaagtgaacaatgtagagcgtatctgtgctgaagacgtaaggagagagtggaggtcagaagctggcatggtccctggtgcatgtatcagccgctggca

SEQ ID NO: 21716 - DNA, 378 bp, Homo sapiens
  misc_feature 34: h=a or c or t
  misc_feature 35: n=a, g, c or t
  misc_feature 36: n=a, g, c or t
  misc_feature 245: r=a or g
  misc_feature 246: d=a or g or t
tctactaaaaacacacaaaaaaatcagccaagghnnggatgctgtcactgaaatcctaataactgacaggattctggtcacaggtctcaggggagaatttcactgagcacctgatgaagacaaagggtcgttgcagggatttcggaatggcttcatgtcctgttcagcctgcctccccgcagaagtagctctgaattagctttctccatcacagaccctgaatcgagggtacaaatgaagccccrdcctcttcagcagaacttcatcagcacgtttttctgaagagagggaaattatccaatgcacagagaggccggtgaccccagcctgagatccatctctggtttgtcagctgcttctcatattttcacagcagct

SEQ ID NO: 21717 - DNA, 371 bp, Homo sapiens
  misc_feature 255: w=a or t
catcaatcacagaatgaagactcagacagcctcccaggaggacacaaagtcagcctcagagaggcatggaggtgttaaagagggaagtgcctgctagaatttcagtgggttggatatgctctttaacgatgcacaaatcataggtatacattttctgacaattggaatctattattactcttgaaccagctgttccccaggctgtttcctgtaatggaagggatactttgagtttatatcttttcaatcctacawcctcagaaatctacactgatactaataaagggactcatttctcctataagaacccctatgcgagaaaagtatgtttgggtattgcctaatgcactcataataaatatacacgagcc

SEQ ID NO: 21718 - DNA, 341 bp, Homo sapiens
atggatatccagttttccaaaaccgtttaatgaagagactgtccttttcccattgagtggtcttgaaatccttgttgaagatcgtttgatcatatatggtagttatttctgggccctgtgttcacgtccatggtctgtattgcctgtctttattacagtattacagaccacaggctctttggtttcccatgtaatggaaattaacacggacccaagcagatttcccagacaggacttttatttcagggcttgtgcttgagcgcaagggaaacagtggaggtgaggctcaaggatcctcttcctggcttcccggaaaaagccagtaggaattttttttatta

SEQ ID NO: 21719 - DNA, 179 bp, Homo sapiens
ttaaaccaacaacagcaaaaaggacaaagaagggcattacataatggtaaaggattcatatcaacaagaagacttaactatcctaaatatatacacaaataacattggagctcccagattcataaaataagtatttctagaagtacaaaaagacttagccacacaataaaagtggggga

SEQ ID NO: 21720 - DNA, 232 bp, Homo sapiens
  misc_feature 210: d=a or g or t
ctagcgtggcggcgctgcagtctgggcagtgggttggttcctcctcggtcctctgtcgagtggcgacagggcctagccacctggcgggggtgaccttcggacgtgcgacccgctcggagaagggagggaactgtggcccgcaacaaagcagtgacaggcccgacatcccctgcagcgcgatctttccctcagctgcctgccggaggaagdgcctttctgtttcacagggcgt

SEQ ID NO: 21721 - DNA, 140 bp, Homo sapiens
  misc_feature 47: m=a or c
  misc_feature 77: r=a or g
  misc_feature 109: s=g or c
ctatggtatagctaaaaacaaaagcccataaagttggagatagggamcagagtttaacatagcgatctaggccagarttgacaatgtttaagtaatggtggaatctgtsaataagacttcccagagtgttaatatatatc

SEQ ID NO: 21722 - DNA, 199 bp, Homo sapiens
  misc_feature 125: d=a or g or t
tgagttcatgtcctttgtagggacatggatgaagctggaaaccatcattctcagcaaactatcacaaggatgaaaaaccaaacacgcgcacaaaataaaaaaaccacacacattaatacttagcdtcgaaaggaccctgggtttagcaaagtattaatgtgtgtggtttttttattttgttgggttttttttttttttt

SEQ ID NO: 21723 - DNA, 372 bp, Homo sapiens
  misc_feature 8: m=a or c
  misc_feature 9: h=a or c or t
tcttctgmhtgatagacatttgagttatttccagtttctggctattaggaataattatcctatgaacattctttatgtctatatgtacacatttgtgtagggtatatacctagaaataggatagcatagggcattcatatgttcagtttagcaggtaatggcagttttccaaagtggttgtatcagtttacattccagagggcagtgtatgagagttcctgttaatccacatcctccataacacttggccttttaattttgattttcaattttagccacttaggtgatatatagtggtataacaaaatgattttagtatacattacctagtacataaaatgtttatttaaaaatagtaaaaaaaaaaaaaaa

SEQ ID NO: 21724 - DNA, 149 bp, Homo sapiens
ctgtttctaatagcttttttttttaaaaatgaaggtttattttttctctgatttatgaaagtaattatactcaataccaggaaactcagaaaatgcttgtaagtaaaaagaaaataaacttcactagccacctcgccctccctgccgac

SEQ ID NO: 21725 - DNA, 196 bp, Homo sapiens
  misc_feature 177: s=g or c
taatcagatcaggtcacctgagaccatgattaagtgatatgaaacaagatcacttcacaattttatctaagcacagacctaaacaaggtcactgtgtaactcacaacatacccaacatccttctcacctggctaatgtgaatgacagctacttttttgcccagtcatacattgcccstcattttctaatagcatcc

SEQ ID NO: 21726 - DNA, 373 bp, Homo sapiens
agcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacaggtctcactgtgttgcccaggttggagtgcagtggcgtaacctcccaggctccattgatctccctccttagcctcccagatagctgggactgcagatggcccaaggggctatacaaagaaagctgtttgcacaggatagaattaagagcagcatgtcagcattccgtctgcagttgagatgttgattcctccttgtattgcacattgctgaa

SEQ ID NO: 21727 - DNA, 466 bp, Homo sapiens
  misc_feature 344: d=a or g or t
  misc_feature 345: d=a or g or t
  misc_feature 452: n=a, g, c or t
  misc_feature 463: s=g or c
caatttatatttccaacccacacctttcccctgagttccatgctcagatattcaaccatctacttgacaagtttccgtagacatctaatatacatctcaaatatgacaagcccaaaatcgaactgctgcttttctccctaaaagagccatcctcatttcagtggacaacaatttcatctttccatcttttagggcttaaactctggagtcattctaaattctctttctctcatgctgcacccactctgttagcaaaccatgtcagctgtgctttcacaataaattaagaaacaactacttaattcatcaaattcatgttggtccaggacagaagacctgttctddctcttagaatcgtttcataactgagcctcctgcttgtagtcttgctcctgtggtatgttctcaaaacagtaaccagagtgatcattttaaaagctgtagtgatgtgncattcttccgstca

SEQ ID NO: 21728 - DNA, 191 bp, Homo sapiens
tgggctcaggatattctcttgcttcagcctcccaaggggctgggattataggcactcgctaccacacctggctaatttttgtatttttagtagagacagggtttcaccgtgttggctaggctggtctcgagctcctgacctcaggtgatccgcccgcctcggcctcccagagtgctgggattgcaggctat

SEQ ID NO: 21729 - DNA, 193 bp, Homo sapiens
atattaattgtaaagtttattgtatagtatttaaccgctgaagttcctattttatgttgtgcttatgtgaaccccttggtgaaggtccttttccttggatgtgtagttatatgatctttttaaatgtacagatattttgctataaaatcggtgcagttttttatggtttttacacttctctttaattcccacc

SEQ ID NO: 21730 - DNA, 81 bp, Homo sapiens
tctgtaaattgcttttttcggttcgctgtgtgcctttaatttgagggcttttatcgaacaccctttttttttttttttttt

SEQ ID NO: 21731 - DNA, 58 bp, Homo sapiens
  misc_feature 1: m=a or c
  misc_feature 6: r=a or g
  misc_feature 7: s=g or c
  misc_feature 10: y=c or t
  misc_feature 13: r=a or g
  misc_feature 26: s=g or c
  misc_feature 47: y=c or t
mgcgcrsggygcrccccgctccctcscactctccctgcccctcggaycccatactcta

SEQ ID NO: 21732 - DNA, 165 bp, Homo sapiens
atttttcttttccccttgctacagcatgccccctagcttcggtactctgacaccttctcttgcacttgcggatgatgaactggaataacgatgaaagaaagcacatccgatctcaacattcacgtcctgccctataaccgattaattaattgatccccagctata

SEQ ID NO: 21733 - DNA, 314 bp, Homo sapiens
  misc_feature 7: m=a or c
  misc_feature 8: n=a, g, c or t
catttamnaaccaacaacaaccgataatgactttgcacgattcactttgggatctcaaagtgtttccaaagcattcagatttacaaacaattcacaagacaggtcatctttgtaataaccatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaa

SEQ ID NO: 21734 - DNA, 126 bp, Homo sapiens
aatctctttaaattcttgttacatagactctgagctctaacaggctagggattatcttgcaaaaaacgtatggcaacctctcactacctagcacagtttgttctctctctcccttccctcacccca

SEQ ID NO: 21735 - DNA, 95 bp, Homo sapiens
cttcttctccttagagtgacagctttgtctgcactccgtaagttttgacgtggtgttttttgttatagtattaagaatttccttttgccaaagtg

SEQ ID NO: 21736 - DNA, 355 bp, Homo sapiens
  misc_feature 263: d=a or g or t
  misc_feature 264: v=a or c or g
  misc_feature 315: s=g or c
agtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcgdvgactctgagatccgtgtgcctccggtggtgcccgcgcagacagtgcgacastggtagagttcctgtacagcggttcgctcgttgtggcgca

SEQ ID NO: 21737 - DNA, 349 bp, Homo sapiens
  misc_feature 348: n=a, g, c or t
  misc_feature 349: k=g or t
acctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcaggcaank

SEQ ID NO: 21738 - DNA, 186 bp, Homo sapiens
ttgcaggatagttaaaggtgtttaaagggtaaggcttttggtgtaaatgctggatggggtgtgtgtgtgtgtggatatagggacctccctctgtactgtgtaatcggcattaatacctagactcatatgtatggaattttaaattctcttagcctactgattggtttggatgagcacaccagcaac

SEQ ID NO: 21739 - DNA, 239 bp, Homo sapiens
agcaggacagtgatggaatatggctactgtgatggttagtttcaggtatcaacttgaccgggttaagggatacccaggtagctggtaaagtgttatttctgggtatgcctttgaaggtgtttctgacagagattagcctgtgagtcagtggaccgagtaaggaagagccaccctcacccagtgtgagcgggcaccatccaatcaggttgagggcctggatagaaaaaaaaggccgagga

SEQ ID NO: 21740 - DNA, 277 bp, Homo sapiens
atcccctttcccctttgttttccttctttcctttccaaatccaggagataaatcaactaagagccaggcacccttttaagtccaataagaaacattttacaacctgctctctctgaagtctgctatctgagagcttcctctgtacaataaaacttggtctccacaatcctttatcttaacctaaacatttcatttctattaatcccaggtctttagataaactcaactagttgtcaatcagaaagtgtttaaatttacccatagcctggaagacccc

SEQ ID NO: 21741 - DNA, 340 bp, Homo sapiens
  misc_feature 269: s=g or c
  misc_feature 284: k=g or t
  misc_feature 287: s=g or c
  misc_feature 291: v=a or c or g
  misc_feature 298: s=g or c
ccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcstcaactgctcttttkgtsttavatcccasatccagtttgtcagaaaagcctattagagataccttgaaaat

SEQ ID NO: 21742 - DNA, 102 bp, Homo sapiens
  misc_feature 11: r=a or g
tttggggaggraaccacagaggcaagctgccaccctcatcacctatccagggcacgtgctgtcaacagtgtgcctcaccattgatgtgaacctccatcgcct

SEQ ID NO: 21743 - DNA, 281 bp, Homo sapiens
  misc_feature 202: m=a or c
  misc_feature 204: m=a or c
taatctgatatttgatattcttatttttttacaattcataaataaatgcaaaagtctatgtcatttatttttgtacttttctgagctacatataataattgaatacttataataattgaatactggttgggacagaagtagaagttgcctacctaggaatgcaacctatcaggtaattcaggattcccatgtaaattaacamgmttactgtgtaaactttgcagcagataattacctggactctagagccagactagtattgagtttgctctgctactaac

SEQ ID NO: 21744 - DNA, 321 bp, Homo sapiens
  misc_feature 306: b=c or g or t
  misc_feature 314: m=a or c
  misc_feature 318: s=g or c
  misc_feature 319: s=g or c
ttaaatatattacccaaaacaatggtcggaattctattttccatggaaaacaaactggcttagaggaggagaataatgttgctaactttgacccagaaacacctcagctccttatttgggggctgttctaatcactttgcacttattatctcagtttttctcatcaaaaaccatatggataggtattattattatcattcccaccttacagatgagtaaacaaaggaccagaaaggtttactaactgcccaatggcatggggttaatgagtgttcagagtcaggtttctaaccccaaatgcctccbtgttcaamacassgg

SEQ ID NO: 21745 - DNA, 206 bp, Homo sapiens
atacacacacatggagaagccaggagaggacgcggccagagatgggctcctgcccttgaacccctgctggggtggaagcaggtgcacaatgcttctttgagtatctccgtgtctgtggctgatatccagatgcaaggcttcttccgggcatccctgggaatgggagtgcatagacatactggtcaaattacagcacagcctctact

SEQ ID NO: 21746 - DNA, 201 bp, Homo sapiens
ttggagagtggagggaccggttaggggagaaatagccagagagatgacgagagacacagatgggttggagaggggtactctagaatcctgcagaggccaagtatgtgacgggctggagtgaggggacttgggtgacatcgggttttggacagcagtgtataggtccgagagatgaactatagggcaggcttggggagggcc

SEQ ID NO: 21747 - DNA, 68 bp, Homo sapiens
atctggaaattattatttagtagtattttattttaaaatatcagatgctttttttcttcccagataga

SEQ ID NO: 21748 - DNA, 402 bp, Homo sapiens
  misc_feature 144: b=c or g or t
  misc_feature 145: r=a or g
gtccaggttggagtgcggtggtgccatcgtggctcaccgcagcctctgcctcccgggttcaagtgattctcctgcctcggcctcctgagtagctgggactacaggtgcccaccaccacacccggctaatttttgtatttttttbrtaaccagttttcaccatgttggccaggctggtcttaaactcctgacctcaagtgatctgcccgcctcagcctctcaaagtgctaggattacaggcgggagccactacacctggactcattcttaagttataattaactataatatcaattcttattttggcatctccagagtttctgtcttgccttacacaactttacctgtttatgggacagacagctgtctaatttcattctcattgtgtcagaatgctacccac

SEQ ID NO: 21749 - DNA, 136 bp, Homo sapiens
  misc_feature 37: d=a or g or t
tgtttaactgaggaacttccgaactgtttcccatggdtggctgcgccattttacatttccaccagcaatgacttacgaagtttccagtttctccatatccttgccaaccattgtgatttttgattgtagccatcca

SEQ ID NO: 21750 - DNA, 257 bp, Homo sapiens
tggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaaac

SEQ ID NO: 21751 - DNA, 263 bp, Homo sapiens
  misc_feature 110: k=g or t
ttttgggttggtaaatttcaagttgggcatcagataggacaagggaaggggactggagaaggaagagccgacagtttgccctcaggacttcagagtcactcttttttgtktggttggttttttgggatggagtcttgccctgttgcccaggctggagtgcggtggcgtgatctcatctcgccgcaacctccgtctcaaaaacaaaaacaaaaagaataatcgaataatctaaataaatttagtgttttaaatttggaaacgaa

SEQ ID NO: 21752 - DNA, 157 bp, Homo sapiens
agctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggat

SEQ ID NO: 21753 - DNA, 269 bp, Homo sapiens
aattatcagcacagatcctttgtcacagctttgacatcatatgaccccagacccttctaggtgccactctctggcctgatgccaggcagtggcaagcacacagagctgcagcacacatgcttctgctgtcaagaccctgcagtctaatacgggaaacagatatgctgcgttcatgaagaattatgacaccaggaaatgtgtgatcaggagcccagacaagctttattctttaagacctttttgatcctaagtgacagaaaacccaccca

SEQ ID NO: 21754 - DNA, 164 bp, Homo sapiens
tctatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtgga

SEQ ID NO: 21755 - DNA, 237 bp, Homo sapiens
cttaatgctcaaacctaaaattctccaaatccatatttgtttcagatgcaaaattctattccaaatatctgttctttgtttttttcagcagagcaagcctgtccttagaaacagctgcaggccagtcactgtctctccctgtctttatcttccctgctgagtggcatgttgcttgcaaggccccatggggacttccaaagccttccataaatgactggcagtaatactttttttttt

SEQ ID NO: 21756 - DNA, 189 bp, Homo sapiens
ctttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagaccgc

SEQ ID NO: 21757 - DNA, 256 bp, Homo sapiens
agaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcc

SEQ ID NO: 21758 - DNA, 248 bp, Homo sapiens
gattagaaagttcatggccccgcgatgaagtcgagatctcaaatactgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtga

SEQ ID NO: 21759 - DNA, 401 bp, Homo sapiens
  misc_feature 278: n=a, g, c or t
  misc_feature 279: n=a, g, c or t
  misc_feature 348: r=a or g
tagagcccacagttcaccaggagttgcagatacttttcagagcagcactttagatgaattttctccacctataatgtgtatgctaatcactggttaaaatgcagattcagattcagaaggaccaagatggagcccagttttcaatttttaaacaactcccactggatgccaaaattaatgccgctggtctttaaactgcagtttgagtaacaaagatacagatgatgattctcagtagggatatgggaagatgaatactttagtcttcccaggatggnngggtacttatctttaaattgttattcctacctcccctacaaaatccacatttcttacatagaccaagargccctttttaatctagccttgtgtgcaccaacttcttacccactagccacact

SEQ ID NO: 21760 - DNA, 65 bp, Homo sapiens
caaataaaaaattttggtcatttggtactgactttctctctctctctctctcccttttttttttt

SEQ ID NO: 21761 - DNA, 172 bp, Homo sapiens
ttgctttctaagacacttactttcatcggcactttcagatttttgaattatactttctcaatttgatttttcaagtgagttattaggatataggtgggagtggagaatgcctgcctgcctttcttcctttgtcattccctctctcctttctccctcctcccctccctccata

SEQ ID NO: 21762 - DNA, 208 bp, Homo sapiens
tacaatattggggatgtttcacccccaccccagtggcctcaggtacacgtacaggattgacaggtgagcagttgctccccgcccctcttcccttttggctggggcacatggctgcgtctgctgcatgtccgtgccaaacacacacacacaggccaacagccacgcagggcaaaaatgaaccacagccactacccaggccccacggcga

SEQ ID NO: 21763 - DNA, 163 bp, Homo sapiens
  misc_feature 134: w=a or t
  misc_feature 135: n=a, g, c or t
ggccgggcgcggtggctcacgcctgtaatcccagctctcagggaggctaagaggcgggaggatagcttgagcccaggagttcgagacctgcctgggcaatatagcgagaccccgttctccagaaaaaggaaaawnaaaaaaaaaaaaaaaaaaaaaaaaaaaa

SEQ ID NO: 21764 - DNA, 192 bp, Homo sapiens
  misc_feature 2: b=c or g or t
cbcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccccgcccct

SEQ ID NO: 21765 - DNA, 140 bp, Homo sapiens
attacttatgatttccctgttttttcttcctataaggaagctgaggcacaagttaatcaaagtctcttggcctagggtgacacagctaagatttgtacctagagatttctgagtgttgacttctctcctgcccccactcc

SEQ ID NO: 21766 - DNA, 431 bp, Homo sapiens
  misc_feature 8: m=a or c
  misc_feature 15: n=a, g, c or t
  misc_feature 16: n=a, g, c or t
  misc_feature 34: w=a or t
  misc_feature 106: d=a or g or t
  misc_feature 359: b=c or g or t
  misc_feature 360: n=a, g, c or t
  misc_feature 361: h=a or c or t
  misc_feature 430: m=a or c
aaagagtmatcaacnnggaaaggaaacaaagagwgcttttgggcatccaacagttaatcacttatgtttttagagcatgcaatcttaactttgttaaactattatdattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacatbnhggtatgggccctcctcagtgactttaactagctcagaaacgtactcccccaccaaccccacctcaccgmc

SEQ ID NO: 21767 - DNA, 292 bp, Homo sapiens
aactcaaaatgggtcatgttcttactgtaacatataaaactgaaacttagaagcaaacaggaaatcttgagcaagggttaggccaactggcattaaaattccttaaaaaaacattgaattttgtaaaaaataaaaacattttgtagaagaccctgttaaagaggatgaaaaggcaagccataaacggaaaatatttgcaagcacatgttcaacagaaaacttatgtccagaatatataaagaacttgcaaaatttattaggaagaaataatccaattagaaaatgggcaaac

SEQ ID NO: 21768 - DNA, 124 bp, Homo sapiens
ctccccgcaatccctcaaaccttgaggagaagtggggaccccacccctcatcaggagttccagtgctgcatgcgattatctacccacgtccacgcggccacctcaccctctccgcacacctcca

SEQ ID NO: 21769 - DNA, 178 bp, Homo sapiens
acgtagcccgccactcctcccacacacgtgagccagccattgcctgacaggctctgccactttctctgcactggttcagcctggtaagtgttccgctggcagcgtggaaggcccgcacactgacctggaagaagctggaccaagaattaggagcccaggaaccggagcagacgagaca

SEQ ID NO: 21770 - DNA, 229 bp, Homo sapiens
ttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagccttg

SEQ ID NO: 21771 - DNA, 390 bp, Homo sapiens
  misc_feature 114: r=a or g
tgctggaagtgtttggcctttggggcaaaaagctggtgttgcaccttgaccgccttgcttattctgtgtaccagcaccgcacctcccttcacactcatgcatgcaaatgacagragaatcttcaaatgcaattgtaggccagcaatcaattggacacctctattcaaagttttactgttttcctggttgttcccttagatgaacttggcatatcaaacttgggtgctgaccactgtctctgagaatagaaaatagcagaccgggcacagtggctcacacctgtaatcccagcactttgggaggccgaggagggcggatcacctgagctcaggagtttgagaccagcctgggcaacatgcgaaaccccatctctacaaaacaaacaaacaa

SEQ ID NO: 21772 - DNA, 105 bp, Homo sapiens
atacaagtctgagcaagtacatctcttgcaggttttccacatgaaaaggaagccaaataagtcctgttaggagattaggtgagaggaattagcaatgtaggggta

SEQ ID NO: 21773 - DNA, 460 bp, Homo sapiens
  misc_feature 113: r=a or g
  misc_feature 201: r=a or g
  misc_feature 254: r=a or g
  misc_feature 261: n=a, g, c or t
  misc_feature 262: n=a, g, c or t
  misc_feature 263: n=a, g, c or t
  misc_feature 312: r=a or g
  misc_feature 313: k=g or t
  misc_feature 405: r=a or g
tttggctattggttttaagcataggatatcagtattatttgtatacagcgttatataaaatctaaccaacttcaatataagaatagtacttgattttaaatgttaatatgcaratattaacagtatactacatcatattttatgtgttcatatattgatctttttacttaacaaaaagcctgttagaaatataacccactratgacccgagtccaattagctgaaaaccttctgtagaaaggtgattgtatgaraaattcnnncaacattaaaaaagggaagtggggagggaatacaaacttgaacaaaatrktcttaaatgaagttgcatctctttttaaaattaagatatcattcatgcaccatacggtttatcctattaaggtgtaaacttcaatgtttttratcatattcactaagttgtgcacatcaccactccctaacttcagaacactttcat

SEQ ID NO: 21774 - DNA, 170 bp, Homo sapiens
  misc_feature 15: s=g or c
  misc_feature 16: s=g or c
gtagcggcgcgcgassggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagagta

SEQ ID NO: 21775 - DNA, 133 bp, Homo sapiens
aattaaattcataaatcccagaacagtctttttttttctttttcctttacaccctacttctgagcttaattcagttgatgttatgtccaaattcaggctgagtgctcaggctgaagcaactctgtagcccact

SEQ ID NO: 21776 - DNA, 282 bp, Homo sapiens
  misc_feature 115: r=a or g
  misc_feature 119: k=g or t
  misc_feature 120: k=g or t
  misc_feature 122: s=g or c
  misc_feature 128: r=a or g
  misc_feature 131: k=g or t
  misc_feature 139: r=a or g
  misc_feature 142: k=g or t
gtgtcaatgaaaagaatcaaactctgtaaaatatttaaagaagtctattctgagcctaatatgagtgactgtggtccaaggcacattctcaagaggtcctgagaacatgtccaarggtkkcsaaggtrgckgggttatrgtktggatttatactttttagggggatggacataagacatcagtatatgtaaggtgtaattggttttgtctgggcagacaggactactcaaagaggtggggcttccaggtaacaggtggattgaaagattttctgatgggcgc

SEQ ID NO: 21777 - DNA, 91 bp, Homo sapiens
atacataagtattcaggatacaagttttttatttttagactttctttggtcatacctgtttttttgtttgtttgttatttttgcagggcac

SEQ ID NO: 21778 - DNA, 201 bp, Homo sapiens
  misc_feature 7: m=a or c
  misc_feature 141: r=a or g
  misc_feature 145: w=a or t
  misc_feature 185: r=a or g
  misc_feature 186: r=a or g
gttaagmgaaatgtgcaattcgatcctcaatcagtgggtggaggataacagggtagattcacttgtgtgcacttgtacagttgtagctgcgagtccagaagtcctctagagcatgtgtactggcactgagttggtgagacrgttwgtggagtatcccattctgatgagtacagaaaaaaaaagarraagaaaagaagagaa

SEQ ID NO: 21779 - DNA, 215 bp, Homo sapiens
ctgtattccaaaacctgctgcatcataataaatatatctatatatatttagcataagacgtgatatttttaatttcttttttaaaaaaattatatttgtctcttagagttaaaattttctttatataatattgtcatatgtcatagttttaatacaattcacatgagatctatgtttcttaatgatattttgttgtgtaaaattgatcggattcg

SEQ ID NO: 21780 - DNA, 124 bp, Homo sapiens
tcgctctgtcacccaggctggagtgcagtggcccaatctctgctcactgcaacctctgcctcccggcttcgggcgatccttctgcctcagcctcctgagtagctgggactacaggtgcacacca

SEQ ID NO: 21781 - DNA, 395 bp, Homo sapiens
  misc_feature 130: v=a or c or g
caaaaccaataaaacaaaaatggaaaaccagcgtttatgaaatctccttttgccttccatgaggattacaccatctctttttctcctattaacatatggagagggctgggtgcggtggctcatgcctgtvatcctagcactttggggaagccaaggcaggtggatcacttgaggtcaggagttaaagatcagccttgccaacatgatgacacctcgtctctactgaaaatacaaaaattagccgggcatggtggcaggcacctgtaatcccagctactcgggaggctaaggcagaagaattgcttcaacctgggaggtggaggttgcggtgagccaagatcatgccaccgttctccagcctgtcactccggggtgacagagtgagactccgtcta

SEQ ID NO: 21782 - DNA, 284 bp, Homo sapiens
  misc_feature 128: b=c or g or t
agcagacgactcaccctgggccgggggtgaggcttggtgggtgccaggggtgctgaggaggccaaggagggcactgggagctccgttccgggagagctgtctaaggacgcggaaccgggtggggaggbagggaggtaaccaagagtccgagccgggcctggaaattctgaggaggaaaccgggaccgcggtatccagacgctccgatctgtacgagccgggcctcgggcgtggtccatgggcgtgaccttgagggtgacccagcgagctccgcgaagggggtac

SEQ ID NO: 21783 - DNA, 227 bp, Homo sapiens
  misc_feature 68: m=a or c
  misc_feature 217: w=a or t
tacatagctttatgctatcaggttaaaccacaaagtaaaatttctccaatattgggatactgcaagtmttaatgttacctctactggtcacagagtattagaaaaacctgtcagtactacaatgtggattataggtaagaggcagaaaacggcaactgtgacacgtacagatttatttggataataaaactgtcatctgatttgttagatatttttwctccccccaa

SEQ ID NO: 21784 - DNA, 432 bp, Homo sapiens
  misc_feature 3: m=a or c
  misc_feature 323: m=a or c
aamacaggactttgcgtccgtcagtgaggataacaagtctgtcattggatagatcctaagtgaaattagatataaaagagaaatgaattgaatttactggacaacattcttcagatctgctgggacatattttcattttctgtgagtactggaatggattgggacaaggtacgtgttaaaactttaggctagacagaacgtgagtattttatcctagcaaaggtcagctcccaaagactgtggaatgaacaacaaggagatgtgataaataattaaggactaaatgtaatgcaaagtatttacttctgctttcttagtaatamgtattcctttggaacttactggaagccacaggctgttttgcaaaccaattatttcagtgggcgtttcattttcttacatgtacgatacattatgcaggtagaaatagca

SEQ ID NO: 21785 - DNA, 199 bp, Homo sapiens
caaaaaatccatatactaggtactcaaatacctgttagttgacccttcccctatgatgtgaactggttattcacaactatctttatactttaagtcctgttcctaaacacacactgaggttctggagggcagggctgggtcttaggtaaatttgttctgctaccttctcactggacacctggctcacccaaagcttgcc

SEQ ID NO: 21786 - DNA, 175 bp, Homo sapiens
gcagatcgtagcccgggcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcata

SEQ ID NO: 21787 - DNA, 412 bp, Homo sapiens
  misc_feature 1: v=a or c or g
  misc_feature 24: m=a or c
  misc_feature 47: k=g or t
  misc_feature 339: k=g or t
vctaaaaattcataccggaaggamagaatatgaatgtaacgaatgtkagaagacatttaaaagtaattcaggcctcattagacatcggggatttcactctgcagagtaatcctggaactacattaaagtggggggaatttaattcaaattgtcagttactgaaaccctgggatgtaaacttacagtattgatcagtagctgcagctttcgtaaattggcagttaggaaaaatattcttttgcccattcatccctcttcttttcaaggatggcaacgactggtaaacagtaattagttggtaaagtcactggaaagggaagaatgcaaaatgattctgakgccagacgaattggaaaagctcttttcttcaggggatttctctctgatttcttctactaccatgtagtgtgat

SEQ ID NO: 21788 - DNA, 53 bp, Homo sapiens
  misc_feature 11: m=a or c
  misc_feature 15: s=g or c
tagcaatatcmcttsgagaaagatctttcaacacacacacacacacacacaca

SEQ ID NO: 21789 - DNA, 400 bp, Homo sapiens
gctgtaaattgtcagagtgataaatttacacttcgaatattgaggaggaagtctatctttacctctgataagctgagtttatatagcttgtatttgttaaggaacaaaagatgtgaagctcttattcttgtgttactgtttagtggtgctctgctctgccactggagtatggtaacatcttcatatcttatccagacttgttaactgtacacctctcatgcttaataacagtttagctttctgctcatattgctggtattttgaacacaagatactttttggacgcttgagttgtggttttccatttttcattggagatgatcagagtttgagcagcattatggaagaataatgttgtaacaactttctcctggaaatcacttcgagttctaaaccatca

SEQ ID NO: 21790 - DNA, 118 bp, Homo sapiens
ggaagaaaaggattgagaactttaagagtggtgtggatgcagactcttcttattttaaaatctttaagacaaaacatgactgaaaagagcacctgtacttttcaagccactagaggga

SEQ ID NO: 21791 - DNA, 64 bp, Homo sapiens
attccgaagaaactgcctttggtatgtaggctggagcaaagactccaaagcctcccctcgatct

SEQ ID NO: 21792 - DNA, 209 bp, Homo sapiens
  misc_feature 177: k=g or t
  misc_feature 178: w=a or t
tgaataaagatttcacatgaattttttaagatgaaacatgcttcatgcatgcaggtttctttgggcgtattcatgcccactccctctggttggagctttgtcagagaagtgtgagcagttctttcctaggccataggtgaaagatgcgcatgacacgcttagcactgtccttgcggkwcatgaggcacatacatcttactgccccgttt

SEQ ID NO: 21793 - DNA, 223 bp, Homo sapiens
ctgatgggcaagtggccaaaaatgggcgagaccatggggctggagcaaggggcgctttctctgcctactgggcctttcctctagaagcagcggaaggcgttctctgggctggagttttctcacctgtgcagtttttggagctgacttgttttccttgcatgcaactgtggggagctgtggattctgtaacatgaagctttgtttcctctgttgcccaggccct

SEQ ID NO: 21794 - DNA, 191 bp, Homo sapiens
taactgacagcctagttagaatcaagtgcccaaatcgctctgcattagaaaatacaaaaactagggaggaggaaggcaatcaagaggagagcaattttgcttgaatattagctctccagttgatggaatgagtcagaacattttagaaacagacaattgtaatataaaattataagttgttagtgaggtaa

SEQ ID NO: 21795 - DNA, 244 bp, Homo sapiens
  misc_feature 91: m=a or c
agaagcgctcgcctgttcacagccaacggagggtacggtataaaagtcaagccaggctgacattcacgtttcattctgccacactcgggamggtgatcggggaagcatggggattccgggagaagcacccacaaaactagcatcctcctggaggagctcgggaataggatgagtgataatccacccagaatggaagtgtgtccttactgtaagaagccatttaaacgattaaaatcccactttg

SEQ ID NO: 21796 - DNA, 195 bp, Homo sapiens
tggttagatgacttctgctgagggaagggattttagtttttcctagttaggttacttaattacctaatagatgccaaatacatgtttcttaagttaggctattctgtagattaatatctcaactgagatgtcttacaactttaaaactgtaaagattctatgattctaaataacagcatttcccacactgggccg

SEQ ID NO: 21797 - DNA, 328 bp, Homo sapiens
  misc_feature 20: v=a or c or g
  misc_feature 21: m=a or c
  misc_feature 48: r=a or g
aattaaaactcttaaggtcvmttataaatgtagaaaaaaatgcaaaaraaatttaaaaatatttagtacactgtaatttaaaacattaaaaatagaattaaagtgttttatttcattgtgaaaactaagtagtttgaatagggattgcctttttttttctgccaagtgacttatgatactgagtaagcatcttttctattcatggcaaactgtcatactccttttaagtttgggtgagcttccagccttttattgcttgtgctttcaatgttgtgaagtatttctgtattcacattaaatgctctttagtgtgaagtttgtttttttt

SEQ ID NO: 21798 - DNA, 94 bp, Homo sapiens
tgctttcctttaagttccaacctcagtctgcaacagggtttcgctcttgtcacctaggctggagtgcaatggtgcgatcttggctcacttcaac

SEQ ID NO: 21799 - DNA, 125 bp, Homo sapiens
accattatgtaatggcctactttgtctcttttgatctttgttggtttaaagtctgttttatcagagactaggattgcaacccctgcctttttttgttttccatttgcttggtagatcttccatct

SEQ ID NO: 21800 - DNA, 151 bp, Homo sapiens
aataggaaactcctgacttgccttaaaaagccctcattgaggccggacgtggtggctcatgcctgtaatcccagcactttgggaggccgaggcaggtggatcacgaggtcaagagattgagaccatcgtgactaacacagtgaaacccctc

SEQ ID NO: 21801 - DNA, 234 bp, Homo sapiens
  misc_feature 7: y=c or t
tgtattyatttaaataattgaactatcaaatactgttctgaaaataaaacctctctaggataatttattgatgcttatttgattgctataacagaaagtcaattattgtacaatttgaattgtaatgatgtgattatttgtgccatgtaatgcatgtaaaatgtaaaatctgttttcaaaactagatctatttaaccaaagactatttcattcctgatatgatttgtgtgctgt

SEQ ID NO: 21802 - DNA, 268 bp, Homo sapiens
tgccttagcctcccaaagtgctgggattacaggcttaaggcctgcctgttatatattttttttcattgttgagttttgagagttctttgtacattaagttaattaattaaaatttttttagagacagggtctccctctgtcacccagattggagtacagtggtatactcgtgatgtactgccaccttgaactctggggctcaagggatcctctgcctcagccttctgagtaactaggactagagttatacgccaccgcacccagcaac

SEQ ID NO: 21803 - DNA, 268 bp, Homo sapiens
ataacttctggatctccctcctctgacactcaatgttcttgattttggagaaagtcaaactactgccacattcccccaaactcaaatacagagttattgttgtagtttaagattcaagtaatgttccaggcaacatttctttaatcactcacgatccacagtgatctttcatttagctaaaactctagattcttttcacctaaaagactatagctagctccttctatcattctattgccctagtggacttttaaatttaactccaccc

SEQ ID NO: 21804 - DNA, 375 bp, Homo sapiens
  misc_feature 137: h=a or c or t
  misc_feature 339: r=a or g
  misc_feature 340: w=a or t
gtagaatcatggggttattttatttgtttctttgtttgttctgataagtaattaatttgcttaaagccaaactatttatttgtctacacatggtatgcagtagctgatagtctgcttagctttttaaatgtcaagchgccaattttatagtctgactccctgagggtcttctgagcctgtgtagtttattttcagccaaagatatggatggggtttatatgcaaatttggagacattctttctgtggttctcttgcttctattgattcataaattttagttgcttttccacccctgagctttgtcctccttgtaagacttcagctctctgcctcccgarwtgagtgcatattctggaatgcacccaatcaataaa

SEQ ID NO: 21805 - DNA, 193 bp, Homo sapiens
  misc_feature 85: r=a or g
  misc_feature 154: r=a or g
  misc_feature 174: s=g or c
catcttagtaatactgacgtgattttgtgattgttccccttgggtgttaggtatgatattcttaattgtaactatgatataataragcaaaccttgaactaccttttctaacatcacacatgctcaacaaacacacacaaaccccatatatatrattgagatgtacacacactsacacacacacacacacaga

SEQ ID NO: 21806 - DNA, 276 bp, Homo sapiens
  misc_feature 276: r=a or g
attataaaaaatctcaaacacatacaaaaaacagaatagtataatttctccttacctagttttaacagttatcaacattctgtcatttttaaatcatctatagtagtgtttttcaaccattttttcattattgtcccttcaaggagccttttagatatttttttctgatcaccacccccatgaaattttaataccaaagatatactgtaaatctctttatgaactgtatgcatatatatgctttatctgtaggaagagtttctttcacaccccgar

SEQ ID NO: 21807 - DNA, 92 bp, Homo sapiens
tatgccaacatgcccggctgatttttgtatttgtagtggagacagggtttcgccgtgttgcccgggctggtctcaaactcctgacctcaagt

SEQ ID NO: 21808 - DNA, 158 bp, Homo sapiens
gtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggttt

SEQ ID NO: 21809 - DNA, 282 bp, Homo sapiens
  misc_feature 117: r=a or g
  misc_feature 118: w=a or t
  misc_feature 127: w=a or t
ccaaattcttaagtctgcctctggtcaagcatgttaataaaaccaggtgaaacattttaattgcttttcaccttctcatctaggcttcagtgttaactatcatttgcgtctgaatgrwggtgaaatwataacatacggtgcattaagacaggtcttcatttagggggtgatcatcagtagacattcactgtgtttctactctagtgaatagtagtactaccacaatgcctctatcaatgtgaccagcaatcccatcagaattccatcgccaataccaccacc

SEQ ID NO: 21810 - DNA, 203 bp, Homo sapiens
  misc_feature 93: w=a or t
tatcttggtgtaggatgtgatgtagctatccacatttttgtttccttccttccttccttctttctttttctttctttccttctttctttcttwtgagatggagtctcgctctgttgcccaggctggagtacagtggcgtgatctcagctcaccacaacctccacctcccaggttcaagcaattctcctgcctcagcctcccaa

SEQ ID NO: 21811 - DNA, 87 bp, Homo sapiens
agttcctcacctctcagttggacacgtgtctcctgggcagagccaagacctgtgagaggtctgacctgcgtccccaccgtgccccca

SEQ ID NO: 21812 - DNA, 289 bp, Homo sapiens
tgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgagt

SEQ ID NO: 21813 - DNA, 97 bp, Homo sapiens
  misc_feature 25: d=a or g or t
  misc_feature 75: k=g or t
  misc_feature 76: y=c or t
  misc_feature 83: k=g or t
  misc_feature 92: k=g or t
atatgcgggggcctcggctggagtdagcggcgtggacgcctctttcctccggctcttcccttgttgctgcgagakygagaggkccgcgggckgcgga

SEQ ID NO: 21814 - DNA, 247 bp, Homo sapiens
cttagccaaggcagggaaagacaggctaggcctgctgagtgctatcaatggttaaacacacagcccctcactcctcccagatctctgcccctgacaatgaaggggagccaagcgtgaaacacagccagtgagcagatggagaccacccccatccaaccctgaggagggaggagggggaagcagggagtcaaatcccatatacagggtttcctgggctaagtgaaaattctagaagacaatgacgggt

SEQ ID NO: 21815 - DNA, 54 bp, Homo sapiens
tgttaatttattaaacagagtgcaaagcccttggaaatgtcactgcttggcaat

SEQ ID NO: 21816 - DNA, 150 bp, Homo sapiens
  misc_feature 2: s=g or c
  misc_feature 108: s=g or c
asatcgggcggaggaactgggctgctggtagggcctgacaggttcaggagagggttggaggcttccccgtgccgccccttgaatagtgatttagtactgttatctgasgttcactttcacccctggctcctcctccgtctactacccggc

SEQ ID NO: 21817 - DNA, 194 bp, Homo sapiens
attgtatcgttcttatgcctttgcatcctcatagcttagctcccacatatcagtgagaacatacaatgtttggttttccattcctgagttacttcacttagaataatagtctccaatctcatccaggtcactgcaaatgccattggttcattccttcttatggctgagtagtatcctatatatataccacctgc

SEQ ID NO: 21818 - DNA, 244 bp, Homo sapiens
  misc_feature 125: k=g or t
tcaaggtaaccgaatactgttaaagagaagctatttgcagaataattctgaccaataattatgtaaaaaaaaaacctgaatctcatcattttgcaacctctgatgatatcacggatttaggtatkgctaaaaccatcaggtgatagatgatcaggctgataacacgtgcacctgctgccaaccttaacataaaaaataatactaaattcccctgtgaagcctgcatgtgcccccaaacccccaa

SEQ ID NO: 21819 - DNA, 161 bp, Homo sapiens
cataataggagcttctcccttttcttcttctttctgaattttataaaagtaacaacaaaattgatgtatatgtgtgtataaggtaataagcttaatcttttagctaaatgtacaaacaaatgagtgctgttttaccaagtaattgttagcaagcaggtctt

SEQ ID NO: 21820 - DNA, 191 bp, Homo sapiens
  misc_feature 10: v=a or c or g
catatttttvttgtggcaaaatatacttaaaattgatcattttagccgtttaaaagtgtacaattcagtggtatcaaatacattcacagtgttatgcagccatcaccactattcattttcagaacttcttcatcatcccaaacagaaagtctatacccattaaataactccttattttctgtcccccaaga

SEQ ID NO: 21821 - DNA, 156 bp, Homo sapiens
tttttcttgaaacaggtattgactgagcgcccagtgtatgcctggcactgggctgggtgctgccacctaagcgagcacgaccaatgcaagtctatcagggacgccctgaccgccaagcagctggcccctgcagtccgccatgccactcccgacggt

SEQ ID NO: 21822 - DNA, 168 bp, Homo sapiens
gaacaccctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaatt

SEQ ID NO: 21823 - DNA, 134 bp, Homo sapiens
  misc_feature 8: b=c or g or t
agttgtcbtctctgtgaggtgggaatgccggtgaatcctgccgctggcgtggatgagaagtgaatgcgtgctcggagctgcgagtgacagcgggcaggaggcgcccagggacacttggtttctccagggccgtc

SEQ ID NO: 21824 - DNA, 151 bp, Homo sapiens
ctactaaaaatatgaaaaattggccgggagtgctggctcacgcctgtaatcccagctcttcgggaggccgaggcgggtggatcatggggtcaggagtttcggtccagcctggccaatatggtgaaaccccgtctctactaaaaaaaaaaaa

SEQ ID NO: 21825 - DNA, 126 bp, Homo sapiens
tttgtttccgattgttttccggtggcgagcccggctccgaaacttacaaagtgttggatgtcccccgttcgaactgagggactgcagaccgcctctgggtagctggatgaagcccaccccgtcccc

SEQ ID NO: 21826 - DNA, 172 bp, Homo sapiens
ctaagaataaatataggagtacatcttcgactttactagatattgccaatttgctctccaaagtaagttgtgctaatttatactctcaccatcaggtataacatttctcattgctcaatatccttgccaatgattgatgttgccagactttttaatgtttgccaatccgatg

SEQ ID NO: 21827 - DNA, 188 bp, Homo sapiens
taaaatgaaggttcaggaattagatgtggagactaaggacgatgccaagatttattctatgtctgtgctcagcctaaattgggctcaaaaggaagaaaaaggatgaggaattactacacattattcgcttctcctgaggatgacggtaagatgacctaatacaatcaggggcgaatctgaggccagaa

SEQ ID NO: 21828 - DNA, 238 bp, Homo sapiens
tagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgaccc

SEQ ID NO: 21829 - DNA, 202 bp, Homo sapiens
gagacatgcggacatgggaagagacagagacacagagaaagcagagacagagagagacacaggaaagctgagacaagggagagaggcagagacacagagacacagagaaacagagatggcgcaagaggaaaggagagagaaacccaggacttagagacagagccccggagagactccgaacagaccccggcacagagacggc

SEQ ID NO: 21830 - DNA, 182 bp, Homo sapiens
actaaggaaggaaggaaggaaggaaggaaggaaggaaggaaggaaggaaggatacattcatggaggcactgttctagacactttggtatcaaaactgatttactccagacaacaaccctaggtgggagatgccattacattctactctatcactttacacagaaggaaaccgaggcacagaa

SEQ ID NO: 21831 - DNA, 232 bp, Homo sapiens
  misc_feature 150: v=a or c or g
aaggaatctaaactacttgtttttgtagttagctctgtcatttaaccatagtctaattatccagctctatatattaccataaaaaatctttaaatgtacaccatgtaacaacacttatcaacctaagaggaatgccaattaatgcttgcvaaggcactctaagattttttttttacaagcaagtgctatataacaacaaaatatctattactattctatctttccaaccaaa

SEQ ID NO: 21832 - DNA, 110 bp, Homo sapiens
cttgggtgcagtggtgcgatcatggctcactgcaatctctgcttcctgggttcaagtgattcttttgcctcagccacccaagtagctgggactataaacacaccgccacc

SEQ ID NO: 21833 - DNA, 129 bp, Homo sapiens
agagactggagggacggacctgcaggagccagggctgcccgccgagctgcagttgccgctactgccgctgtcagcgcccgactgaagagtgacagccgcaaaagcaggagtgagcaccgaaccccggca

SEQ ID NO: 21834 - DNA, 190 bp, Homo sapiens
  misc_feature 139: h=a or c or t
  misc_feature 140: b=c or g or t
ctggatctacaaacagcccaactccaaggaatctggcatctctcagtggagcatacaggtgacttcataatctaaccgcattagtaactgccaaaatcggaagtaatttctctctgtttaaaaaggcagtgaaacaaahbttcagagcaggtttcttcaactgaacaaaatattttggaccttagaggtg

SEQ ID NO: 21835 - DNA, 167 bp, Homo sapiens
tctttttttaaatgtgcagatactacagttgtagtttgtgaaattgcttaatttttttcttatcagaaagtaaagaggactatatctagtatatagcacacctgtgtccatagtatgtgctctgtacttgatcacatgcagtattaatattatttaacacggcagct

SEQ ID NO: 21836 - DNA, 228 bp, Homo sapiens
  misc_feature 85: s=g or c
  misc_feature 123: k=g or t
catcctcatcttcttcctctcttgttactttggatatttgctgaaaggtcgtcagttgctccacacaacttataaaatgttcatsgccgcagcaggagtagaggtcctgagcctcctattttkctgcatctactggggtcaatatgccaccgatggcattggcaacgagagtgtgaagatcttggccaagctgctcttctcctccagcttcctcatcttcctgctgat

SEQ ID NO: 21837 - DNA, 247 bp, Homo sapiens
ctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcac

SEQ ID NO: 21838 - DNA, 363 bp, Homo sapiens
  misc_feature 7: h=a or c or t
ggaggahgcaagacatgaacttggacagtcccttcgtctctggaaccttccagcaggtcatgaaagctcagagcagaacgccgtgcccttcctgacagccctctgcctaatccctgccatcatgctgcattttcctctagggcaaaaataaagcagtcattttcatgctttgcaaaatagttcaagctttttggatttccttgcatttttgtagatgattggatttggggatgcatttgaaaagccattcccagaacagcagcaaaatggaaacagccatttggatgttataccaccttcccttccaaaatggccacacgaataaccagtgcccgactaccaaggggcaccaacttcacccca

SEQ ID NO: 21839 - DNA, 173 bp, Homo sapiens
agagagaagagctttcagtggggccgcttgctgcctggctcaagtggtgggaggtgtgttgtgcatgcctgtgtgtgtatatgtgtgtgtgtgcccctatgtgttcatgcacacatgcccttcactcgccgaggatttgactgctaaaagaaagatctactttttccccaacc

SEQ ID NO: 21840 - DNA, 354 bp, Homo sapiens
tgcctgaaatcctttaggagttcttgtagtactaatacttccattaaaaccactccgtagcatctgttgagctgtatgtgtcaggcactgtgctaagtgttttacatatgctctctcacataatctttatagcatccttatgactagactgccttcttattcttatttttactcatgaagaatctgaagcagtaaagttattttcttgcccaagcttacacaacttgttagtaagtatacttgaactccgatctacctgtctgactgttaagttcatggttttaacaccacactgcattattataaagagattagaaaaagaaaatgggcattaattttacttattatagaatt

SEQ ID NO: 21841 - DNA, 147 bp, Homo sapiens
tatgtcttaggttatctttgaagctacttatctctgtattagggaaaagtcagtactttttgaaaaatcaatgtcgatgaattatggtgggatatttggctggaggcactgattgtattagctgccctattaggggatgtctagaga

SEQ ID NO: 21842 - DNA, 404 bp, Homo sapiens
  misc_feature 129: m=a or c
  misc_feature 130: n=a, g, c or t
ttcgccgctgcgttggggaacctggaccgcggcggcgccggggtttccctcatgatcccgggcgggtggcggcggcggcagaggcggcgggaggatgacctcttaccgggagcggagtgccgacctggmncgtttctacactgtcaccgagccccagcgacacccgaggggctacacagtatataaggtcaccgcccgggttgtttcacgaagaaatccagaggatgtccaggagggagaatcctgaaccaacctatccatgaacatactctctgccattttcttagtccttttttcgggaaaactcttttataataacaactgttggtgaaccattcatctgaaaactcttataattgtatggaagagatacagtgattttaagaaactacacaaagaactat

SEQ ID NO: 21843 - DNA, 397 bp, Homo sapiens
ccctgtgaaggagctttgtccttagggcctcaacactgcggccactcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcgga

SEQ ID NO: 21844 - DNA, 97 bp, Homo sapiens
cttgtttatcgcacacaataaatccaccttataaattattgattgaaccaataaaacctatcaaaacaatttaattgaatacacatacaccacgccc

SEQ ID NO: 21845 - DNA, 86 bp, Homo sapiens
tgaatggatttttaatgtattacagaatttagttttttagtattttgttgaagattttttcatcatgttcattagtgatactggct

SEQ ID NO: 21846 - DNA, 421 bp, Homo sapiens
agaaaattggggtagaaatgataagaaaatcgaggctccctcccccaggatgctcaaaaataatagcagcagtgcaggacgtccctcaagcaaataggatagagaatggggtcaagttgcttggatattaaagaaacccatgaccccataagattggaatagatagggtcaacttaggttacagggttttcagtgttctgagaaagtgaagaggtgcttctcctcaggcttattttggaacttctactggttttcccagtgagaacattttaacaaataatcctgttgccgtcagcctattttataaacaccttttgctatcaacctgtcgtgtaaatatgtggtcaaagaaagatcagttccaatgggtttttttctttatggcattatgttctggaggcgtgatatgaagccaccccat

SEQ ID NO: 21847 - DNA, 329 bp, Homo sapiens
  misc_feature 3: s=g or c
  misc_feature 4: k=g or t
atskcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgc

SEQ ID NO: 21848 - DNA, 399 bp, Homo sapiens
  misc_feature 385: m=a or c
acgtgagattatgtggatgctatgcctccttgcacctggacagattgtttttctggtaagtaggtggccctattataggtggcagctgtgttccagaagaaacaaagtgaagctgttctcagggtgatttctggagaaaactactgtctcctgaaagcatgcatagaagtcagtgctcactcttgctaagccacatattccttaacgatccggcttaatatttttaaaagatacctcctcaacccctatacctgtctcaacaatactgtcttcaattattaggtaaggccttgtcattaagagaggggtaggagaaaaaatagaataataaggaaagtgaagaaaggagatattaatttcctaggattccaagaaaacaagtgtmacgtggaaatatat

SEQ ID NO: 21849 - DNA, 167 bp, Homo sapiens
tttttctcatgctgttaatctgaacttaaagaattacttatcagttattagaaagtctaattatacagactgcatcctagaaaataaactacaagcagaaataaatcttaccttacttattaagaaaagttgtatatttatctatatgaattttattaggggaagat

SEQ ID NO: 21850 - DNA, 107 bp, Homo sapiens
acatcggtccgtcctgcttccagctgctgcagcgcgccttcgccgccaaagcatccagcagccccctgctccggcccagcatggcgaccccgacccagaccccccaa

SEQ ID NO: 21851 - DNA, 154 bp, Homo sapiens
taattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatta

SEQ ID NO: 21852 - DNA, 179 bp, Homo sapiens
  misc_feature 13: s=g or c
aaacacgccaggstcccaaccactacaccagccctcagcgcctcagtttcccgctccagcctgcgaatgggctccggggacgtccaaggcgaggcgccagagaagccacatcaactcagctccttactcgactcctgcatgggcgatacagtctcgccccaacctctctaagaaccccc

SEQ ID NO: 21853 - DNA, 196 bp, Homo sapiens
aaggcttcagtcaaacatttccttttaaactatccatttgttttttctcctcttatttcaaataagtcgagtcctgtaacgaagaatttgtttcctacctagcatatccttttaaaattctatcattccataacttataattccttctgcaggtccacttagccaaaagacatacgtcttttttctttttcttttt

SEQ ID NO: 21854 - DNA, 308 bp, Homo sapiens
tagcagtgtgagaacagactaatacacacaccaagtcatttatgagagatctgcccccacaacccaaatacctgtcattaggccccatcttcaacatggggatcagatttcaacatgagatttggaggggttaaacaaaacaaactatagcaatggtattttgttgtagcagcctgaatgaactaagacaagctgctatatatattttttcactggttcattatttgttcatttagaaaaaaatattaagcactaactgcatcaggcagtattttgggcataagaaagtcaagataaaagatcacaaa

SEQ ID NO: 21855 - DNA, 218 bp, Homo sapiens
  misc_feature 65: k=g or t
aaatgaattaggtctattaggataattaggagtttgatcccatcaacactattcttgtagcagtkaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagc

SEQ ID NO: 21856 - DNA, 351 bp, Homo sapiens
caaggttagcgtgaaaatgacagcccccttaggctgccccctttggcactgagctctagggacacagggaaataattccagcctgttatctgcctgtgaaaagttcttgcttggaaatctcactttgatgtgtgtgtctgagccgggtgctcagtccggctattgtttgcgagatggagtcagacctgccggtggcatcttgtttactttcgtctccggctgctcagtaggggatggagatttgaaatagtcgccaagcctctgccacggagcctgtgctccccgttgattgcaaagggtaatgattaaacaggtcatttgaaaacaaaagccaacagctcggattctgaa

SEQ ID NO: 21857 - DNA, 270 bp, Homo sapiens
  misc_feature 21: h=a or c or t
tggataattttgaagtgtgthcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcaaaaaaaaa

SEQ ID NO: 21858 - DNA, 111 bp, Homo sapiens
gtgggccagccatggagcacatccgcacgcccaaggttgaaaatgtccgcttggtagatcgagtgtctcctaaaaaagcagctctaggtactttgtatttgacggccgagt

SEQ ID NO: 21859 - DNA, 255 bp, Homo sapiens
tttgaaagtctaatgttaaccagaagtcttaagataatgtaaatagttgagtaacacatattttgtatgctatatgtattatatactgtattctttttaatattattattattattattatacttgaagttttagggtacatgtgcacaacgtgcaggtttgttacatatgtatacatgtgccatgttggtgtgctgcacccattaactcgtcatttaacattaggtatatctcctaatgctatccctccgccca

SEQ ID NO: 21860 - DNA, 373 bp, Homo sapiens
ctcctttcagctataatccaatagtaccttattttattgtttaagccattccagctttggtcattgggagcactttcagttggctgctgtgtctctttgacatattccgatcactgtaatttttattttgtttttgagcacgtccttgctttctggcgctacaagatgctccaggctcatctgatatatttcctacccagtccaagcatcaaccatttctccaaggagctctgactgcttttattggagaatggtattaaaaccaaggtcaagatgctaggcaacatccctaattatccccactacaccagaggttccaaaactttctcagctcacagtgcccttcgtggctcaaaaatctttcacagcacaa

SEQ ID NO: 21861 - DNA, 130 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaagga

SEQ ID NO: 21862 - DNA, 233 bp, Homo sapiens
taacaattagccaaatactgatttttgatggaaatttattctgaattattttcttttagaaaaaaataggaaaacatataacaatagaattacttaattaaattgattccttggctgggtggctacgcctgtggtcctagcactttgtgaggccgaggagggtggattagttgaggccaggagttcgagaccggcttggggagcatggcgaggccccatttctgctgggaatt

SEQ ID NO: 21863 - DNA, 337 bp, Homo sapiens
  misc_feature 311: k=g or t
gctgtaaggaaatgctaatggattaagaaattaaccacaggacctaattagaaaaagatctggcaacatgcccagctcatccagcgggagagggagaaaatattctgcattcgtgacactgtttagaaaggggtaatttaaatgccctttaatctgggctagtattgtccaattaagaagtctgttaggatgataacacttgggttttttaatacttagtgtggtgaagcagatttattttctccccttagtatatttatattgaatggtaaaggttatagtttaattaaataagctacacatttcctgtkttcttttaaaccactgtgctaggagt

SEQ ID NO: 21864 - DNA, 121 bp, Homo sapiens
  misc_feature 32: m=a or c
  misc_feature 33: m=a or c
gaactaagcagggcggtcgggggagtcatacmmcatgggattatgtgataaatgatcttggcatagaagagaatttaaagagtgatggcttcattccagcgctccaatagtcatgaccaaa

SEQ ID NO: 21865 - DNA, 259 bp, Homo sapiens
ctgctgctacctagtccagcctcaccgcatcccagaagaggcacgtcggccttcatttgcctagtggattttcaaaagcagctcttcggtttttggtgctgttaagagaccttgcatttcaatcacacgggagaaaactgaagctcgtaacaggagaatctggcagctggacacagcttggactgcattgtctggcttcatgacccctgctgtgtagccggctcatctcttcactctcacatgtacactctccgcgctt

SEQ ID NO: 21866 - DNA, 201 bp, Homo sapiens
  misc_feature 195: m=a or c
  misc_feature 196: m=a or c
acaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagcctagtcccccacacccttgcgtcttgtactggccttggacccccammccgga

SEQ ID NO: 21867 - DNA, 373 bp, Homo sapiens
agttaggatgatgacttagaccatggcagttgtgggtggagatggtaactgccagattctgtctatatattgagaagtagcaggcaggatgtactgagcaattggatgtgggatgtgagagaaatgactccaaggtttttggcctgagcaatcagaaggatccatctaacatttactgaaataaggaagatgctttattcaatctaaaagtgaaaaaagaaccttttagacattattattataaaatgtctataagaagacttctcattttaatcctcaaaatatactcccagaagcataaaagcatccactgctacagctgaacagttttttcagaagctgagaaataaacatgaatttactattttggtga

SEQ ID NO: 21868 - DNA, 169 bp, Homo sapiens
ttgttctcaggcttacaatatgtatctttgaattatcaaataagtagataaataaatggaatgataccacttttcatatattttaataactttacaacagcatgcttctatttatcctcctgttttttgcattattgtcataaatttacttccatatgttataaaccgc

SEQ ID NO: 21869 - DNA, 184 bp, Homo sapiens
ttattctcttcctttcacaaaagtctatattctaggccaaatattcccaaaacattcaattatacctcatgttcagtggctgcagaaaggcacattatcattagagtagaattttagattataaatctctgtctcacactgtggtatccagaactgaatataagacccatagaaatctccccag

SEQ ID NO: 21870 - DNA, 408 bp, Homo sapiens
  misc_feature 346: m=a or c
  misc_feature 347: r=a or g
  misc_feature 360: s=g or c
ttcagaaaggctcccatcatcaaatgtgcaaaatatgtaacaaccagctgctattcgatttagttgctataaatgtccattgttgtctgaaatccagtaacattctgcatttgaatctaaggcatttttaaaagaaaaatgcccttcatgggttttctcacattattttaacatttactaattatttcttttactgggtctctgttaggttctaaacatgattcaagtactggaattataaaatttcacaagacaaatatggtcccaaaatgtagtcaacaaaattcctattcaaattcaacttaggtttaaactgagtctgtaaaatattttacttgaaatagamrtgccaaagcagasagaatttttcagcaggtcaagtgcacttgcctacgtatgatagtgtga

SEQ ID NO: 21871 - DNA, 408 bp, Homo sapiens
aatctatgtaaagtacatagtataaccctgaaagggattattagtcccacttgacagatgtggaaaatgagccctagagagattaaataaaatagaaccttctatgactaagtgactaaattcaggtctctgatttcaaagcccatactctttcctctgagttgcattgcccctaccaggtacttggcaattactgtcttgtgcaatctttggatctttgccttgataatgtgcttaatcattcccttcacagttcatagtaaagtaagaatgacgagcatttagcatcatcacacacaagcctaagagtcagcaagactcaccttactataaagctagcttcatcagctccagcagctttccaggtagcaagatgtcactggcagagtggataatgaactagcacat

SEQ ID NO: 21872 - DNA, 212 bp, Homo sapiens
ataagcaagtgagccgcttctcccctctaaaggatgtttacacgtgggtggcactcgctggaatccagcgctcgggcagccctgggaggacgcgctcagctgcgtggaggatggagagcaatacatcatcatctttggagaatttagcgacggcgcctgtgaaccagatccaagaaacaattatcaatataaaaccccctgccataaccctt

SEQ ID NO: 21873 - DNA, 365 bp, Homo sapiens
taggcaagtaagtgaagtccagaaaggtaacattttgctttactttttccaagttatcagactgtattacttcaggcattttatcactacagtgctctagattcaggaaaaatattcccttccagtatgttccagaaataatgtgcggaaaccttagagacaggttatttcattaagaccagggttattctagcagaaaatgcctctctggtgtgtagaaagtgaactaagaatagttaaaaaaagaagacagtacacaaatcaggtttccagactagatggagcgtaagtgcctactgttagaggtttgattttcagttacaatgagtttaaatctttttaaataactaactttgtatttttaa

SEQ ID NO: 21874 - DNA, 113 bp, Homo sapiens
aagcatttcttgcgccaagaactaattaaccaaccatagtgatgtttcctgtctcctgtgacaaaccagaaccgatcattaggcatcacgggacactgtagatggaggacacc

SEQ ID NO: 21875 - DNA, 240 bp, Homo sapiens
gaggcttagaagataaaaaagaaaagaaaacaagatatcaaagagaaaacaacaaatcaataagacggccatcaaatgtgtgttttgtataatgataaactgtgcacatttctgtttttctccatatactataaatttatgtactttcaaaacttaattttgtcataatattagacttacataaaatttacaaagataatatgaacagttcccatacatggtcttcacccagcttcccct

SEQ ID NO: 21876 - DNA, 160 bp, Homo sapiens
tggcctggattttagttgctgaggttataagtatgtagggaaagaattactgtagaaattaaagtttccagggattttattgctgtgctgagtcatttatccttcttgtgttttggggctgaaagttagctggagaactatttatcttttctctctcata

SEQ ID NO: 21877 - DNA, 389 bp, Homo sapiens
  misc_feature 32: k=g or t
  misc_feature 44: s=g or c
  misc_feature 46: m=a or c
  misc_feature 49: w=a or t
  misc_feature 61: s=g or c
  misc_feature 314: r=a or g
gagcacgcagagtccttctgtcggttggtcckggagcggcgcasgmagwtggggccgtgasgagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgargaaagagggcttgcatgaagaggatggatcttcaatgacatctttaagcatgagaaactgagtcgatcagatccc

SEQ ID NO: 21878 - DNA, 424 bp, Homo sapiens
ttgattgggattgtgttgaatctgtagatcaggttgggaagaactgacatcttgacgatattcaatcttccaatacttcatgttagacctgaaatatatctttgatgtatttcatcagaattttttagttttcctcatacccgtgcatatttttttagatttgtaacctatgtattacatgttgggggatccccggctcttttatgtcaaaatctttttttagctatattttagattaacatttaacatcccccccttgtgatctataccgttggatattcaggtattactgtgtgtgtaacagctaaaacaagagggaggagggaaaataaaggcagtgaacttggacggatgcatcaacaacagcagataaagctaacccctcagtgaccatagcaacatgtcttctggaagcctttactct

SEQ ID NO: 21879 - DNA, 340 bp, Homo sapiens
tcacccaagtggaaatacagaaagtgcttacaacatgtaaaattctgtattgttgacattcattacttttgttaacaaatgtgtcacatagaaatttcctgaaaatatgatcaaaaaatgaaaaagcaaatacttagtgagcagacatgcagtggggggaccttcctacccagtgtgagccagcatttctcacctgtgcctctatagtagtctaactggtgtgccagttcccactttttgctccaggtatagtctattcattatggtagccaaaataagcctttaaaatttttaaatcaatcttaccaattccttttactctcaacccttgccgcccagt

SEQ ID NO: 21880 - DNA, 357 bp, Homo sapiens
  misc_feature 279: d=a or g or t
  misc_feature 353: y=c or t
ccttgtatcatctaagttaataataggtggatgagatcttcatttcaaatgtttgttgttccttttttctcaatctctaaattgtttgacattgttttttattatgaaggaattgttcaagtaaataaaagatttggaaagaaaaaaagatgttaaaaagctttgcctcttcatttctggtgtatctcttttccttgattttattatgataaaataattccccattataaagttaatgcaaggaaaagtgactaacttggagatgatcacacttatgtdgcatctctagaatttatttttatgtgaatcatgataatctataagcagacatctactttttttccccctagggyacac

SEQ ID NO: 21881 - DNA, 395 bp, Homo sapiens
aagcagttgactcttggtgtgtaaaaattacttgtttagaatgaatgttttccttagattttctgttataccagtagagtttgtttggtcctataagtcagtggcactgtgtgaaggaaggttggaggatgtaatttgggaagggagctactgacattgtcagcctactatgcttttgtttgtgccatatagagcttaccaattgtcagtggcctaactgcccctattgcatcaaaaacggatagtggcaggctgggcacggtggctcgcgcctgtggtcctagcactttgggaggctgaggcgggcgggtgatttgaggtcgggagtttgaggccagcctggccaacatggcggaaccccgtctctaataaaggtacagaaattacctgggtgt

SEQ ID NO: 21882 - DNA, 115 bp, Homo sapiens
aggagtaaggcggtccccaggcgagggccaattggcagccgcctttgccgcgatgcttcctgggagttgtagttcggggtgaggccggggcttcatggggagttgttgggctgta

SEQ ID NO: 21883 - DNA, 335 bp, Homo sapiens
  misc_feature 97: b=c or g or t
atctctgtatttttcatatatgggagtgggacggggactttggggagcttatcagcctgtgctcgtggcctccctggaatggagaaagacgtgcttbccggaatggcagggtagctcataagcctttgcagggtctggctctgccatccgcagaaggcagagtcaacatacggtctgtacttcctttgtcaccgtcactcacgctttttctgtaacccacgcaggccatcatggcgcaactaccgcagaggagaaggcaaaaatagctgagcaggtggagatattccatcaagagaaaagcaagctggatgcagaagtggccaaatggaacgact

SEQ ID NO: 21884 - DNA, 422 bp, Homo sapiens
  misc_feature 250: s=g or c
  misc_feature 357: s=g or c
  misc_feature 376: v=a or c or g
attgggtctagagtcgttccggtcccgcggggcatgctttgaagaggccttcgtgtcaggaagaggactgggccttggccctcccccgccgcctctagggccgcagcaaatagcagcgctgtttttccagatcctggtgtaccgagcagcagcaaaggcggtccggcggcaggcatgttctcctccccggaccaggccgcaccgcccctggttagcacccgcctcagcgtctccgccattcgccgcgtastctgaccaatcggtggctcgttcccagccttagtcccgcccaagccgtggccgcatcgtagagatggggtttcaccatgttggcgaggctggtctcaaactcctgasctcagatgatccgcctgtvttggcctcccagagtgccaggattataggcatgagccactgtgtct

SEQ ID NO: 21885 - DNA, 252 bp, Homo sapiens
  misc_feature 83: m=a or c
tgtgaaagttttgaattaaaaacaagcagtagcagcagaggccacagaacttatgggagtcttgtatatcttccaggcatgtmggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaa

SEQ ID NO: 21886 - DNA, 83 bp, Homo sapiens
  misc_feature 61: y=c or t
acacacacaccgcacaagtgcttaatacgtgtgtcttttgtcttaagcactctcttcagtycctttaaatgagccgaggtcat

SEQ ID NO: 21887 - DNA, 137 bp, Homo sapiens
gttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggag

SEQ ID NO: 21888 - DNA, 163 bp, Homo sapiens
  misc_feature 72: s=g or c
cagtatcataaaatgcacactagaagtgtacattcagtggtttccagtacgttcacaggatttgcagccatsgtcgctaattccagaacgttttaaaaccccaaatcgaacctgccgtacccattcgtagtcactccgcaattcccccgaccccatccccata

SEQ ID NO: 21889 - DNA, 190 bp, Homo sapiens
  misc_feature 50: s=g or c
  misc_feature 51: r=a or g
  misc_feature 52: m=a or c
  misc_feature 53: n=a, g, c or t
  misc_feature 107: s=g or c
  misc_feature 108: m=a or c
gttggttccggaggtcgctgcggcggtgggaaatgctggcgcgcgcggcsrmngcactggggcccttttgctgaggggctctctactggcttctggccgcgctccgsmcgcgcctcctctggattgccccgaaacaccgtggtactgttcgtgccgcagcaggaggcctgggtggtggagcgaatgggcc

SEQ ID NO: 21890 - DNA, 217 bp, Homo sapiens
catcatttctagtgtttattttctcacagaaaccatataaatattgaggtatacatagcaggctagaaacaaaataaaccttgagctcctggaaatctttagacatttggttttctcagcatcggaattttatttcttgtctctgtactcattttgtactttctagaaagaaattaatgacgagtaccaagtgaagcaaggccaatattcccagcga

SEQ ID NO: 21891 - DNA, 329 bp, Homo sapiens
gcagatgctaccttcttctagaattcctttcttctagaacagctatatagattgatataagcctgtggccatgctttctattttgtacttttcccttccaaacttccagcccatgccacccacatgccctcccaaatccaccatataagggaagcttatttgcaaggcacaatgaagaagaattagggctgggagagagtgagaaagaacagccactacctacgttgccctgcctgaaaacacccagctgaggagtgggtgggagctggaatccagtcctctcaccctgcaagaggctgccctcaacttcaggaagggaccccctcctc

SEQ ID NO: 21892 - DNA, 199 bp, Homo sapiens
  misc_feature 32: s=g or c
  misc_feature 33: n=a, g, c or t
cacatgcacatacacgtgcacgcgcgtgcgcsnacacacacacacacatcacaggttacctcgttcaacattgtgtagagcacaggccagcaagcttttcctgcaaagagccggagagtgaacattttaggctttgtgggccagacaatctctgttgcaaggattcagctctgccatagacaatacataaatgcacaga

SEQ ID NO: 21893 - DNA, 272 bp, Homo sapiens
  misc_feature 228: m=a or c
  misc_feature 250: y=c or t
taatgctagaattttcaaatattttgttgactcttctccattgttaccgatcttgaaattcttttcttcaccttctgagaaggtattatttcttatcacaaagaatgatgaatatgattttatctacccttattttgggggtaatacgagaatatgaattgcatcatgatccccattatttctaacctaaaagtaaaattcgtttttttttttcaaggcagagcagtmaattgattataagtatttattycttttttcttcttggagcccca

SEQ ID NO: 21894 - DNA, 356 bp, Homo sapiens
tcatgattttcttatacaggtagagttacttaggactcgattgatgatatcagtgtcactaggatttatggctaaaatccacctcctatgacaagctacacttaactcttgtgtgaaagaacaaaggtttctttcacaagtcttctaacacaggtatttcctttggcaaacattattaattttaagtttacagtccatagtccttagaactatttaaataaatcttctaatattatagaaaggctctttttcccttctagcaagtagatttttagacagaaacaaaactgagtgataacaagatacaaaatgggttgaaagatgtaacttaaatgttactgtaacaaggatgtgcg

SEQ ID NO: 21895 - DNA, 121 bp, Homo sapiens
ggaaagattggctgggcggggtggtggtacactcctgtggtcccagttactcgggatgctgaggtgggaggatcgcctgagcctagggaggttgaggcttttttttttttttttttttttt

SEQ ID NO: 21896 - DNA, 127 bp, Homo sapiens
taaatgggaaaaagatgaaatgacaaaagactgcatgctggcgaatggcaaactggatgaggattacgaggaggaggatgaggaggaggagagcctgatgtggagggctccgaagaagaggctgact

SEQ ID NO: 21897 - DNA, 286 bp, Homo sapiens
  misc_feature 159: s=g or c
  misc_feature 186: y=c or t
  misc_feature 265: y=c or t
  misc_feature 277: r=a or g
  misc_feature 280: s=g or c
aagagaaggagaacaggaaaagaagagctagtaagcgagagcgagagcacagaaaagaaaaaaaaaagccttaagaggaccgaagggaggaaaggaaaaggatggacaaccacaaaacgcagcgattgcggaaattttccagcgccattggctgggcascgtgagtccttcggtcgggcgtgattycagcaccgggggaactggacagcacctcggggggacttctgggcaacccgcaaccacagcaagaactccaccagcagcytcaacaacagargcsgcggac

SEQ ID NO: 21898 - DNA, 227 bp, Homo sapiens
taaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcagaaaaaggaaaaaaaaaaaaa

SEQ ID NO: 21899 - DNA, 195 bp, Homo sapiens
aactgtgtccttactgattttctgcctgctaggtctgtctgtttctgatagagggaattgaagtctccaggtatcatactagattcatctgtttctctttatagttctgtcagtttttatctcacatatttcgatgctctgttgttaagcacatacatgttagggattgggaaactatgttgtcttggggaaact

SEQ ID NO: 21900 - DNA, 365 bp, Homo sapiens
tgaaaaagagagagaatttgcacttcctccacatttttgttctattttaatgggccttcaacaccgaagttcatccatgatgtctgcccacactggggaggatgatcttctttactccatccactgattcaaatactaatctagaaaacaccctcacagacacactctgaaataacattttaccatatatctgggtatcccataatccagtcaaattaatgcataaagttaaacatcccagatatatattcaaaagaattgaaaacaggtactcagatgcttgtacatccatgtttaatagcagcattattcaaaataccccaaaggtggaaacaacccaaatgtccagcaataaacaagtgaat

SEQ ID NO: 21901 - DNA, 144 bp, Homo sapiens
tagaagaagacttatttggagctggaatccctaatttctaattaagtaaagtggaggagaaagtgttgatagtttagtgagtaatttttaaagcaagtccctgcccccttcaacgacccgcaaatactacttagaggcggacat

SEQ ID NO: 21902 - DNA, 188 bp, Homo sapiens
actaaaaatacaaaaattagctggccatggtagcacatgcctgtagtcccagctactcaggaggctgactgaggcaggataatcgcttgaacccaggaagtggaggttgcactgagccaagatcatgccactgcactccagcctggcaacagagcaagactcgatctcaaaaaaattgagaatgggca

SEQ ID NO: 21903 - DNA, 144 bp, Homo sapiens
agggggacgggagcaatagacaccggggactattagaagaaagaaggtggtgggggtggagaggtttacaaaactacttattgggtactatgctcactaccttggtgatgagatttttcatacaacaaatctcagtgacacaca

SEQ ID NO: 21904 - DNA, 156 bp, Homo sapiens
caaatggatatttataggaatatattcactactttgtatactttgcaaatttgtctctctggctttacccaagttctgaatgcattgtaattaaaatttaagtttttcttttcccccattagtaaacatttagtgctacatatgataactgcccac

SEQ ID NO: 21905 - DNA, 342 bp, Homo sapiens
  misc_feature 79: s=g or c
  misc_feature 80: s=g or c
  misc_feature 202: s=g or c
  misc_feature 203: k=g or t
caaaattaatcagatacaattatactatcttcacaacaacaatcatctacattggttttgacaatgtacaaagtacttssatgtgtattatttcgtttatctttaccacaacctttgaagtaggaagacatgatgatccccattttactgcctaggacagagagacatcaggaggttaactgacttgttcactgagaaagcskaggagcacagactataactccaacagtttgaccccatactgcatacgcatcagggccttaatcatgagactgtatgacccttctgagcctgggattcacttgcaactgggtattccctcttctacctcaggccccctga

SEQ ID NO: 21906 - DNA, 163 bp, Homo sapiens
  misc_feature 130: n=a, g, c or t
ttatcagtcctgggtagaaatgcacattttctgactttctgactgtctgtctctgtggagagcctctttgtatgacaccagctctgcagcaggagtgcttgtgcacatggccattatgagaaggccagtnagatttcaggagtcatggggactgtgaggacct

SEQ ID NO: 21907 - DNA, 99 bp, Homo sapiens
tgtaccttattctgtagtagactgttataaaaagatgacacacacgctttattttttcttttgcaaataatagaaaaaacacaaccacagaaacaaact

SEQ ID NO: 21908 - DNA, 192 bp, Homo sapiens
caaagggtaaaacatgctcactcccacccggtaatcatttttttctttttttaaaaaaaagtttttattttttccaaactagtgcatgtataaataatggcaggatggggggtactgtgtagatgattaactgactttttaatattttgtaaataaatcggattccttgtgtcctttgtgctagtgtaaccc

SEQ ID NO: 21909 - DNA, 143 bp, Homo sapiens
ttaggtgctttaatgttacccactcccctacaatttatacttttgttgtcacaatttacatctttttatcatatatttcttaatagcttattgtagctataattgtgaccattttgacttttaaccttcatagtagacacaga

SEQ ID NO: 21910 - DNA, 250 bp, Homo sapiens
  misc_feature 29: y=c or t
  misc_feature 31: y=c or t
tatcaggaaatcccagttgtctatgtggycyagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgcaagcagaaacagcaggtaaa

SEQ ID NO: 21911 - DNA, 290 bp, Homo sapiens
  misc_feature 126: m=a or c
  misc_feature 139: w=a or t
  misc_feature 144: r=a or g
  misc_feature 148: y=c or t
  misc_feature 160: w=a or t
  misc_feature 161: m=a or c
  misc_feature 170: r=a or g
  misc_feature 227: w=a or t
  misc_feature 252: w=a or t
gaggaggctagactcaagctgtctggagagtgtgaaacaaaagtgtgtgaagagttgtaactgtgtgactgagcttgatggccaagttgaaaatcttcatttggatctgtgctgccttgctggtamccaggaagacctwagtarggcyctctaaggtccwmccaaatcargcaaaattgaaggagctggtaccagtatctcagagcctccgtctcctatcagtccgwatgcttcagaaagctgtggaacgcwacctcttcctttgagaccttgtggagaagggtctgaaa

SEQ ID NO: 21912 - DNA, 155 bp, Homo sapiens
actgtctctcccgtccttggattgctacgggcatggctcaacccgtggcttgtttacatcttgcttcacatacttgaacagctaccttttagggtcaatccagagtctcacctcaggcacaacccccatggctccccctgaaatgcctcacccgt

SEQ ID NO: 21913 - DNA, 256 bp, Homo sapiens
gacacaacttcttgtgggcacatattcagaaggcatctcactggagagggtttagttctccttagcagaagataagatttcaagatttcagctaagactcatctctctgcaaatctttcttttgagagcatcttcaccaggaggagattccatctcaagagaccactttcactgctcatatgtaagaagcaactcttcatctgttcaagtttgatcatgagagtgcggcaattcagtcacaacttcaggctccagc

SEQ ID NO: 21914 - DNA, 263 bp, Homo sapiens
  misc_feature 15: w=a or t
  misc_feature 128: y=c or t
ttattattttgagtwatgttccatcaatacctagtttattgcgagtttttaacatgaagggacattgaattttatcaaaggccttttctgggtctaatgagataattacgtggttttagtcttgagtyctgtttacgtgatgaattacttttattgatttgtgtatgttgaaccagccttgcatcccttgatgctgacttgatcgagcagggaagctttttgatgtgctgctggatttggtttgccagtattttatggaccct

SEQ ID NO: 21915 - DNA, 251 bp, Homo sapiens
  misc_feature 59: s=g or c
  misc_feature 60: s=g or c
acctgatagctggaaatagacaaagcaagctgaggttagttctactggagacgttttcssttactgatcttttttgtttaagcctcttgtagctgagtttcttttatttgcaacagaaagagacatgtctaatatttattttcccaaaatatgcatcaaatttcacttctttccaaattgattatttccagtttaaaacatgaggatgatgcgtgcacatctttagtactctcaatgtttccaacccgcac

SEQ ID NO: 21916 - DNA, 429 bp, Homo sapiens
  misc_feature 12: m=a or c
  misc_feature 13: s=g or c
tcaataatttcmstttcttcctttaagccatcaagtttctaaattttacaacttgacagtttagcaatttcatttatgaaaggctgattccattttgatgttgatttttacatttcagaatttttcatatataaatatttgatgcattagatgggatactgagcttgagtctggcccaaatgaaccacaaggcccagactgatctatcagtagttagaaggcttctaatacactggctttctaatgtacagtaaatactagcgttgttttcaatattctttcttttgactaaaagtttccattccaactggtgaaaaatttttaaaaaatatttataatgatagttagagaactgtttatatgaggatcagacattgtttcagcactggatctcctctgtcccctctcttgctacagcatacagcccgt

SEQ ID NO: 21917 - DNA, 409 bp, Homo sapiens
  misc_feature 113: y=c or t
gttcatgcttttcactctgcacagcagggatgttcttaagaagttgccctctgcgaaatttcactaaatgggaaccgtggaccctgcatgatgggattataatcacaccagcyactccttttacataattttttgtttaagatccagtaagactccctgtttttaatacatataaagcaacagacatgtatatgtcgataaactgagggtttgcgtccctattgcctggtgcaagctacagcaaaaaaccggtgatatcacatctacaaatctcaatggattcaaaaacaatatgaaaatttttagctgacaagaacatgtctgctgcctgcagtccctgcaatagctcaccatgttgcctactaaccaaaagatcaaaaattatcgatttcatggcgctgcgagatca

SEQ ID NO: 21918 - DNA, 217 bp, Homo sapiens
  misc_feature 14: s=g or c
agaaccccgcggastgctgtgcgaggccggagccgcggtggcgctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcaat

SEQ ID NO: 21919 - DNA, 248 bp, Homo sapiens
caaacttattcgagttgtccacagttggcaatgttgatcttcttgctgctcttgccatcctgcaccttacagttttaaatgtaattcatgaccggatgattaactttttatagtactattaccctctcccagtatgattttcccaattgaataaaaacttcatttttaaaaaagcagcagcatatatataagaaccaaagttttgcccatcatgcttatccacttctctactctccaatccccctaaa

SEQ ID NO: 21920 - DNA, 189 bp, Homo sapiens
tgagtgaaataaatgtccttagatagatattgtccctaaactcttttctattgaaagtttatagtattgaaaatttgatgattattagtacctagtataaatcaacattcatctgatgttctctttttagatagccaagttataacttttttgaaaagacattattggactaagttagtaggtcagccc

SEQ ID NO: 21921 - DNA, 312 bp, Homo sapiens
  misc_feature 2: h=a or c or t
  misc_feature 8: s=g or c
  misc_feature 9: s=g or c
  misc_feature 299: w=a or t
thggatgsstggacatatggatgatgggtagatggatgagtggataggtggatgatggataatgggtggatggacagatgttttgatgaattaacagatgaatgatgggtggatggacagatgtttggatgggtggatggatggatgatgggtagatgagtggataggtggatgatgaataatgggtggatagacagatgttttgatgggcgaacagatggatgatgggtagatggatgatgagtgggtggacagatgtttggatgggtggatggatgatgggtgggtggacagatgtwtggatgggcggaa

SEQ ID NO: 21922 - DNA, 197 bp, Homo sapiens
ttagttacataaattcattttattgtagaataattataagaccgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtga

SEQ ID NO: 21923 - DNA, 428 bp, Homo sapiens
ccaggtgctgctagggacagcataggcccgggcactgctagatgcttggtttaaaccaggacaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattaca

SEQ ID NO: 21924 - DNA, 462 bp, Homo sapiens
ttagagccactgttaagagagaatataaaataatcataacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagttttaataaaaacattttgtctattcctaaatgtaatttggt

SEQ ID NO: 21925 - DNA, 101 bp, Homo sapiens
tcctgcagcccattggttgcttatatttatcgcttggctcaagttctgccctttggagaaatactgagcaagtctttcattctctgtgtgacagccctcgt

SEQ ID NO: 21926 - DNA, 268 bp, Homo sapiens
  misc_feature 29: m=a or c
  misc_feature 31: m=a or c
  misc_feature 128: m=a or c
  misc_feature 246: s=g or c
gctgtctcctgaggtttgccagggagatmcmgtggttttcatgtctcttccgtgattttcagggaagagggtcactatttggcccttccagaatctcagggtccggttctcccggaagtttccgggcmgccccggaccccattggctttaggggccgcgtctccgagggctccgatttgggccctagattttggaatactgtgttttgtccgtcccagccttcaccaggcggatttcatctcccasacagttagtgatttatggcaga

SEQ ID NO: 21927 - DNA, 335 bp, Homo sapiens
ttattaatattctcttcacctgtcccacagtcacctcagcaatttatgctccattagggcaggactgtctcactggtaactttatccccagcatctagcacaatccctggcctagacaagttgcctaatacatgcttattgaatgactgaagccatgaatgaaggaaaaataaatgaatgggacatctatgcacctggcttttagactttgcaattattgcatggcttttagcaaatcactgaatatgtctcagccttagtttcctcaagttccaactgagcagtgcaagcaagatgatttctgaaagcttggtggatctaaacttttttttttt

SEQ ID NO: 21928 - DNA, 203 bp, Homo sapiens
tagtgataatagtattcattgtgttttgtgaaatatattctaaattccctatttacatagtgaagtaaaaaaggtgcactaactcccgggatacatcattctctctgtccttagaggaagcaaagtatattagttattgctgtataacaaataacccaaaactcagtagattaaaacaacaacaaatatgtattacgtctctc

SEQ ID NO: 21929 - DNA, 58 bp, Homo sapiens
gacagtatttcttcacccatccttcatgaagataaaaaatgaggcaaaatagacacac

SEQ ID NO: 21930 - DNA, 160 bp, Homo sapiens
  misc_feature 112: r=a or g
  misc_feature 113: n=a, g, c or t
  misc_feature 142: s=g or c
agagaagaggagaaagagagagagcagagagcgagcggagagcgaggtgtagagaaaccgagggggagagaacccgagtgtgtgtatgcgtgtgcgtgtgtgagcgcgagcrngcgagcgagagaagaggagaaagagagasagcagagagcaagcggag

SEQ ID NO: 21931 - DNA, 273 bp, Homo sapiens
cagattgcttcttgctaattgttttactcttgtgcctgaaaatgttagtgatacgaattgacactttaatgttgtatgcttggtggggatctttttatcacaaggcattttccaagagtcatatgttgataaagggatatatgttgtccttagaaatcacacaaatcatgaccacaataatttatctgtaactgctgctaattttattgagcagaggaaaaagaatatacatatataaacatgtataggtgcatacacaatacacccggatct

SEQ ID NO: 21932 - DNA, 386 bp, Homo sapiens
  misc_feature 173: s=g or c
  misc_feature 174: d=a or g or t
agtaaccggtggaagtgtcaaagaggaaggagtggagggctgctgaggtgacagggtgtggtctgtgagggagcggacgaacccggagaagagagcagagagacccaccaggactaggaggcagcggggagcgtgcctgcgtcgctcggagcggtgacagcaaggagcgcacsdggaggccgggcggcaaggggagtttccagtcctcgataagtggagtccctgctctgcgctgcgccagcgccttccgcctgggcccgcggtgctagacacctgccgagtccgaagcgggagtcaggctgagccttcggcccccaagagacactgtaagaaccacggagtgttaaacttggggcttgagaatcagagtcatccttgaatttcac

SEQ ID NO: 21933 - DNA, 123 bp, Homo sapiens
aaaagccggagaaggggcggggtctcagctcctacttcattctacggccgagaccggaggatgttccctgctcaggaggaggccgacaggaccgtgtttgttgggaatttagaggccccccag

SEQ ID NO: 21934 - DNA, 308 bp, Homo sapiens
  misc_feature 116: m=a or c
tacttagatcagaaccccctctactgcccaccctcctcagtgaggttgttttgtatatttataatacagtttcattttcttgtcactgtatgcattctgtcctgttatcctcccamcatcctaaatgactatttttttacatttgcctaatattaaagttcaccttttctgctagaaacttctacagttttcacaaatgcatagtaatcatgtagccaccattagcgtatcagacagaatagtttcatcactcctcgaaatcccctgtacttcacttgttcagccctccttgctcctcacaaaacccc

SEQ ID NO: 21935 - DNA, 323 bp, Homo sapiens
gtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcagg

SEQ ID NO: 21936 - DNA, 145 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaa

SEQ ID NO: 21937 - DNA, 329 bp, Homo sapiens
  misc_feature 213: y=c or t
ttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagtycttcctgtgtttggcttccaggaattacatgaacgacagccttcgcaccgacgtcttcgtgcggttccagccagagagcatcgcctgtgcctgcatttatcttgctgcccggaagc

SEQ ID NO: 21938 - DNA, 425 bp, Homo sapiens
tagtgtttcttggtcagagtggtgatctgtggagtttatattttaaaaatgagactagtatacatggggttgctccttcagctcctccccttaccttttccccttccactgtcactttgaggctaaagatgaaaagcaagacattcatctaagggatcagcttagcggcagagatagacacgcatgcacttacttcagcaccacatggggagtgtgtggatagcatgtgcaccttcttgcccttgggtctgagtctgcccattgttcctatgacagacatggggataatggtttctttttggggaagatgaaagatgcattcacagactggtgatgtgaattattggggattcctttagaaggataatgctaagatccaagttaatttgatttggtagcttttctcatggttttatgaaaatata

SEQ ID NO: 21939 - DNA, 143 bp, Homo sapiens
tgataacagttttacatatttgctttcctatcttttggcctgtgtaccttaaagaaaattataaggatcataataaacattttacccttatacttcagtatgcatctctaaaaagtaaggagattttctacaaaaggacagca

SEQ ID NO: 21940 - DNA, 292 bp, Homo sapiens
tatacacatttccctactttgaaatcagactgagttttttaattcaattactgagctccctgatatattaggcttttaaatttgtttaaaaattattttttcagggtcctcactgttctattaatgttaagacattctggttcttgacggcgctaaatttttctcgttcccgaattgccactcaggctaagcaagtgccatataatgtcttacagcttggggtaagttttattacaagggcattttctggaagcatcaggatatttggaaattatttttccttcttccccac

SEQ ID NO: 21941 - DNA, 153 bp, Homo sapiens
cttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccccga

SEQ ID NO: 21942 - DNA, 327 bp, Homo sapiens
ttagagagaatggagaagggatgaaaggactaattgggcaatagagtttggatgtttctttaaataatagttccttgaccccatagatgtttgaggggaggagtgtggttaattgtactgttaacttttgtttagataagaaaaggaggagttggataagttatatatgagaccctggcaaggtgcaaagagagagaaaggcttaataatggaggtatcagtcagagttctggcaggaaagagatggcaaacctagatggatggaatagcacctgccatggcctgtttatgaactggactagagctctgtttgcatagggtaaggtc

SEQ ID NO: 21943 - DNA, 211 bp, Homo sapiens
gtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcattgatgtattttgccggtttt

SEQ ID NO: 21944 - DNA, 121 bp, Homo sapiens
  misc_feature 48: m=a or c
  misc_feature 94: m=a or c
agcgataagctcgcgttctccagtctccagggccttatcattcctcamgctttccttcatcggctcgcaaagaaacgtggcgatcaaggaagamagcgaaggctccatcctcgtcggggga

SEQ ID NO: 21945 - DNA, 158 bp, Homo sapiens
atttttttttaattttattgttccataagctattggggtacacatggtgtttggttagatgagtaagttcttaagtggtgatccgtgagatcctggtgcacccatcatccaagcaggatacacttcaccatataagttgtcttttatccctccccaca

SEQ ID NO: 21946 - DNA, 378 bp, Homo sapiens
  misc_feature 205: s=g or c
  misc_feature 249: k=g or t
  misc_feature 265: r=a or g
  misc_feature 271: r=a or g
  misc_feature 295: r=a or g
  misc_feature 308: w=a or t
  misc_feature 359: r=a or g
aggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtsatttgcatggacgtctgatgctgctgcacagtttaccgtgcttkatagaaaaagacttaraagaarctctgactcagtttatagaagaaratccctcagcgawtatgatagagatgctgaagcatccctggcagctgtgaatcaggtgaagtarattacatcagctggcgagt

SEQ ID NO: 21947 - DNA, 228 bp, Homo sapiens
  misc_feature 216: k=g or t
gtaatagtaacggtccgtttccggggtggagccagggagggcgggagtttaggctgcgctgacccctctcagccccccctccaggagacgttcggagcccaggacatgtcgggaatgaggagatacgaggtggcgctggaggcggaggaggagtgagtggaggcgggttctgcggaggaggaaccaggcggctccggggtgggggagggtggagtkctgcggaggcgc

SEQ ID NO: 21948 - DNA, 125 bp, Homo sapiens
gtgtagggtctttgttttttaaaatgttctgctgcttccaaatattttataatctataatgttactattatgattaacaaaagagaaacagtagcttaaaattaatctaaaataagacagccgat

SEQ ID NO: 21949 - DNA, 465 bp, Homo sapiens
  misc_feature 259: k=g or t
  misc_feature 424: h=a or c or t
aactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgtkaaaatttagtaccccttcatcattccaataaagataagactgatccattgtctaaggaaattatttataaataatagagattaatttatttgagatttgaaataagaatagttatgaaaatattagataccacataaattgtttgaaattactgaataaccatchtaagtatggaacatttaatggctatattttatttgtgtaca

SEQ ID NO: 21950 - DNA, 50 bp, Homo sapiens
ttttcagtccttgcgcaccggggaacaaggtcgtgaaaaaaaaaaaaaaa

SEQ ID NO: 21951 - DNA, 140 bp, Homo sapiens
tggactccctcattccctggatcaaacagcatacaatactgatgtcagataaaacttttccccaaaaccctgttgaactaaaggcactttataaccaatatatacacttcaaagaaacagaaattctggccaaggagaga

SEQ ID NO: 21952 - DNA, 195 bp, Homo sapiens
taatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaa

SEQ ID NO: 21953 - DNA, 158 bp, Homo sapiens
ctgtgttgaaatctcttcattcaattgataaagctctagaacattctttttaatgggtgcataatattccagtggggtaactattagaattttttattctacaattgccctactcatggatatttactttggtctcagtttttttggccattgtccac

SEQ ID NO: 21954 - DNA, 141 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaa

SEQ ID NO: 21955 - DNA, 262 bp, Homo sapiens
  misc_feature 201: b=c or g or t
cccggggcgtggcctagcgatctggtggccgccatttcgaagctgaagaggttaggcgacgctgacttgctttcaggagaggcactcggtaatcgagaagaaccggctttcggccagccaggagtggccagaggcctagaaggggagaggaaggcctgcctgcccagcattgcaaggcccagcgatcaccagacgtgcctbaggacacagggcacagtgtccaactttgacgcgtcctctccgggcactttaataccaaatc

SEQ ID NO: 21956 - DNA, 207 bp, Homo sapiens
  misc_feature 168: v=a or c or g
tttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatttatgcagtvaagaatgaattatttttctgactaaagtgtgtagcagta

SEQ ID NO: 21957 - DNA, 230 bp, Homo sapiens
aattccctgaggcttactgggagctcccaggccctggggatttgacagcgggagagagatagggaattctggtttctgcaggtgagaaggtgtcgtgatagaataatgaacatttcctgtggggctggcactgtgttctacatagaactcatttaatacaacaaccgtataacgaggaagcaagccatgtgcatcaattatcaggaacgctttaatccaactggaacccc

SEQ ID NO: 21958 - DNA, 330 bp, Homo sapiens
  misc_feature 52: s=g or c
  misc_feature 216: d=a or g or t
aagaaattccgagccaatccagttcctgcatctgtctttctccccctttacsatgatttagtcaagcaaaaagaagaacggagaaggtctctgaaggagaaaagcaaagaaagctcttttggcctcacaaaagccatttaaatttatagcaagggaggaacagaagcgagcagcccgggaaaagcagctgagagactttcttaagtataaaaagadaacaaatcgatttaaagccagacccattcctcgatctacttatggttcaactaccaatgacaagttaaaagaagaagagctctatcgaaaccttaggacacagctgagagccca

SEQ ID NO: 21959 - DNA, 455 bp, Homo sapiens
  misc_feature 288: m=a or c
tcctattcggccatcttggctcctcccacctttttttttctaattgttgcatttacatttatgttggagtctgtactgccatttttattccttgtaatacacttgtcaggcttgtttatcaaagttataaattggggctgggcatagtgtctaaagcctgtaatcccagcactttgggaggccaagacaggaggatcacttgagcctaggagttttgaggctgcagtgagctatgatcctgctactgcactttagcctgggtaacagagaacctgtctagaaaaagamaaacaaatggcaaggccaggtgcagtggcacatgcctgtaatctcagcactttgggaggctgaggcaggcagatcacctgagaccaggagttcgagaccagcctggccaacatgatgcaaccctgtctgtagtaaaaaatacaaaaattagctgggcatggtggcgc

SEQ ID NO: 21960 - DNA, 267 bp, Homo sapiens
  misc_feature 110: d=a or g or t
tttagttagaaaggcatccaggaattgttttcctacgcccccttgagtggaaagatcttagttagaagataaagtcaagtttgtgttcaggggatgggaggaagactatdaaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgta

SEQ ID NO: 21961 - DNA, 264 bp, Homo sapiens
  misc_feature 107: r=a or g
ctgatcgtccattaaggttaaaaatagtctgtgtatttgtgcttataataacacatatgtcagtcgtgggctttttgagccgttactccactggactgtcctgtaargagataattgtttagcaacgtgttatcctttaaaaatgcctcttattatttggctgatggactgtatagagcatgcccactactttggaggttggttgaagttgaagggtgaggtgacttaggaaattcaattcgaaattatttggaaagactggtc

SEQ ID NO: 21962 - DNA, 459 bp, Homo sapiens
  misc_feature 14: s=g or c
  misc_feature 15: s=g or c
  misc_feature 53: v=a or c or g
ttataacagaatasstgagactggggaatttataaaaacagaaatttattgcvtcacagttctggaggctgagaagtcctatatccagggctggcgtctggcaagggccttcttgctgcaacatcctatggcagaaggtggaaaggcaaaagagcaagagggggctgaacctgcccttttattacagtaccaatcccatccatgatgtggcctaatcacctcttaaaggccccacttcccgataacattacatttacaataaaatttgagcatgcattttggacaggacaaacattcaaaccacagcaacagctgacctgccctcactgcccccacacacagatagacccatgaggggctgagatgattaagtactagaggggtctactgcgtgctttggcatgattgtcacttgttaaaacaagtattctgcagagttatagaacttcagaagtatat

SEQ ID NO: 21963 - DNA, 139 bp, Homo sapiens
cctttgcgaatttctctgatttgtgggcacagttatgaagtttccccacatgtgaagacaggtacaaaatagcagagccaagcagacagtgggtctattcttcattagctcagtgacttgtccacactcgtcttagcac

SEQ ID NO: 21964 - DNA, 198 bp, Homo sapiens
  misc_feature 112: s=g or c
  misc_feature 114: m=a or c
  misc_feature 144: y=c or t
agcgctgggccagggacgcacccccaccgcgtcgtaggaaaattacctggtgtggggggtggggcggaaggcacctcctataccccgactccgcctgggccacccgcccctsamcctcggcctgacccagcctctccgtgcctyccctagccgcctcctcccagcagttccccaggagcgagctgcgagatgccccgt

SEQ ID NO: 21965 - DNA, 83 bp, Homo sapiens
  misc_feature 11: y=c or t
atctgagtgtycaagtacagttttacagtggctaaggttgtctcttgatcttttttctccgttgtgtgatcacagatgctgag

SEQ ID NO: 21966 - DNA, 279 bp, Homo sapiens
agaaatacagattaaactttgagcttcttaaataattcaagatgataggattttacaaaagcttagaagtcagatattaaaaatggaatctgtattctgcagttgttgtataccagtataagcttgatcacaaatttttctgtttataaaatataaaatcacaatttgatacatacgtgtataggcactctattcatgcttaggaaaatataactgtgaagtgaattgtaagtaattttgtaagtacttactatactgatatcagaaaaaaaaaaaaaa

SEQ ID NO: 21967 - DNA, 343 bp, Homo sapiens
aaggaggccagacacaggccacagagggctggtgcaagcttggaaattgggtgcctaagaccttgcttttgtgttgaaaggtttgtccgatatgtgcctcgatgccctggggagaccccaactaccgcagcgccaacttcagagagcacatccagcgccggcaccggttttcttatgacacttttgtggtaagtctggagcctgggctctgatccctcccctgggggagtggcacggctacttcactcttctcaaaaggggaaatggggatccccagtgttgaactttgtcgctgttgtgatgggcttccagtctgtatactggatacagtgataaagggggt

SEQ ID NO: 21968 - DNA, 273 bp, Homo sapiens
tgtagttaacaaagtagctgacccacagttaaatcatcagcctgtctggcttccagatcccttatcttgctcctcagcatagattgatagaaatctgtgcagcacttggatcaaggtacacgtctgaatcagattaatttagacagtcaaatctagttgtatgttaactctcatttaaggttattgttagaaatgtggttagtccaagagtttctcctcataaatttgacagtttcagtggtagccaatatcttattttaccatcaaaggcga

SEQ ID NO: 21969 - DNA, 418 bp, Homo sapiens
  misc_feature 259: y=c or t
  misc_feature 260: n=a, g, c or t
  misc_feature 382: w=a or t
  misc_feature 383: r=a or g
aaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattyngcaaaatgtcaattctctaaaaatgtgtccgtatatttctgtacctgcagtgtagtaaaggtttagacgaaaccccataattatagtggcatactgtcacttaggtttcaagcagcaaaatwracagtgcagctcagaaattgtagtttggttcttga

SEQ ID NO: 21970 - DNA, 158 bp, Homo sapiens
ggagccgaggtcttgctatgttgcccagaatgatattgaactcccggccttaagggattctcccaccttggacttctcaagtgttggtattacaggcatgaaacactgcaccaagctagaaatacttgcccatttctattgctcgggtcacgtggccc

SEQ ID NO: 21971 - DNA, 265 bp, Homo sapiens
aaactccaatgttttgctgatgcttggatgtaacaggcctttgtagctgacacatttcaagcaatgctgttcagctgcctgtttgaagaaagtttattttttaaaaactatgtttgcagttggctgaagagagacatggaaatattgaagaacgtatgagacatttagagggtcaacttgaagagaagaatcaagaacttcaaagagctaggcaaagagagaaaatgaatgaggagccaagagccttaatcatttttattgccac

SEQ ID NO: 21972 - DNA, 379 bp, Homo sapiens
  misc_feature 8: b=c or g or t
catcagcbcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaata

SEQ ID NO: 21973 - DNA, 159 bp, Homo sapiens
aaaaaagttagtaaactatccttagagcatgctcattaatgagtttgtgggggtaggaaaggggaattgcgtctctcgaatattttactcagttagagtcagatctttctctgaatgggatcaaaatcagaataagcgttttggtccaaatgctcaccc

SEQ ID NO: 21974 - DNA, 216 bp, Homo sapiens
tgttgcagattcttgtatgtggtaggctgctgctttcttcctgtgttctgaagtctttttgtctttgggtttccataatttgacaataatgtgtctagatatgaatctctttatcatgtctgaagttgttgagcctcttggatgtgtgtattcctgccttttgtcagattttggaagttttcagacattttttcttcaaatttttttctgtactgt

SEQ ID NO: 21975 - DNA, 114 bp, Homo sapiens
  misc_feature 7: n=a, g, c or t
  misc_feature 8: n=a, g, c or t
cattttnnatgtgttgtgtttattatgcgtaattttcactggatgatgagatacatggtgatactatgtcagtttattctctgtgaatatgtctgtacatagacaggaagcgac

SEQ ID NO: 21976 - DNA, 260 bp, Homo sapiens
atattctggggactataaagccctttgtattgaaggttaatggtgataagagaatttactgtgattttagaggttgactctcaactctgaacttttaaagactaattaaaaagtcaggatactttcttttcaccattgatttttttaagcttttttttgtgtgtaggttgcttttcatgttaacttcttcataaagatgaaattgttaaaattttaatataacctctcattctgtaatttctctccctctcttcctccca

SEQ ID NO: 21977 - DNA, 280 bp, Homo sapiens
catcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagcccccggcacccaaaatttgttgacaaaaataatgcgtttatgtatataagtcagtaactttttcttttt

SEQ ID NO: 21978 - DNA, 253 bp, Homo sapiens
atattgggtaattgtttcctggtggtttaatagatcctttttttcctttcttccttgtttacctttgtggtttggtgattttctgtagtgctgatctttggtttctttctttttctcatttgtgtatctctgtaatattttttttctttgtagttactgtgaggcttacataagatattttgtagttataatagaccattttaagctgataacttaaatttggttgcatataccttttacctttaccctcggt

SEQ ID NO: 21979 - DNA, 334 bp, Homo sapiens
tcgtatttaggaatgacagcagttttgagaagcctgttggggtttcaaatataaatgggctttttaaagtagctttatttttctaaagagggacgtggaatctttttatagaaaattttccccttttaggtagaaaacggtgatatttggctactgccacaaaaagttaattgagtccgttgtgtcagccagaggatgagactctggtggggttcccatgcaggcagtgaaaggaggccccgccccagcgcagttagggcagcggggggcgccccatctatggggctgcagcaggccccaggcctgtgttccctcgctggttggggacggcagt

SEQ ID NO: 21980 - DNA, 198 bp, Homo sapiens
acacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgacccca

SEQ ID NO: 21981 - DNA, 124 bp, Homo sapiens
caggatggggaccggacgctgaaaagaccaatgcatgattggagggctgggactttcagccctacccctcaacttccaaggaggggaaaggggctgaaggttaagttgaccaccaatggccaaa

SEQ ID NO: 21982 - DNA, 257 bp, Homo sapiens
caatacatgtatacattgtgtagtgatcaaatcagggtaattagcatatccatcaccttaaacatctgtcatttctttgcgataagaacatttaaaaacctctcttatagctattttgacatatataatacattattgttaactctattcatgctactatgcaatagaacaccagaacatattcctgctatctaactgtagctttgtacctattaaccaatttctaaccacccctatccttcaccatcccatcctca

SEQ ID NO: 21983 - DNA, 401 bp, Homo sapiens
  misc_feature 7: y=c or t
ggaattytccgtacagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatggtgagcgccttcgtcttcattccgggtcctcctcccgcctcctgagatcgacggcccagtaacccccgcctggtgttccccagtggatggcaattactgcctgacgtgcggcagtgacaagacgctgaagctgtggaacccgcttcgggggacgctgctgccgacgtacagcggccacggctacgaggtgctggatgcggccggctcctttgacaacagtagtctctgctccggcggcggggacaa

SEQ ID NO: 21984 - DNA, 362 bp, Homo sapiens
caattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctacaaggagagaccctgcctttaccaaaaataaaaaaatctgctgggtgtggtggcacatgcctgtaatcccagctacttgggaggctgaggcaggagaattgcttgaacctgggagcaga

SEQ ID NO: 21985 - DNA, 76 bp, Homo sapiens
ggcggcggcggcggtggcggcggcgactgctgcggtgaaggaggaggaggagccgagcgggcgcagaaaactcccc

SEQ ID NO: 21986 - DNA, 407 bp, Homo sapiens
atttggggaaatctcccctctttttttccgcttgtggtttcatcatttgtgtagctgtgcctgggcctcaacactgtagggtttggttaggtactttataaaaagcttatgttgctgtgcatggtcttctgagacccgctctttcctggagtcggttcccgggttgtctccaggaccgattctgcatggcggcgggcgctcactgtcatatctacatcaccaggcacaagccgcatggatccagtggccctggtggccgttggtggtcccaggcgctttcctggaggacatgtgagaagccctgccggcgcatactgggcctggggtagccgcatggggatgggtctctgcgcatgaaatgctggagtttccgaagagctggagagttgacagcctcactggtgcgt

SEQ ID NO: 21987 - DNA, 133 bp, Homo sapiens
atttatcaatataattgggttttaaatagtataaaagaaaacttgtgatctatataatttatgtatcaccttcattgtaaatttagcaggaaatgcatcacaattatgatttttttttttgcaccagcgaaac

SEQ ID NO: 21988 - DNA, 418 bp, Homo sapiens
  misc_feature 32: s=g or c
  misc_feature 418: n=a, g, c or t
tcatttcaagccttccttgttcatgctgctgsgttcccttttcctgattctagctcttggggaaccctggggagcctccccagtagcattggcccttggggcccaggtgaagtcctttgcttggggccctaccgtgagcccacaacctccagggtttctgtgggagagggctgctcccctagacccagcaggtccctgagccattggcaaagaggagagaggctggggccacaggtggtgctggccgaggaaggaggagtagggtcgcacagaggagcactgatggatggagaaccagttctgggagtttggggagagatcaaggcaggagggagcccactgggcagaacctaaaggtccatatgggcagcatgcatacacaggaaagtctacagtttggtaccccaggactcgccan

SEQ ID NO: 21989 - DNA, 150 bp, Homo sapiens
tttgtttgttttttgagacggagtctttatctgttgcccaggctagagtgcagtggcaccgtcttggctcactgcaacctccgcccccggggttcaagtgagtcttgtgcctcagcctccctagtagctcggatcacaggcacgcaccat

SEQ ID NO: 21990 - DNA, 317 bp, Homo sapiens
aatataaatataaattattttaatatatatatttaatatgagactatttcatattctaattgaaattttttataattgccaaatattttttatgaaaaaagttttagtttcttctacaaataattcatgtttaatatggttttccacatgtttattaagtgccttctattaaggtgatgctaaaaaagtgtagtacttgacatctatgtagtactttacagttatcagttactttaatatacaacgtgtattaatctgttttgtgttgctattaagaaatatttgaggttgagtaatttattaagaaaagaggttaa

SEQ ID NO: 21991 - DNA, 277 bp, Homo sapiens
tctgtctacatgtgctaaggatgatatctggtgaaagcactggctttgttgaaaagctgaaagagaagggtgtttgtgcatatgcatgtcggaaccagcttcatatcattgtattagcagaagagttgggggaggagagggaaagaaagttaattatacgtgttccctttctgcaatgcagaaagaaaatagttatattcttagaaatcagtcaaaatgtatacagctgatctaatttgttgacactacacaactcaatatttttggaggggggcca

SEQ ID NO: 21992 - DNA, 184 bp, Homo sapiens
tatgttgaagccctaacctccaacgtggtggtattgggagatgggccttttggaaggtaagtgtgtttgaatgaggtgaagaggttggggacttcgtgatgggattattgtccttacaagaaaagacaccagagagcttgttctgtctctttgggccatgtgaagacatggtgagaaagcagca

SEQ ID NO: 21993 - DNA, 182 bp, Homo sapiens
tgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggct

SEQ ID NO: 21994 - DNA, 244 bp, Homo sapiens
atcctttgcgctctcggtgcccccctccacgcccaggagcgtgggaaccctgcttaagggctttactagggaaaacggtgctggttcactggggcgcgtttccgggaagtaaactcaaaaactgacactcgattcagctattggaaagtttttttaatgtggttggaacaactgagccatgtgaaaacacaacaagaaggtaccatcctggaagcagagagcaaacccttatcagataccacat

SEQ ID NO: 21995 - DNA, 206 bp, Homo sapiens
actaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccaa

SEQ ID NO: 21996 - DNA, 168 bp, Homo sapiens
ctaatagcaaaagcagtcctgggcaaaaagaacaaagctggatgcatcacattactcaacttcaaactatgctacaaggctacagtgaccgaaacagcatggtattggtcaaaggcagacccatagaccaatggaacagaatagagaacccagaaataaggccacacc

SEQ ID NO: 21997 - DNA, 112 bp, Homo sapiens
  misc_feature 110: w=a or t
acacacacacacacacacacacacacacacacacggactctccgaatcagggctgggcctctgtgccaggccatcccgtctttggagtgtatcctatttgaggtcaagawat

SEQ ID NO: 21998 - DNA, 340 bp, Homo sapiens
attttattagcaaggtgttgatttaaattaaaactgtagcaaaaatgctatggctctgattttaaactgctgtaagttctagacagcaaaggaaagctgaaaataaatgctgcatttaaaaataaatgttgctttaccaaagaggtgggaagatggaagacaggatggagtgaaaggctccagtaattttacctatggtactctgagttcacaaaggtgtcttgtactcagacagaaaaccgcagcgtgaagaggggacagcatgagtgaagaggaagtgaattttcacccttcacttccaaaccacaggaaaggaagtgactttaaaatgccaggaaaa

SEQ ID NO: 21999 - DNA, 122 bp, Homo sapiens
attgaagagagaccatgatggcggcggcgctggggcccccagaagtgatcgctcagctggagaacgcggctaaagttctgatggcatcaccttccatggtcaataatgaacaacgccagcac

SEQ ID NO: 22000 - DNA, 228 bp, Homo sapiens
cttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacct

SEQ ID NO: 22001 - DNA, 310 bp, Homo sapiens
gaagacttgtttaatcaatatactcagccttttgtgataatggtaatggtttgtgggtagattagtaaccttgaaaacagaaaggaatagtggcttatactagtgactgtccagaaagacctagctgatcattaaatttttggaattgttgagaaggccagttttctttcattctaaacagttaacatagttaaggaacataggtaaggatacatttaaggaaatagaatgtttcaaatagcttaaaaaattctcttggccaactttttgatgaagttggtaaagtagcagtgtaagtccaagagcccag

SEQ ID NO: 22002 - DNA, 277 bp, Homo sapiens
cagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacacca

SEQ ID NO: 22003 - DNA, 233 bp, Homo sapiens
catctagcatttacagttatctactgaacatctccatcctgatctcttattaacagtccatatttaatattgctgaaaccaaatttatctggcacatagtaggtacccagtaatgtgcagtgaacctcttttactctacagtccctaaaataattcctgattttgctttctttcttttccaaacactactgttttaccaggctttctttcatcccggtcacttagagcagtgc

SEQ ID NO: 22004 - DNA, 94 bp, Homo sapiens
aaggtgattgctggagtagttttaagaacagttttctagacatgacagtaaatggtagcattctgcttcatcacttacacttctcccaacccgc

SEQ ID NO: 22005 - DNA, 233 bp, Homo sapiens
atcagcatccgccagctcaagtggaaggagttcccatttggccggcgcttgccttgtgacatctactggcatggagtttcatttcacgacaatgacatattctccggtcaagtgaacaagtttccaggttcaaatggtgaaagacgatgacccctcctggaagcccacttttatcgtgaaacctgatggtggttgtcagggtgatggaatctacctcattaaagaccccagca

SEQ ID NO: 22006 - DNA, 151 bp, Homo sapiens
caatggtgggatagaattaggtcaggaaatggaagttgttccaatggtgtgagaactaggagacaagatgattcactttattatttaaaccaagcttcatttttagtttttgttgtttaaatggactggaaagttaagtttttgcagtgat

SEQ ID NO: 22007 - DNA, 391 bp, Homo sapiens
acaaaattatagtattgaaaggattaagggacaaaatagtgtatgtgtagtggtggagaagggggtggaagagagccaaagctttattgtccatagagggaagaccataagtaaaagctatagttgaaaaatgaatataagcatattatttagagagaaagaggtaaacaccaaaaaaactagctgaaagagttgaaaaaggaggtgggaggatcacttgagcccgggagctctaggctgcctggagctatgatcacgcctgtgaatagccactacactccagcctgggcaacatagcaaaactccatctcaatcaatcaatcttcccactttgacctcccaaagtgctgcaattacaggcatgagccaccatgcccagtcccgtgtatct

SEQ ID NO: 22008 - DNA, 382 bp, Homo sapiens
tggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaat

SEQ ID NO: 22009 - DNA, 241 bp, Homo sapiens
  misc_feature 204: h=a or c or t
  misc_feature 228: m=a or c
cagccttctgtctcacgggttctgtatccatggattcaaccaatgtggatagaaaacactttaaaatcaataagagcatacaacaaaaaatacaaatataaaacagtacagtataacaactatttacctagcatttatattatattagatattataactaatctagagataatttaaagtatactgtagagtatgcattaggthatatgcaaatactacactatttcmtataagggacaaa

SEQ ID NO: 22010 - DNA, 145 bp, Homo sapiens
tagtataacttacgtagtttttgtttgtttgttcgtttgtttttttgagacagagtctcactctgtcacaggctggaatgcgctgaaatatgggctcaccgcaacctgcgcctcctggttcaagtgattctcgtgcctcagccct

SEQ ID NO: 22011 - DNA, 445 bp, Homo sapiens
  misc_feature 12: s=g or c
agttctggtgasatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtcca

SEQ ID NO: 22012 - DNA, 254 bp, Homo sapiens
ctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgcc

SEQ ID NO: 22013 - DNA, 328 bp, Homo sapiens
agtcacagaaggcatgcacaagcagaagcagtgttgggtgggggcagagtgtcggactgaaagtcaggaggctggggagctgggtcctctgcttgctgatggaccatgggcaaatgtcctcctctctccaatcttggggtccttatttgtaaaatgagaggattggaccacagagcgatggccagtaaaacagagaaaaagaagctctcaaagtgaagacaggaatgcattgtataaaaattcacaccccctgctgccgcccaaactcccttaaaaaaggatcaagagaatcctgacgggtgaacagcccccctcttcccgcccccca

SEQ ID NO: 22014 - DNA, 213 bp, Homo sapiens
taaaaattagctgggcatggtggcacgtgcctgtggtcccacacccgctaatttttgtaatttttagtagagacaggatttcacaatgttgtccaggttgatctcgaactcctgggctcaagtgatcctcctgcctcagcctcccaaagtgctgggattacaggcgtgagccactgcacctggcctgtttgatttttttccaccatcacccct

SEQ ID NO: 22015 - DNA, 467 bp, Homo sapiens
  misc_feature 418: k=g or t
attataaatccctttctgcatttctattattaatttttatttgtaaaattgctaaaatagctaaatttggccatttaacctgcatttaaaatctaggaatgtggggtgatcatctttgtacataaattacctaatgaccctgtccatgctgtgctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatatkttacatttgtcatttcagtgttactggagttttcttcattgtgcacaca

SEQ ID NO: 22016 - DNA, 195 bp, Homo sapiens
ttggaattccagagaaattaatatttaagaaatcactttattgtggagtctcttctttccactctgtatcaactttcattttggtgttaggctcctaacagctcaaactatacagaaactgtggttttcttggttataactgtgttggtgttttgagcttggatgtcataagctgtaatttaatcactcccctta

SEQ ID NO: 22017 - DNA, 93 bp, Homo sapiens
agcacaggcatgagccaccacacccagcagttctttttatctaactgtaactatatatcgttgaccaggatctgccttccccgctgcccccgt

SEQ ID NO: 22018 - DNA, 191 bp, Homo sapiens
tattttattgttgctacattctgaactttagcttggggaaaaaggaattgggttttgaaagcttgtttacgacaaatcaagtgaaaatatctcttggacgtgcttgcttacataaaaataagcgttttggcactaacattggtagactctggtaggtctttccatcttagattatttttatttcaaggaag

SEQ ID NO: 22019 - DNA, 99 bp, Homo sapiens
  misc_feature 2: k=g or t
  misc_feature 3: k=g or t
tkkcacaggggttgacccgagccagatgacgcaggcgaaactgacacctccgcggtgtgtgtttccaagcgctcgatggtggagatgctggggggcgtc

SEQ ID NO: 22020 - DNA, 252 bp, Homo sapiens
ggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcga

SEQ ID NO: 22021 - DNA, 321 bp, Homo sapiens
atgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaaca

SEQ ID NO: 22022 - DNA, 278 bp, Homo sapiens
  misc_feature 162: r=a or g
  misc_feature 163: s=g or c
gttgaaaataaatatcccaagccaagataacagcggactcttgcttggcttctcccagacaccgcgtccccaggaggcccctcgccggtgggtttggcgtcatcacacccgtgggtggtcccgcccaggaggcctgtgcttaatcactgtcaggtgaagccrsagccagaggttaacatgtgaaaggaagggagagagcaagcccggcttgcaggccgcacccctgatagtttgtttcacatccctaacaagcagggtttacctgagcaaacacaccc

SEQ ID NO: 22023 - DNA, 74 bp, Homo sapiens
  misc_feature 32: r=a or g
  misc_feature 33: s=g or c
agttcgggagcgcgcaggcagtcgcgcgcacrsacgcacgcaggcacacacacacacacacacacacacacaca

SEQ ID NO: 22024 - DNA, 164 bp, Homo sapiens
taaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggctcac

SEQ ID NO: 22025 - DNA, 224 bp, Homo sapiens
  misc_feature 12: s=g or c
ccgtttggagtscccctgaaatatccaagaaataggtaaacaggatcatttgacatgtttaggtacatgggattgccaaaatgatgttcagttttctttaggttatatttttgtgaataatgctaatgtatgttccaaaattatatgggatttctaaaactctaatgtctaagtatatgctatcaaccataattaaggttgttaagttattgtaaaccacaggc

SEQ ID NO: 22026 - DNA, 215 bp, Homo sapiens
  misc_feature 7: n=a, g, c or t
  misc_feature 8: h=a or c or t
aaatttnhggctctttccattatgactgtgtaaccttggatacagtttcctcatctataaagttgtggtgggagaatggctgagaacagtgatctctcagctctccagctgtaaagatgttaattatgattttaactctcaagatcaggccacataaggaacaggggaattccaggggtgggacacagctgggggagtccagaccagggcgggtg

SEQ ID NO: 22027 - DNA, 248 bp, Homo sapiens
ttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctaa

SEQ ID NO: 22028 - DNA, 78 bp, Homo sapiens
agtcggcatccatcagcgggcgggggtgtcgccgaacaggctgctccgcagagcccgccgcgaccccgcgccgcccct

SEQ ID NO: 22029 - DNA, 200 bp, Homo sapiens
  misc_feature 172: s=g or c
  misc_feature 176: n=a, g, c or t
taaacaaggaaatgaaggagggaggcgggactgggggtgcctgcgggagccgccgccgccgtcgcggaggaggaggaggaagaggtggaggaggtggctgctgtggccgccgaggagtcccttgctgaaggcggaccgcggaggccgggcggcgggcggcgcgcgcgcgccsaaanaaggcggctgttggagaagtggga

SEQ ID NO: 22030 - DNA, 361 bp, Homo sapiens
acatttttatgtacaaagagttaacatgatttctttcattgggtggatgccttggataatccatccaaggaagatcacttctaggaacaagcaacattaaagagctttaagtgtgtgtgttgaggggaggagggcagtgggtgatgccttgtggagaaataggtggatagaggcaagaattaaagctaggaaacccgttaggaggctgttcttttacccaagaagccattctagactctggaaattcggtagagcacaaagtccctgccctcatggggtttctattctagttagggaaagcagttaataaataagcaaataatatcagctaataccaaatgttatggtgaaattagaaaaa

SEQ ID NO: 22031 - DNA, 133 bp, Homo sapiens
taacaataacaaagtcttgatgatgtacagtattcaaactttaggttgaaatacgttactctttgattcctagccagtagatcttatctacactttaatgggagagaatggtggtgtgtgggtaggcacaaaa

SEQ ID NO: 22032 - DNA, 139 bp, Homo sapiens
aaaataaacataaagaaacaatgttggccgggcgcggtggctcatgccttaatcccagcactttgggaggccaaggcgggtggatcacctcaggtaaggagttccagaccagcctggccaacttggtgaaaccccgcca

SEQ ID NO: 22033 - DNA, 185 bp, Homo sapiens
cataaatagtatcgttaagatgagtttttaatataatttttatataagttatttctattttgatgtattcatctttctaataaagcctagaaataataacacacaggactggcagtcatggaagggagaaaagcgagtcatgggaggtcagccaaggcagggcgctttcatgatgggggcagctc

SEQ ID NO: 22034 - DNA, 220 bp, Homo sapiens
ttatttcattttacatgccttagatgttaacatattaatttctcaaagcacgtttactggctactcatcatgtagtaggtcatatgttgaatgttaacaattctgagattagaaatacagatatgtccaggcgcagtggctcgtgcctgtaatctcagcactttgggaggcggaggcaggcaggcagatcacttgaggtcaggagttcgagaccagccca

SEQ ID NO: 22035 - DNA, 233 bp, Homo sapiens
tatgtatgtggaccatttggatattttgttttgtgatactatcctttcaaatcttttacccatatttttaataggattgtttgtcttatcaagttgtagggatttttttaatgtattctgaatacaaacccttttcagaaataagtattttttcctagtctatgccttgcgtttttattttaatgctgtcttttggttagtgagcagaactgttcaattttaatgaagtccca

SEQ ID NO: 22036 - DNA, 439 bp, Homo sapiens
tgattatagggtgtgaggggctgtaaaattgaggtcactgtttggtcagagtaaggatgataaaatcatcaggatgtggaaactgcactctttggtgattcagtctcttctgggtttcttcagaacagctgatatcagtagtttcattggtgtgcaggccctgaaagaatatttcaaaaggaaaatttaacatttcacaatgctcaagttgttatctatagagcagttaaaggaaactatcatgtaggatctgcatgattctgagacaataggtgacaaacaactatgagaaagcagatcagagagcaagctgacctaatgattaatgccaaatataccacaagcttggtttattctcatttctacccttcccttcttccctgattaattttacgaaatttatagggaccacttcactaatagctcttctcaatgttat

SEQ ID NO: 22037 - DNA, 136 bp, Homo sapiens
tagcaaataatgtacgaatgttttttgcattcaaaggacatccacatctgttggaagacttttaagtgagtttttgttcttagataacccacattagatgaatgtgttaagtgaaatgatacttgtactcccccta

SEQ ID NO: 22038 - DNA, 101 bp, Homo sapiens
agcctctcctgcgctcatctctccattgtcttttctgtgcattttgctttcttccgaatggactgtcctctctccgcacccactcccccgcccccgcttga

SEQ ID NO: 22039 - DNA, 224 bp, Homo sapiens
gcattcgccatctagagagacacagagatgaggagcccaagagatgaaactggagaggtaggtgggatcagctggtttgactgccgttacttaccccattaaggagattaaactaggggactttcaagcaaggggaataacctgatcagctgtttatgttagcagaacatctccagcagcagctgggatgatgaagcatcttctcttggcaaagaagaacacct

SEQ ID NO: 22040 - DNA, 351 bp, Homo sapiens
ctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggagt

SEQ ID NO: 22041 - DNA, 90 bp, Homo sapiens
ttaaaaattcagaaaaccaggtcatgaaagggagaagaaatagatatgttaaccgggaatactggtgtagtttttaaaattgagcactac

SEQ ID NO: 22042 - DNA, 405 bp, Homo sapiens
  misc_feature 405: r=a or g
cttctaaccctcaatttcccatactgcctaggcagtctaccacagaaggtgtagtgatagtgttagctaacacttacatagaccttatttttggcagtccttttatatttataatttgagctgatgctcataacagctgtgtgaaataagcagtattatctgtcttacaattgagaaatctaaaattcagttaagtaatttccccaaagtcatagtgatattgaatgaaacagcccaagtttttactacaaatcccatattgttttcaactttcaatcatggttcatgatcctgctgctgacagttgataataaaagtatcctattataaaaacagaatgaaaatatataaagtgctattgtgatatgagagttttcatcatatgaagcataaagaagcaaaggr

SEQ ID NO: 22043 - DNA, 192 bp, Homo sapiens
attctccctgcccaacactgatcagttagtcggacttccatctatggaccctagagcttttcctgccagtggttgctcctgtaacctactgtggccattgtgggctgacagccatattgtgagggattaggtagctctctaggcattgacaagaacctttgaattttagaaaatatccaaaaaaaaaaaaaa

SEQ ID NO: 22044 - DNA, 305 bp, Homo sapiens
ttattcagaattactattttaggggacatctgaagatcctgcttttttcctctagctctaaccctttcttctatgctgtaaccatactctttgagaaattggtttgcatatattattctctattgccttactgcatattagcttaacataacacaagaaaggtgtaaatcgtacatatacatcccaaagaattttttaaaagtgaacacatctgtataaacgcccccaagataagaaaaatgaacattatcagaactctaaaatcccctattgtgtcccttccagtcactacctccaaccccgtt

SEQ ID NO: 22045 - DNA, 220 bp, Homo sapiens
agaatgaagatggcttcctgtcccgctagcgtcacgtcgggatctgccttcaccaaggccttcactcgcgccagaggcaacctcgagagacgagccccaggcacactcgttggggcctggggctgcgaggccgctgcctccccagcaggccattataactacattcttagaatgtgatccctttcaacatttcctgcacctctgcttctgcacactacca

SEQ ID NO: 22046 - DNA, 176 bp, Homo sapiens
cttaaccctgggcaatcactgatttatctgcctttcctatttgccttttccaaagtatcacataaatgaaatcatacaatatgtagtttttgcatcagacctctgtcacttaacaaaatgcattttaagattcatctatattattgcctggattggtggttctttctttttttttt

SEQ ID NO: 22047 - DNA, 450 bp, Homo sapiens
atagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcat

SEQ ID NO: 22048 - DNA, 152 bp, Homo sapiens
atgtacagagcttcaatatgtctatttaaggaaaaattgtggttttgccaacaaagatcattttgaaagcacgaatggtttttacctgtcttcttagatgttgtaaatgccaagcctagcagcgaagacaggaggggtggcccaagaccccc

SEQ ID NO: 22049 - DNA, 461 bp, Homo sapiens
acacagggattctgccagttgcttgctgtactccagccctcttttgcagatattctggacaaattttagttgcttgtttcttgtttttgttcttattttgtgccgaagatgagtgccaggcacctttcatcagccatctagctgaccacagggaaaagatgggattgtcctgtgcttacctcaagcctagtgagaatggtttcatggaggcctctcagtgtgcttgatatatatcccctgcagatacatagagaacaatggactagtgtctgacacggatcctgaaatctaaaagtgtgaatgtatggcaatgaacctgagctggcagagaagagattctgttgcactgggaaatagctactcttcggatggaaggggattagtggcatggggtatgtgtgtgtttcatagaacagaagtggcatatgcagaagagaaaggctacaaaacatcatttagta

SEQ ID NO: 22050 - DNA, 175 bp, Homo sapiens
gtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcacc

SEQ ID NO: 22051 - DNA, 116 bp, Homo sapiens
  misc_feature 116: r=a or g
ctttgattctagtatctcaacgtgtttatttttagattctgataagtgaaatggatgtccttgtggagctctggcctccccagcttatctatcagtcctgctgtcctcacctcctr

SEQ ID NO: 22052 - DNA, 498 bp, Homo sapiens
  misc_feature 489: s=g or c
cataaagtaagacagggcttggtcttgaaggaaataacggatatgcattattcttccttccctgcccatccagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagccattgtcaatctggactataagtctgtccacaattctgtgtgtagagattccagactggggcatagggatgaaaacctaaaggataccttcttttgggaaattctttttttctttttttttctgagatggagtccgctctgtcgcctaggctggagtgcagtggcgcgatctcggctcactgcaggctctgctcccgggttcacgccattatcctgactcggcctccsgggtagctg

SEQ ID NO: 22053 - DNA, 243 bp, Homo sapiens
tagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcaccgtgttggccgggctggtctcgaactccc

SEQ ID NO: 22054 - DNA, 179 bp, Homo sapiens
  misc_feature 143: n=a, g, c or t
acaaaaccagccctacagagcgctgagtccgcttctgcccccatcccgcccctgcccaggcccctgggatgggtgggcctccaggtgcaccccattgacctgaaccctcccgcctctgcccgcttctaaacctgttcattgantgttgattatcgacttactcatttcacaacgcaccc

SEQ ID NO: 22055 - DNA, 76 bp, Homo sapiens
tgaactatatccatccagtaattacccaacccaatttttttaaatggacaaaagatttgagtagacttaggacggc

SEQ ID NO: 22056 - DNA, 158 bp, Homo sapiens
cattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgaggga

SEQ ID NO: 22057 - DNA, 294 bp, Homo sapiens
catcaatttcagtgcctgaccaggccttcaagaagacgtaggcaccccaaaatccattggtctcatccaagaaagagccttatttatactttgggaagactgaagaagggttttgtcagttgaataaaactagactagccagccttctattattatctaatctattaggtagttcagagttttgaccaaaaaatcaatctagactgtatttaaaactgagaaagaatattttattactttctcctccaaagttcatcttgggagctccccaatcaattaataaaatacacacaa

SEQ ID NO: 22058 - DNA, 102 bp, Homo sapiens
cacaccaccatgccgagctaatttttgtatttttagtagagacggggttttaactatgttggccaggctggtcttgaactcctgacctcgtgaaccgcccac

SEQ ID NO: 22059 - DNA, 214 bp, Homo sapiens
atacatttgtgggtcgcactctttttgttgggcagcactggtctagatcaggagttggtaaactatggcctatgggccatatccatattgctgcctgtttggggatggcctgagagtaagggtgatttttatagatgaacatttacaattgattcagtcaaatggaacactaactttgaatcccagttaagtgaaatgttttctcaacccccaa

SEQ ID NO: 22060 - DNA, 266 bp, Homo sapiens
  misc_feature 247: r=a or g
atgagattttatgacgctatgtgcaagatctagcgaacgtatttggctaagaaaaaccctggaggagagactgcctcagacaactggggggctggaaagccgacctggaaagcagcctgaccttggatgatttagcacctgggttttttggctcttcctgtattaggtttgctggcttcgcatcaagtggaaggaggtggtgccagggacgtgaattaaacctgtcaaatagagggtgaggggagtrcagaaggctgggggggcaa

SEQ ID NO: 22061 - DNA, 110 bp, Homo sapiens
gtttttcaacaagactttgaatacggtgattccacttgctgtatttcacagcaggctacgcatggggaagtcccgatggggtcaaggagcagtcaagccaggaggtgttc

SEQ ID NO: 22062 - DNA, 116 bp, Homo sapiens
  misc_feature 32: s=g or c
  misc_feature 102: k=g or t
tgaaatcatacagtatgccaccttttcagatsggcttctttcacttagtattatgcatttaaatttattccatgtattttcatgtcttgatagctctttttktttttttttttttt

SEQ ID NO: 22063 - DNA, 54 bp, Homo sapiens
agagaagggaaggccagtagtcatcttctaccttgatttttttttttttttttt

SEQ ID NO: 22064 - DNA, 179 bp, Homo sapiens
cagacaaccacagtgaacagtcccttcctttggaagctgtttagcttggggttaaaccccatacatggcagtggaaatataaatatgaatttgtcacccatgcatttgaaatacagcatttgctgtttgtgaaccagctcattccataatttttccttataatactgttagaggcacat

SEQ ID NO: 22065 - DNA, 182 bp, Homo sapiens
aggttgtgctagtgcccctcccctcccgctctgtgccccgccgggcggggaccgtgggagccgcggacaagcccaaggccggagcggttccaggaggaccctggtctgcacctgtggttgccaggtaggtggatgtgagagaccctacccttctggttctctagaagccatcccatcaccgc

SEQ ID NO: 22066 - DNA, 396 bp, Homo sapiens
  misc_feature 2: m=a or c
  misc_feature 3: m=a or c
  misc_feature 111: s=g or c
  misc_feature 113: m=a or c
  misc_feature 189: k=g or t
  misc_feature 307: w=a or t
  misc_feature 311: s=g or c
  misc_feature 315: k=g or t
  misc_feature 377: r=a or g
tmmttaattaaatcaaagtaccaatgttacagttgagttatatctcccccactgactctgcatacacactattggttggatactgtactgttgaagtccccaagttgactscmaatttcgacttagctggattgaatgcggtcaataaggggttgcaccatgagctaaagtagaaaggtaaagtgattkaggcttctctaatatgctgtggaagtcagatcgactcaacaagagtttatacttaaatacattttaagttacgtgctcaggattttacaagcaccatggaagaatcaaaagaaacgtwagasagtkttgcactgagaaacttaggctgagtgaccaactcacataaaattattagtcatctacctgargcagaatatgatgaaacac

SEQ ID NO: 22067 - DNA, 138 bp, Homo sapiens
  misc_feature 110: h=a or c or t
  misc_feature 111: v=a or c or g
  misc_feature 113: s=g or c
agctgcgggctccgaggccagagagaaaagactgcgaggtggccgcagctgtggccggagaggtgggagtcggagcgaggccctctcgggggagcagggtgaacgccgghvastctaggatcctcactcggggagact

SEQ ID NO: 22068 - DNA, 184 bp, Homo sapiens
  misc_feature 172: b=c or g or t
acgttgttggtgtttagaaatgctactgatttttgtatgttgattttgtatcttgaaactttttgttggttttttgagacagaatctcactctgttgcccaggctggagtgcagtggtgtgatcttggctcacggcagcctctacctcctgggttcaagcaattctcatgtbttagccccctaa

SEQ ID NO: 22069 - DNA, 157 bp, Homo sapiens
  misc_feature 122: v=a or c or g
tatcattcttttttgtgtgtgtgagacagaatctcactctgtagcccaggctggagtgcagtggtgcaatcttggttcactgcaacctccacctcctgggttcaagcaattcctcgtgcctvagcctcctgagtagctgggattccagggacgtgct

SEQ ID NO: 22070 - DNA, 185 bp, Homo sapiens
atacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaactg

SEQ ID NO: 22071 - DNA, 157 bp, Homo sapiens
tgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagaa

SEQ ID NO: 22072 - DNA, 281 bp, Homo sapiens
tgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccgata

SEQ ID NO: 22073 - DNA, 57 bp, Homo sapiens
gaagttacaaatcaataatctaggctcccacctcaagaacctaaaaaaaaaaaaaaa

SEQ ID NO: 22074 - DNA, 343 bp, Homo sapiens
tatagtattataatttcatgggattactgtcatacatggggtctgaagttgactgaagcattattatgtggtgcatgactgtacactaacaagtcaagtgacctcttaggacttagtctattaatctaaaggatgagaagtacattctaacatcaggtgtcttttctcgagcacaatcaaattttcattttcccaatctcttataatgactcatgaccgggtgaaggaggaatcagtgcaaattgcttgttgggatggaaacaggtgctagaagtgaggaaaaagcaatgttcaaacgcaaaggaagggtggaggaggaaaggtgtggagttgccacagggac

SEQ ID NO: 22075 - DNA, 422 bp, Homo sapiens
  misc_feature 34: y=c or t
tttctgctgtttggtcagttcctcccctcctgtyaagccacagttgtctctttagttcctctactgaatttcgtttggcatcagaagatttaaagattagctattagtcctagtgggtggtcaaatcaataccctggccaccatcccaggcttaaaagaaatgctcttgggatgattttagcccactgctttataagaagctgcctatccccaaaagtcaaggccccacagttcactgatacattcaataccatgaaaacggtgccatggtggtggttttctggtgatgcacaaggctgttcggatcacccactccttcactgaatgttcttggttatgcacaatgataataatcagtgtcattaaaggattcaacttaagcattaataatggaccacttctgtgtaccttagtagtttaca

SEQ ID NO: 22076 - DNA, 278 bp, Homo sapiens
tgatatacaaaaaataattccttgagtttttatgttggtctctttgttatagtgcttcaattcaagatatatgtgtatgtttgcaagtgtacacgttttctaataaggttgaagatgtagaaattgaaaagattattcctgctatggagatttacttttttaaagagcaataatcaaggaattaaaataaacatgaagtgtaaaatgcttaggttactcatgtttttcctcaagagaagaaatgctcatgtttttccctgaggaaaaaaaaaaaaaaa

SEQ ID NO: 22077 - DNA, 347 bp, Homo sapiens
  misc_feature 230: s=g or c
attccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtsaaagagcgagtgcctctccaagcgggggtgggagggggtcaggctgtgcagaggagagagacagcgagaagaagccgcggctggctactgcgaatttgggattcgattgggaggatt

SEQ ID NO: 22078 - DNA, 111 bp, Homo sapiens
agatgcggttgagtccttttcctggaagtcggtcagctgaaaaacaatgtaaattcccggttttgaagacttattgctctcaaatctgatggcttttaaacggaggggcat

SEQ ID NO: 22079 - DNA, 118 bp, Homo sapiens
caagagcatcaggtgaaatgtaaaagatagataagctttgatgtaaagcagaggtattggggttgaagggaaggatagattagaaggcttatttaaaaagagatatcatcaggacgac

SEQ ID NO: 22080 - DNA, 161 bp, Homo sapiens
aaatttgatagttgatttaacataggccaaatgacttgcagtgaaagaagaaaaataacactttaattattacctctttctcaaaatgaattgatttttgtcattgtagatctgtgctttaaacaaatgagtagtgcttagaagatacttttacaagagcc

SEQ ID NO: 22081 - DNA, 196 bp, Homo sapiens
ggcagagataattattctgaaaaactcaggggcagaaatattaagtgacctgcccaaggtcaccaagaatggggataagaacccaggttttgtgaacacccagtccagtactcctactaccttttcctgatatccttaggagcgggatccatgggaagggacctcagacccctagtgggttagcaaaaccccggca

SEQ ID NO: 22082 - DNA, 455 bp, Homo sapiens
tatttaggtggataactgaaacggaaaagcagtttgacacaaatacacagaaagaggaattgcggtgcataatcaatcgtctgagtcccataactgtaacactttttctcttataaattggtagttcctaaaaatcaccactttaaaaattttattctgtcttgctgaattaagcagaaatcactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagttaactgttgacactttcttaatgtttttgatgttggatgcattacaatggaagaattttttt

SEQ ID NO: 22083 - DNA, 126 bp, Homo sapiens
gtgggccgaggttccggcgcggctgctggccggcggctgagccgggagaaaggagctgcggccaccgttcgccctacttctgcgcctcggggcgggcgcgccggtaaaaatggcgaaatgggggtt

SEQ ID NO: 22084 - DNA, 147 bp, Homo sapiens
aatttgcgagctgcatgcatctcccaggggaaaagggctctctccgagacagctcagagggccactaaccaggtggagaaacgaaaccagaggaaggatgggaaggactgatccacattcccaccaggaagtttagcagaaccccat

SEQ ID NO: 22085 - DNA, 268 bp, Homo sapiens
ttttctttctctcctgctctcgcggcgggaacgcggggcctccgtgttctgctgtcttcatcagcgtgggccgcgggtagggggtagtggggtggctgggtttgggctttccagagaaggtgacgctgcctgagctgagcttaaagcacgcccaggagttagactaggagagggtcgtgtgggggaaagaagggcgttctgggcatcggtaaattcccagagaggatggagagctcagtgatctccagaaagtgaaagaggcggggca

SEQ ID NO: 22086 - DNA, 257 bp, Homo sapiens
tccgaatgaaccttatgatgtgtatattgagatgtactcagtgtgattttaaaccaaattgtcttcctgtagtcacaatatatactgtagccttttaacagcaagtcttgctttcccaaacagaaagccattctgaaatcctacagtatcacaggtgagaaaaggtggttattttttccccaagacaacagcactagtaatcccacttaataagagcttatttaattggatgtcagcctcttaactgctaagccaca

SEQ ID NO: 22087 - DNA, 148 bp, Homo sapiens
tccttctgttattgatttctaatttcattccattgtagttggagaacatactttatatgatttctatcctttgaagtttattcacatttgtgaaaaatgtcctaacatactgggtatccttgagaatattctgtatgcacttgaggac

SEQ ID NO: 22088 - DNA, 304 bp, Homo sapiens
  misc_feature 273: b=c or g or t
aaagtgctgggattacaggcatgagccactgcatccagcctgaaccaaatatatctttattataacttaggaaagaaacgtttttggctggttagttttacagaattaaacctaatggttgttctaatagcagttccaatgatttgcagatttgaggaagtaaattattttcttacagtgtccataaaagtaacaatgaaactatatcctaccataataatcctctataggtaataaattatttgcattttataggagagaaaaatatatgtbaaagtttttgaacagtcacacaggcaggccc

SEQ ID NO: 22089 - DNA, 409 bp, Homo sapiens
tttatgactcgtgggatggcctcttgaaatctttgaaataaaagcagcctgtgtgctagatcagagcctgaacatgcgtgctggggggcatgggagccgggaaggaggcattatgcaaacccgggagccacagttacaacaacggcatctgtccgagtgcagagcagggagccaccatgggctctgtgtgcaggcagggctggcgtgggctgtggccagccttggccggaagctctgcctgaggggaagccacactcgagcacccatctgacgggactgcacatgtgaagcctactccagaagggacctcagtccacctggcactgcccagcaggcatggggaaagggtcttgcttggatgggtgcatttgctgggcacctcttgccaccccatcatcaccaccagagt

SEQ ID NO: 22090 - DNA, 372 bp, Homo sapiens
atctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcaga

SEQ ID NO: 22091 - DNA, 446 bp, Homo sapiens
  misc_feature 440: w=a or t
acagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggawttcctt

SEQ ID NO: 22092 - DNA, 273 bp, Homo sapiens
actccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgcc

SEQ ID NO: 22093 - DNA, 254 bp, Homo sapiens
ccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcaaa

SEQ ID NO: 22094 - DNA, 194 bp, Homo sapiens
cttttcagcgcattcatttgaggagacacagtggcacagaggttaagagcaaaaggtactcagttagactacctagattgcaaccttagtttcaatagctactaactgcgtgatcttgaggaagttacttctctgggcatcagttttctcatctgtaaaatgggaatgatattagtaacacaaaatgactgcta

SEQ ID NO: 22095 - DNA, 297 bp, Homo sapiens
taagaaatcctcttattgtcatttaaatgaggcatccagatggagcatttttaggcccacctatctctgttgtttagactccattttctgtgtattactgaaaatgatacattattctcatttaaacaaaatggcaaatcaaagtgagtggttgatgtcagcaagactgacagaataggaagtgggaaggagtggattagtttttcactgttaccttatgactttgagttttaacaacagaaagagcttggaggttttttttaaatctagtgtttagaaaacttgaatatagtggag

SEQ ID NO: 22096 - DNA, 412 bp, Homo sapiens
  misc_feature 3: k=g or t
  misc_feature 33: m=a or c
  misc_feature 34: s=g or c
  misc_feature 243: w=a or t
  misc_feature 246: w=a or t
  misc_feature 401: y=c or t
ctkaattattcgagtaacttatcaccacttgcmstgacttgcaatggcatagtgtttctgctttttaatactctggcaattgtccttaagaaactaacacagtgatttgtttcactgttgaacctacttgagtgaaattgctatcttctagggttcagcacacattacctgcttcctggattacctagctattcctggaacaatttgacattaatgagcttattactatcatgttttgctgtwgtwgtctccaatttttcattcaaataaaaatttaattaacttttctgctttccatagatgtagtcttgaaaacattaaatctcatgttagctaagcctgattcagactttttctcttactatactgcctaaggctctatttttcttaggatacttatycaataaagaat

SEQ ID NO: 22097 - DNA, 213 bp, Homo sapiens
ttgaagtgggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaagacttactataaagctacaatagttacaacgattgc

SEQ ID NO: 22098 - DNA, 374 bp, Homo sapiens
agtttgagtgttaccagctttcgctatgcaacggccaagtgtttctcgggctgagaattatcagcttttgtgggatactattgcttccttaaaacaatgtgaacaagctatgcaacatgcatttattccggccaagttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaa

SEQ ID NO: 22099 - DNA, 366 bp, Homo sapiens
tctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacacca

SEQ ID NO: 22100 - DNA, 507 bp, Homo sapiens
  misc_feature 474: k=g or t
ccgtctagattttatgtgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctaggttttatatgaagatatcccgtttccaaagaaattctcaaatgtatccaaatatctacttccagattctacaaaaacactgtttcaaaacggctctgtcaaaagtaaggttcaactctgttacttgagtacacacatcacacggaagcttctgagaatgcttctgtctggtttttaggagaagatatttcctttttcaacataggcctcaaagcgctgcaaatgtccacttccaaatattacaaaaagagtgtttcaacctgctgtatgaagggaagtgttcaactctatgagtkgaatgcaaacatcacagagaagttctgagaatt

SEQ ID NO: 22101 - DNA, 124 bp, Homo sapiens
atgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcga

SEQ ID NO: 22102 - DNA, 192 bp, Homo sapiens
  misc_feature 128: v=a or c or g
actggtcaggtctgcagcttctgacagactgtgtgggtttgtttttgtctcctgtccagacttgtgtttgctcaaaccaattcttggtgcaaaggggcatccatgatgcctttgtaaaagcattcgcvgaggccatgaagaagaacctgcgcgtaggtaatggatttgaggaaggaactactcagggcccca

SEQ ID NO: 22103 - DNA, 507 bp, Homo sapiens
  misc_feature 27: w=a or t
  misc_feature 331: y=c or t
  misc_feature 444: n=a, g, c or t
  misc_feature 447: w=a or t
  misc_feature 457: k=g or t
  misc_feature 461: y=c or t
  misc_feature 493: y=c or t
  misc_feature 504: k=g or t
ttttctttaagtgaatgtttacagggwaacctagttgacaaaagtttgtttcttggcactttgcatttggcacttctgtaattttttaaggtgtcgactggttattaatagattaatcttccttagaactacaaataaccagatccagcactgtgcccttttctttttatagataagggaactgagacccagataatataaacctacgaagtgtacactagaaccttctgttacttctttatctaccacagggcaaactgtaagtaaacaattaaaataactgattcaatttgtgaatcagctctcttgaaatgatatagttgctcatgtyagatcttttgtgataacaatgattgaagtccaaaggtaattgtttaaaaaattgtcataagaattaggcagaacgggtagcctcatatacccaaggtggagtaaaagagagtngawattatgaatkattyttcttctataatagaaatctgttatgatagtyattactcactkatt

SEQ ID NO: 22104 - DNA, 287 bp, Homo sapiens
cactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacaaatacttgcaaccatcacc

SEQ ID NO: 22105 - DNA, 143 bp, Homo sapiens
  misc_feature 108: n=a, g, c or t
  misc_feature 109: s=g or c
  misc_feature 110: d=a or g or t
gatgtcagctctcgacgaaaatagagagggatcgcctgcaaatccccagctccggcggggctaaaccttgcaatccctccctggccggcgccgagccagagcgcaggnsdctccaccgcctcccccggcgcgcacacgaaccc

SEQ ID NO: 22106 - DNA, 109 bp, Homo sapiens
tttttttttttgaagaatagagtgatggtcatcagaattagctgaggcagaagaggaggcaaaatggtaatctggaaggttggtttatggcaaattcattaggcactca

SEQ ID NO: 22107 - DNA, 335 bp, Homo sapiens
atgtcatcagcaaacagcgacagtttgacttcctgtttatcagtttggattccctttatttctttctcttatctgattgctctggctagaacttccgtattatgttgaataaaagtggtgaaagtgggcgtctttgtcttgttccagttctcgggggaatgctttcaactttttcccattcagtataatgttgactatgggtttgtcatagatggcttttattaccttaaggtgtgcctcttctgtgtcaatattgctgagggttttaatcataaagggatgctgggttttgtcaaatgccttttctgcatctattgagatgatcacgtggggag

SEQ ID NO: 22108 - DNA, 112 bp, Homo sapiens
  misc_feature 11: m=a or c
  misc_feature 12: m=a or c
  misc_feature 13: m=a or c
cgcgctccctmmmgcctccttcccaagggcgcccttcttctgcccccagctcacgtctgaatccctcggcgccccctttctcttctcctagccccttcctcacgtccccgca

SEQ ID NO: 22109 - DNA, 290 bp, Homo sapiens
attatcaagtcatttttcacatttcgttcagtgtttagtaacacaactgtttaatgaaggcttgcagactttctttcataaagtttaaagttgtatgctgattgctgtatataattaatgtatcaaaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaa

SEQ ID NO: 22110 - DNA, 180 bp, Homo sapiens
aggagggccgagtcacctttctgatggtgagtttttctgcatcagcccaggatgaggaggaggagtagggcttgggctcaggtggagtcattgatgctgagagattgtgaagaatatactgacagcatccttgtagctgcatcacagtaaatcggacttctgaatcaagcagcccagccc

SEQ ID NO: 22111 - DNA, 122 bp, Homo sapiens
aagacctgcccccatgattcagtcatctcccactgggtccctcccatagcacgttagaattatgggagctacaagttgagatttgggtggggacacagagctaaaccatatcaagggccaaa

SEQ ID NO: 22112 - DNA, 135 bp, Homo sapiens
ttcttaatgatgtgtctcagaccaggcgtagtggctcacacctgtaatcccagcactttgggaggatgaggtgagcagatggcttgagcccaggagtttgagaccagcctgggcaacatgacaaaactccgtcac

SEQ ID NO: 22113 - DNA, 332 bp, Homo sapiens
caaataagttgtttatgatgatcctgaatgaagtaccatagggatgaatgatcagcagttgaccaaaattaaccaaagcttaaactatgttaagacatagtgctaggtatgctttatgaaatctaattatttgaaagttggattatgtacatttaatttttcaactgtcagaaaacaggatttattttagccagatatgtcattgcaatctgaataagcaggaattttctatgcctattaaatggattatttctagaaggcacaaattcagatggttaattttgaattatcccaagaagatcaatatataactgctaagggtgaatttatac

SEQ ID NO: 22114 - DNA, 430 bp, Homo sapiens
  misc_feature 37: y=c or t
  misc_feature 337: w=a or t
  misc_feature 344: s=g or c
  misc_feature 372: n=a, g, c or t
caattttgttttgttttgttttgttttgagacggagyttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctacaaggagagaccctgcctttaccaaaaataaaaaaatctgctgggtgtggtggcacatgcctgtaatcccagctacttgggaggctgaggcaggwgaattgsttgaacctgggaggcagaggttgcagtnagccaagattgtgtcattgcactccagcctgggcaactagagcaaaactcctatctca

SEQ ID NO: 22115 - DNA, 198 bp, Homo sapiens
aaatgttttatagaaatgcctagaattttgagactaatagtagttatccattaacattccaaaagttttgtgctttttaaaatttgttttggtaattatcacatttttttctcttaccttcctttaaatggccacaatgtgtactgctggaatgttccatccaaaagatgtagcttcagaagcacagtgattgcccca

SEQ ID NO: 22116 - DNA, 173 bp, Homo sapiens
  misc_feature 159: v=a or c or g
  misc_feature 160: n=a, g, c or t
ttcactgtgttagccaggatggtcttgatcttctgacctgaagatccgcccgccttggcctcccaaagtgctgggattacaggcgtgagccaccgcgcctggccttgatcttttctttttatactttcagtaaactgatccaagccttaactgttgtavntgtgtgatgaagc

SEQ ID NO: 22117 - DNA, 238 bp, Homo sapiens
aaaaatggaaaagaaagtgctttctcttcctctgagataaaatgggcaaaggagaagaaagtggaggtaaaaaaaaagtatatttcaagttgaagatgagaaagtacaattctcttggatggccttgattttcttagttgagcagatgaaagatagaagtgcatggttaggcaaaatgagaaagaaaatcaaaggtagaataattagatggatgcatagctggttagatagatgggag

SEQ ID NO: 22118 - DNA, 211 bp, Homo sapiens
tgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctct

SEQ ID NO: 22119 - DNA, 296 bp, Homo sapiens
caatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattttttaatgtgttgtaagacgtagagtttatctcaagctgttaaaaatggtaatgtacaaatgtgaatagacacttatctatataatatgggtaagttttgtttcgcctataatagatgtttataaaaacaagtgaggggactga

SEQ ID NO: 22120 - DNA, 133 bp, Homo sapiens
agttgaggacttttttgttctgctacagtactattatataacaaaattaacataaagtatccagttcatcttcaaattttctcactcgtctcaaaaatctttttgtgatgtgttcaaattgggatccgatcat

SEQ ID NO: 22121 - DNA, 161 bp, Homo sapiens
ccatctcttaaaaaatgtcatattcttaacccaaatctggtcttctgaactttgtggttgataatgtcattttgtcattaatgtgcatttaattgatcgattttatacttccaatattgatcaattttatatttgcaattttagctattattcggggcgga

SEQ ID NO: 22122 - DNA, 435 bp, Homo sapiens
caggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgc

SEQ ID NO: 22123 - DNA, 192 bp, Homo sapiens
attctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcatgagccaccgcggcca

SEQ ID NO: 22124 - DNA, 200 bp, Homo sapiens
ctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaagca

SEQ ID NO: 22125 - DNA, 160 bp, Homo sapiens
aaatgttaaattcgggtttattttagtaatcactcacctattgaagtacatcttggttgcttccaagtgttggcaactatgaataaaactgcagtaaacatccatgtgcaggtttttgtgctggcataagttcaactcctttgggtaaataccaaggagc

SEQ ID NO: 22126 - DNA, 137 bp, Homo sapiens
  misc_feature 34: s=g or c
  misc_feature 35: r=a or g
aaagaaatcatagacgacacaaacaaatggaaasrcatcctatgttcatggatgagtagaatcaatattgtgaaaatgaccatactgccaaaagcaatctacaaattcaacacaattcccattaaaataccaatgtc

SEQ ID NO: 22127 - DNA, 145 bp, Homo sapiens
ttttcattttccattattatgtttgtaatgtgcaattatagataaacctttatttcttattgcatcaaatttgggtgtggtttcactccctgttctgtgcgttgagggtggcagccctcagccccttccccactagccagccctc

SEQ ID NO: 22128 - DNA, 344 bp, Homo sapiens
  misc_feature 13: s=g or c
  misc_feature 32: m=a or c
ccttctaatttcsttgtaagtactgctttatmagcattcccccacattttgacacatatgtcttcatttttattcaggtcataatttaaaataatttcccttttgatttttttcttgacctctaagttatttagaagtttgttattgagtttccaaatatttggaaattttaaagatatctctgttactgatttataatttgattccattgtggttagcatactttttatgatttgacatcttgtaaatttattgagacttgttttataatccaaatattctctctttggtaaatgtcctaatgcacttaaaaataatatatattctgctattattgggtgagt

SEQ ID NO: 22129 - DNA, 279 bp, Homo sapiens
actttttagcgtcttctgttctgagttcttctggttggtcacctcctgcttgctgaatgtgggcactgcattaatagtacacatgctgaggacaaggggaatcagccaggagccactggagatgttatcatggcccccagagacggaagatgaggatgggacctgttttcaccacccacctccttccctttttcctcttgttaacttcccaaataattttataactttaaatgattttatcaaactttgatttccgggttttattccatccatccactt

SEQ ID NO: 22130 - DNA, 438 bp, Homo sapiens
  misc_feature 13: s=g or c
  misc_feature 269: w=a or t
  misc_feature 308: m=a or c
  misc_feature 398: k=g or t
  misc_feature 402: m=a or c
aaaaaccaagccstactgcctggtgagcaagagagattccaaagactttactttgaaaagcatctcccagcttctacttttttttaaggaaaagtagattttctttgtctttgtttttgttttaagcaagaacagaatctaatgacttttttcatgccatcgctttgaaatagcgtcgtcttcctttctttctctccctcttcctggcaaagtatatactggatttttattgccttcttgggtttttttccctacgtgtatcggccgtwatgcttagccagtttattctttatttttttactggagtmattgccagtgatggaaacggtgtttgcttctctttcagtcaagatctgcacaaagtatagcattaggtggtatttattgttttatgagtkctamattcatctttccagcactctgaagttatcagcaagt

SEQ ID NO: 22131 - DNA, 334 bp, Homo sapiens
  misc_feature 277: y=c or t
  misc_feature 303: y=c or t
  misc_feature 334: s=g or c
cgtgacacataatcattccatccaatgatcgcctttactttaccactctttccttttatcttattaataaaaatgttggtctccaccactgactacaatgatttccccatggattcattttcagaggagttactaaggcgtactatattaacctcttgcctccccttcatttattttttcccacttcttgaaaagttccgaagctgaaatgatcaatattcatacccatatgccatttgggagtccttgtgcaaagatgagtatttttttttttatyccaagcttctttacctttcctgagaycgatgccaccttgtcagcttctctgcctccs

SEQ ID NO: 22132 - DNA, 147 bp, Homo sapiens
cttttaaaaaatggggtttattaaagaggttaggctgaaggaggaagaaggaaaaaagtcctgcttctaaagtatttgaagttaaatggaaggcaagacaaacttaaagactcctgtgtattaggatttttttttaacaaaggagtg

SEQ ID NO: 22133 - DNA, 221 bp, Homo sapiens
tccgtctgcttgaaatgctccttgatttcttttctgcctggaaagtttatttcctttcgggtgtaagtgaaatatacagtttcccctattaagggtttccaggttccccaagaggcaagtgttgtccttcttgtttgccctgttcatatttgtatcacccagaacatttaccacttgaaatatctccttcactagactgatacttattgagggccgggcat

SEQ ID NO: 22134 - DNA, 58 bp, Homo sapiens
aagctatgagctatgaagttttctggcttggatgggtcagtgataatttcaggggtaa

SEQ ID NO: 22135 - DNA, 399 bp, Homo sapiens
  misc_feature 261: b=c or g or t
taattatgactatagtttttgcacatataagttttacacatggctgtaatgacaagaagaaagcttctgcattgtctttggtcctggttatgataagtaacactgtccgccagacggtatagtgatagaccctatactgtactgaacttcaaaagatatttgtaagatggagagttgccagtaagtagaatgctttcaccctacttcaatattagtttaacaactggaaagatctggctgcttaaatattaaacacatgtbcaattattaaacacttaggattcttcttctgattattaaacctgtatgtaaagaacattggtgctaatgtgcagtcagcttgactggcaccacaatcttcccatgttgtggatttcaaattgtttctatactgtctca

SEQ ID NO: 22136 - DNA, 420 bp, Homo sapiens
  misc_feature 350: s=g or c
ctatatctcttcaggacaggaactgtgttttactcttctttatgcccatgtgacctagaacgtattttgttcttaataagtatttgtccacaagtgaactatcacacagaaaaaggaatctggatcagataggattaagtttatctacatactacagaaaaacccaaaataacgatgttgaagagatagagctgtacttttatgtgtagaagtaccaagacaggcaggcagtccaggattggtgtggaggctccagaagttcctaggctctctccagctttctgcccaacataactaaggtacagccctcatcttcatttctctgaatgattattaagattacagcagtsatatcccagttccaagctataggattgaggaaaggaagaagggtacactttttcaagacttcctgtgaca

SEQ ID NO: 22137 - DNA, 337 bp, Homo sapiens
  misc_feature 337: k=g or t
aaattggggagtagggattaaaggagggaagaagagaaatggcagcagatgcatttttacgttgctcaattggaaattgttctagcaaatacagtctgaattttaatagaagggtacttcagataccttaaccttctttgaatcagatttggaaatggacatatataaaaatgattgctccttatattatagatcacttgtatgctgattcagaaatgttgcagttctcccctcaacacagctctccactgtaactccatggttataatggttggtatctaagaaggaggtttcccataaaaagaatggaggtgtgcacttatttttggcccgggtk

SEQ ID NO: 22138 - DNA, 207 bp, Homo sapiens
caactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacccca

SEQ ID NO: 22139 - DNA, 150 bp, Homo sapiens
ctgtgactacagggagattagcacttcgtctagtgaaactcctttcatctctgtcctatggccccaccccaccattccctctaggcccagaccatcatcatggccctggccattgatgtgtatgggctttctttccctcatgcagcccct

SEQ ID NO: 22140 - DNA, 230 bp, Homo sapiens
atataacacaatcttgtgtttctctttttgtattgtgcccatatttagggaccctggtgaagtaatcatgttgcccaattgaccctggtagcattatgtggtagggtcttttcatcagctcttggtttatactggatgctctttggtttttgttgttgttgttttttaagtgaggagtctttaattaattttcctatcagtcatccttctgtccttaacaaacccctgcc

SEQ ID NO: 22141 - DNA, 161 bp, Homo sapiens
ttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaa

SEQ ID NO: 22142 - DNA, 191 bp, Homo sapiens
  misc_feature 167: s=g or c
ctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctsacgccccctcctcatcctgcacca

SEQ ID NO: 22143 - DNA, 328 bp, Homo sapiens
tacaatctgctgcaggaactgtcagggaaatatgaatgtgatcagtgccgtgaaaatgggtaagcataatgcgttaaagatgcaggaggatctgtcacttctagttggagagataaaatggggtttcctgaaaacagggcaattaaacaatttttttaaagtgacaattgaaccttgaaagaaaggtagtgcttttaaatatgtaattgaagcaagaacattctaggcagtgggaacaatataataaaggtatcaacattcaggaattaacgaactatggcccttgggcccaatgcagcctgccgcttaatttctaagtaaagtctac

SEQ ID NO: 22144 - DNA, 287 bp, Homo sapiens
caatttcagaacctgttattggtctattcagagattcaacttcttcctggtttagtcttgggaagatgtatgtgtctaggaatttatccatttcttctagattttctagtttatttgcatagaagtgtttataatattctctgatggtagtttgtatttctgtgggatcggtggtgatatcccctttatcattttttattgcatctatttgattcttctctcttttcttttttattagttttcctagtagtctatcttttttgttgatcttttcaaaaaaacagcgt

SEQ ID NO: 22145 - DNA, 212 bp, Homo sapiens
ctatcaagtccataagctagtcatatctaggaccatcttgttaaaaattctctcaaagtctcctcagccctcttgtaaacagacttctggaaggtccacttcatcagtttgttatatactttcagactgtctatctcttgtttagattcagcatggcaccgtacgttgaatggactgttaatagatgtttgctgaatgactccaccacagca

SEQ ID NO: 22146 - DNA, 199 bp, Homo sapiens
aacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacagt

SEQ ID NO: 22147 - DNA, 152 bp, Homo sapiens
cgtgtgttgccattttgtctggctgtggcccctccttctcccctccagacccctaccctttcccaaacccttcggtattgttcaaagaacccccctccccaaggaagaacaaatatgattctcctctcccaaataaactccttaaccactca

SEQ ID NO: 22148 - DNA, 356 bp, Homo sapiens
catttagcttccacttataagtgagaacatgctgtatttgttttctgttcctgtgttagtttgctaaggataatggcctctagctccatccatgtccctgcaaaggacatggtctcaatttttttcttttatattttgagatggagtttagctcttgttccctagactggagtgcagtggcgcaatctcggctcaccgcagcctccacctcctgggttcaaacggttctcctgcctcagcctcatgagtggctgggatagcaggcatgcaacatcatgcctggctgattttgtatttttaatagagatgggggactttctccatgttggtcagcctggtctcgaactcctgaccgc

SEQ ID NO: 22149 - DNA, 155 bp, Homo sapiens
ttatatgtgtcagggagaggaaattgatctcctgaggggtgggtggaagagcacttgtccctagttaatccttttttgcctgttctttaaaaagcgtgatagataggccaacccactatgagttttctggtggcaaaagtacaagaaatccctgt

SEQ ID NO: 22150 - DNA, 193 bp, Homo sapiens
  misc_feature 155: k=g or t
ataaaagtttgagcttataaaagtttgaattatatcgaagatgaaatagaaatgtttagtaagatcttttggtgcatttaaagtataagttaatttgtggaattaaacacacttacatacacaaatgatataagatctaccttatagaaccagtkaaaatgctttcaggtgcaataaaccttcagtggcaccc

SEQ ID NO: 22151 - DNA, 310 bp, Homo sapiens
  misc_feature 2: k=g or t
  misc_feature 26: k=g or t
  misc_feature 27: k=g or t
  misc_feature 184: n=a, g, c or t
  misc_feature 265: k=g or t
tkcacatcagtacctttgtataaaakkaactgattatgtgtatgggctggtttctggaccctctattctgttcatgaatttttgtctaacctaatttcaatattgcactctcttgatttttgtagttttatagtaaatcttgaaatcaggtagtgtaagtcctctaactttattcacgtatgtnaaaactatttggccattctagcttcttcgcatttctaaagaactttttaatctgcaccaaaagaagtaaaaagtctgcgtkaatttttattgagatagcattggcttaatagatcagcctggaata

SEQ ID NO: 22152 - DNA, 156 bp, Homo sapiens
aaggttgtaaaatgtgatgtgtatgtgtatatactgtatgtgtactttttaaaataggtgtatgtcccaacccttttttatacaggtttgaatttaaaattacatgatatatacatatactttattgttctaaataaagaattttatgcactctca

SEQ ID NO: 22153 - DNA, 215 bp, Homo sapiens
  misc_feature 140: k=g or t
ccaggctggagtgcagtggcgcaatctcggctcactgcaagctccacctcccgggttcatgccattctcctacctcagcctcccaagtagctgggactacaggcacccactgccacgcctggctaatttttttgtgtttktagtagagacggggtttcaccgtgttagccaggatggtctcgatctcctgacctcgtgatcatgactgcctgcaa

SEQ ID NO: 22154 - DNA, 436 bp, Homo sapiens
  misc_feature 100: k=g or t
  misc_feature 426: y=c or t
atagccacggtaacggcggggtggaaagctaaggcctttgaagacctgggaccccgtagtttcgggagagggtgaggggtgaatggtgctgaggtgcgakgagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagtycgactccagc

SEQ ID NO: 22155 - DNA, 310 bp, Homo sapiens
  misc_feature 149: n=a, g, c or t
catcttgaaaccgctggatttataatgttaatttgtgcaaatacttgtttaaaatataacatacattacataactataaaataaatttgaacactttaagcattacctgtctatacataaaaatctaaaagaaaaaatcaacgtgagtnagatagcatttgtgatgatctgaagaaatatgtgacgtttatcagaattaaacatggctcaaattaaactaacactagagtttgttctcagttacgtgaaacacccacaatccttcaaggttgtccaaaataagcagagtgcttactgtgtgagcgcacct

SEQ ID NO: 22156 - DNA, 167 bp, Homo sapiens
  misc_feature 139: w=a or t
  misc_feature 162: k=g or t
tgtatttttagtagagatggagtttcaccatgttggccaggatggtatcgatctcttgaccttgtgatctgcctgcctcggcctcccaaagtgctggaattacaggtgtgagccaccgctcctgccctttttttttttwaaagaagaaaatgcaataatatkacaac

SEQ ID NO: 22157 - DNA, 132 bp, Homo sapiens
  misc_feature 12: m=a or c
  misc_feature 13: v=a or c or g
  misc_feature 71: m=a or c
  misc_feature 122: b=c or g or t
  misc_feature 127: n=a, g, c or t
  misc_feature 128: k=g or t
cgcttcgtgctmvcagggaagcctctgcacgccctcccccgctgctctcggtcgcctcctcgccgccagcmgccccgggtgcatcccggcttgctccgctccacgcgacccagattcctgcbccgcnkccaa

SEQ ID NO: 22158 - DNA, 161 bp, Homo sapiens
ttaggagatgctggtgtgcctgaagtgatgagtgaggatgaaagtgacctgagaggggaagaccccctaacagggccaggtcacatgcagctgtgtgggctgtgttaatgatcttgggttttagcagggaaatgacacagtcaaattagtttttttttttt

SEQ ID NO: 22159 - DNA, 391 bp, Homo sapiens
  misc_feature 341: k=g or t
  misc_feature 343: y=c or t
  misc_feature 344: k=g or t
caagtcttagagttcactccttccctaccagggcctgaatctggcacagtagactagtataggctgagagttcatcctttttgattctgccactcttaaaattaggtcttgtgcctgcaggaaatgattgtctttaaatgctgccaaagcagcctggcatggtggcacatctgtaatctcagccttccaaatttctgggattacaggcatgagccaccacatccaggctcatagttggctttacatttttgattgctatacctgaaactcattttctcttttcaatgaaacagtcctcttaatagcagtcacccagtttcacagtccttactgtaactgtktykcctgtacctcctgtaccaagacatcaaaatcgcctggatattataca

SEQ ID NO: 22160 - DNA, 149 bp, Homo sapiens
  misc_feature 56: s=g or c
  misc_feature 57: s=g or c
gctttcaacatacgaggtgaacttttacctttctccatttaatataaaccaaaatssgtcttttaaaaaaatgtttatttttaacttttattttagattcaggggtacatgtgcaggcttgttatatagataaactcatgtcacagggg

SEQ ID NO: 22161 - DNA, 248 bp, Homo sapiens
tgacttgagtgggagggcatgtgccttccctcacatcgtgccagctcctaacctgctcaggccacttagtagctcataggcagcttcgtgcttttctgcgccccacttgttgcctttcacttaggctctcaaatagtagagtattactgtcaatgttttggttactgcatttttgaaattaatttaagaaagtcttaacactgacacttcttaaccactagccttccaacacacacacacacacgctc

SEQ ID NO: 22162 - DNA, 388 bp, Homo sapiens
  misc_feature 74: k=g or t
  misc_feature 76: k=g or t
  misc_feature 77: w=a or t
  misc_feature 78: y=c or t
  misc_feature 341: k=g or t
gagaaatcgttttatgggttgctcaggagatagaattgacatgtcttgggattgttttgctgtgtaggggagakakwyaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtkagacaggaaaaacctagtaacgtggtgtgatgaagctaggggaggaa

SEQ ID NO: 22163 - DNA, 349 bp, Homo sapiens
  misc_feature 315: k=g or t
tttctttttcttcagatctgcagaattgaaatgaaatgttttgagctcttcaagctgactcgtcagaatcctggagccttttaaaaaatgacgaagtgcccaatgtggaaatcatagatttcaaggaaggaacaagaaaattgatgaaacaagttcaaaagaaaggtacctgtgcctcatcattcctaaagaacactgatcaatgatcccagaagtatgccatgttctcttaattcatcagagactgaaagcaaaggaaaatcaagaaatgtcatgatgtcatactaagaagaaaccacctgagatgagactgtkagatgttcagagcaaacaaaaacaaaaacagaca

SEQ ID NO: 22164 - DNA, 162 bp, Homo sapiens
aggtacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattat

SEQ ID NO: 22165 - DNA, 266 bp, Homo sapiens
  misc_feature 14: s=g or c
  misc_feature 44: s=g or c
atagtatgtccccstccccagatatagaggacagagaaaacttscaagtgccacaagcagaaataaaccaaacacatcctttctgttcctgaaggtcaggaaatctgcatttcagttgaaggctgcagctgtctgctgtcccatctttagagtctccttgcttcttgggggcttccctcccctcacccgcactcaagtgaagcccatctattactaccttctgaggctggaaatggtgcacgctgcaaacactgagcaacatgaca

SEQ ID NO: 22166 - DNA, 340 bp, Homo sapiens
ttcatctcgtaatttcattcatgaaggttgggaattctgttactcagaatcttacctattttttccaagtagtttctctcagagaacaaaaactatgtatagtatgtgtgtacatatgtaaatttatgtaacatattaacatgttattatgatatgtaacatatcattatgtattatgttaacaattataatctataattctatagattaaccctaagatttatttttccctaccatcttcccattgttgcccaaataactgagtgctgtctttccccacctccccgtatcacccaggctggtctcgagctcctggcctcaagcaaacctcctgccttat

SEQ ID NO: 22167 - DNA, 155 bp, Homo sapiens
taacatcagatgtgttcttctgttttatcaactacttactcttcccacacgcttagttctaaatctaacctttccccccctcgaatagggggcaggggaggatgaggaaacactggaacaactgaacacccctgcccattttctccaagagccca

SEQ ID NO: 22168 - DNA, 128 bp, Homo sapiens
tgtatttttagtagagatgggatttcaccatgttggccaggatggtctccatctcttgacctggtgatccgtccgcctcggcctcccaaagtgctgggattacaggtgtgagccaacgcgcccgacgg

SEQ ID NO: 22169 - DNA, 142 bp, Homo sapiens
  misc_feature 116: w=a or t
  misc_feature 121: y=c or t
ttacttataatgaagtacttgggaaagcggttttcaagagtataaatatcctgtattctaatgatcatcctctaaacattttatcatttaattaatcctccctgcctgtgtctatwattayatacatatctctacgctgcca

SEQ ID NO: 22170 - DNA, 284 bp, Homo sapiens
  misc_feature 272: k=g or t
caaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagtkgtaacgcccgca

SEQ ID NO: 22171 - DNA, 146 bp, Homo sapiens
aatttaattctcataatgaccctatgaggctcttttattatttccttattatagctgaggaagatgaggagatagagttaagtaacaggtccaacgccttacctagaagtagcagaaggggacctcaaacccaagaacccaagcac

SEQ ID NO: 22172 - DNA, 368 bp, Homo sapiens
caacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtca

SEQ ID NO: 22173 - DNA, 171 bp, Homo sapiens
aatttttgtataagatgtaaggaagggatctagtttcagctttctgcgtgtggctggccagttttcccagcaccgtttgttgaatagggagtcctttccccattgcttgtttttgtcaggtttgtcggggatcagatggttgtagatgtgtggtattatttccgagggctc

SEQ ID NO: 22174 - DNA, 275 bp, Homo sapiens
ataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaa

SEQ ID NO: 22175 - DNA, 147 bp, Homo sapiens
gcagagtcgggcgtccgcgtcctcccggccagctcgaccgtcttctctattgggagtctctggtactcaggctggagtgcggtggtgtgatcttggctcactgtaaactcaagctcctgaactctacacaacatattttgtcagcca

SEQ ID NO: 22176 - DNA, 249 bp, Homo sapiens
tttagtagagatggggtttcaccctgtaaagacatgactttgaaggataggaaagctaactaaccagtcataagtgaatatcattgcagggctttttagcatatgggggtacttttttgacttcctgtaggatgttcagtgttgtccaagtaggtctcaaatagaaccccagtgaagtcatattgtttcctttaattcttacttttggggcaatgcagggtttctcttcttcttttttttttttttttt

SEQ ID NO: 22177 - DNA, 295 bp, Homo sapiens
tatacacaatgtggtaatctgagtaagatcctagaatagagaaaagacattaggtgaaaacaagaaaatctgaataacatatgaacttgagttaataataatttattaatctatctatctatctatctatctatctatctatctatctatctatctatcaagacagagtcttgctctgtggcccaggctggagtgcagtggtgccatctcggctcactgcagcctctgcctcctgggttcaagctattctcctgcctcggcctcctgagtagctgggattacaggcgccccttcc

SEQ ID NO: 22178 - DNA, 203 bp, Homo sapiens
tgatgcaaaaatcctcaacaaaatacaagcaaactgagttcaacaaagcattaaaaagatcatgcatcatgagcaagtgggattatcccagggatgcaaagatagttcaacatatgcagatcaatcaacgtgaaatatcaacgggttggacaaaaactatataggaaaaaaatctaataatctaatttaaaaatgggcaaaag

SEQ ID NO: 22179 - DNA, 267 bp, Homo sapiens
tttttttgtagagatggggttttgccatgttgcccgggcctgtcttgaactcctagagcttaagtgatccacccgcctcaggctcccgaagtgctgggattacaggcatgattataggcctgagccaccacaccccgcctactatagcagttttttaaaaaaagcattatgttaaaactgattataccagatggacattaaatatccatctcagaaataccaaaatttgatacataagcctggcctgaatatctttttttttttttt

SEQ ID NO: 22180 - DNA, 194 bp, Homo sapiens
  misc_feature 139: r=a or g
  misc_feature 194: r=a or g
tttttcccaccccggtgcgcgcacagtgctgaccacggacgaccccactgttgcccccggcgagcaccaggactctgctggttagggctgcgcggtcagacagggcggccacctggtacgtgcgctgctgagcgcttgrcctgcggccagtctgaattgagatgtgctgtaagcgtaaaatgcataccgatgar

SEQ ID NO: 22181 - DNA, 419 bp, Homo sapiens
  misc_feature 349: n=a, g, c or t
  misc_feature 350: m=a or c
atccccattgggtttctagaaaatccttagaaccacattatacagatgcctgtgctggacatgaggtttcagaagatgatctcaaagttttgcttttctctaattctgagatcctaaaagccaactctacaacagagattgcttagataagtgcaaagtggtagagcaatttaaggactcataattatgtacgtgcaaggaactgtgtcaagtatatattttcatgatgctatcaaatattaagccaaattcaccctctgcatatctacacattcacagcctgaatcctttcccacttcgctcatacctcaatacctgtcacttgccctgtctcttgtctctccctgtnmctgtgtttatcttgctctgaaggctttcttgaggcatttctccctcctttcaactctaaaaatcccaca

SEQ ID NO: 22182 - DNA, 233 bp, Homo sapiens
  misc_feature 32: k=g or t
caattagatttcttgatagagacataaaaatkttttgattttactcttgaatttttttggcaagcttaacaaaggccaaatcaatgctaaatcagaggtatttacaacatccacaaatttaatccaaagtggatacttaaaacctcatatagatctaaatgatattctcccagatggtgaattaatgtaattttagcaggaagcaaagttgcacaaatatgcagtattgagga

SEQ ID NO: 22183 - DNA, 349 bp, Homo sapiens
  misc_feature 32: m=a or c
ctgaagcccctattttattctcttggagtaamtgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttctt

SEQ ID NO: 22184 - DNA, 157 bp, Homo sapiens
  misc_feature 7: b=c or g or t
  misc_feature 8: n=a, g, c or t
  misc_feature 116: s=g or c
aaagggbnggctgtttcggcggccgcgggatgcccctgcgctgaccgccaggggcaggtgcccgcccgcgtagacgcacccggcctgaccccgcgcaaccatgtaaacggcgccasaggcggacgctggcttctccgcctgggacccctccgccccg

SEQ ID NO: 22185 - DNA, 438 bp, Homo sapiens
  misc_feature 7: v=a or c or g
  misc_feature 8: y=c or t
  misc_feature 9: s=g or c
  misc_feature 10: k=g or t
  misc_feature 300: r=a or g
  misc_feature 305: m=a or c
  misc_feature 306: r=a or g
  misc_feature 307: h=a or c or t
ttttggvyskttttggtgtctttaatgctctatttaatggaaccatctttcccctcaccccttggacatatggagctgtaaacaaaatataaaattctaagccccccacctgacgaatggaccctccctccccttggccagtggaattcccaagttaacctgaaaaattagttcaggctgtggtgggaaggtgggggtcaggcatgcctccttctaccctcctcccgttttaattcaggcacagctgaccagcattaacattaaaacagagaccttcagatttcagatctgaagacgaarcagamrhtgtagcagtaagataccaaattccagcccgactctagtatagcatcacttgacagattgcaggccctggaagaaatggaagtattttaccccaaaatatatttctttgacatattttgaaacggcctgcaa

SEQ ID NO: 22186 - DNA, 145 bp, Homo sapiens
aagaaatgacagaaataagtggtcaaagatgacttcatcatagatttttggttttggcttaagtaaccaagtgtattatgctggcatttactaaatgactttgggatagattgggagcgtgagaaataattacgaaatcttctta

SEQ ID NO: 22187 - DNA, 263 bp, Homo sapiens
taaagaaatatgcagacccaggctatcctccagagactgatgtgctcagtcagttttagagcttaggatgtgattttaataaccctcccttcaccagatgattttaatatacatccctggttataatcatgatggaatgagtagaaaagaaaatagtgttgatttccaatacatgtatccctaggataaatttcaattagaccacattttcttcagcatcctgccttctcaatcagtatgcctctcccctttataagcacccc

SEQ ID NO: 22188 - DNA, 178 bp, Homo sapiens
aaaagaagaataaaataatttggatgcaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactc

SEQ ID NO: 22189 - DNA, 447 bp, Homo sapiens
  misc_feature 7: y=c or t
  misc_feature 8: y=c or t
  misc_feature 9: w=a or t
  misc_feature 360: w=a or t
  misc_feature 383: k=g or t
  misc_feature 395: w=a or t
  misc_feature 399: w=a or t
  misc_feature 401: y=c or t
  misc_feature 425: n=a, g, c or t
aatattyywgaaaatagaagaggagggaacatttcaattatatctatatacatgagcaataaacaatttgaaaatcaaattaagaaaacaattgcagttataaataatagcatcaagaagaatataatatttagggatacatttttaaaatgaagtttaagacttgtaaatggaaaactacagaaatattcttgaaagaagttaaagaagatctaaataaatgaaaagacatctcatgttgttggatcacaacacttaatattgttcagatggcagtactccccaaattgatctacagattcaacgtaatctttatcaaactatcatctggctttttaaaagaattgacaagctgacctwaaatttatatggaataccagggkcctggatagttwaaawcytttaacagagacaagtggagactnaaaattctcaatttcaaaactt

SEQ ID NO: 22190 - DNA, 122 bp, Homo sapiens
aggggagtagcgaggagagcaggagacagtgtgcctgctcggtcccaggactctgtttactttgtctgctttgctaaagaaggccggtgaaccaggaccaccgcacacacaggccccaccag

SEQ ID NO: 22191 - DNA, 311 bp, Homo sapiens
  misc_feature 146: s=g or c
  misc_feature 147: s=g or c
gattcttgtgccttaccctcccaagtagctgggactacaggcacacgccaccttgcccagctaatttttctatttttagtagaggcagagttttgcaatgttggccagggtggtcttaaactcctgacctcaagtgatctgcccassttggcctatcaaagtactgggattgcaggcatcagccactgtgcccggccgccactatttcttaaaaggaagggaaggctccatttcctccatatcttaaaggagaaaaaaagccagtgggaaaaggaaataacagagatggaacacagaaaaagaacagacgc

SEQ ID NO: 22192 - DNA, 154 bp, Homo sapiens
ccatcaggtgtggtaaaatagcagagtatcatggcagaactgtgtgttcatttaagaacaatgggcaaggctcaagacaaaataatacaggaccgtcgcatttctttttctttatcccaccctccccaacctgagagttcacacacaggagggt

SEQ ID NO: 22193 - DNA, 467 bp, Homo sapiens
aaatttccaacaaacatgttaaaaaataattcatagtgattttctaaaaatcttgatagaaacttaaaaaaccaaccctgtatccatagaagagatgtaagccatttctcccttcttttcgtgtatgtgcctctgggcactggtgtactctcacaggttgttatgaaaggagtcttagccattcctgtgtctgcagaggctgcagctatgaatgtcaagacaagtctgcacatcttagtggtatgactggttcctgtatgttttaaacttattctcagattaagtttatctctaacttatttgtccattttcttcttttttccataagctaatttaaaactctcattggaaaggaaaacttgtcctatgagggtcaaatgaaaactacttcgactttactcacattattactttttgcagccttcaatgcttgaaaaatatgtgctgggattacctcactccagaga

SEQ ID NO: 22194 - DNA, 165 bp, Homo sapiens
tctccatgttggccaggctggtctggaactcctcacctcagatgatccgcccacctcggcctcccaaagtgctgggattacaggcgtgacccaccgcgcctagcccccagcttctttcaccagcagaaggcgggcaagcctcagggtgagaggacttcaaagcac

SEQ ID NO: 22195 - DNA, 411 bp, Homo sapiens
  misc_feature 313: v=a or c or g
  misc_feature 314: w=a or t
  misc_feature 315: k=g or t
ataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttgaccagaatagagctttgccaggtaactgcvwkttgctaggtgaaaggggaaaagcagtagctggatatatttcaaatgaggttttgaacaagttcagaaagtggaacttgattgaaaagtgaacaaga

SEQ ID NO: 22196 - DNA, 136 bp, Homo sapiens
tttacaaaaggagtggggagtagtgggcagcagtgagccttacctagttcccacatcgttttcaaggtcggtgtcactcctgcggtgctctggtgacagcacctggtttagatctaggcagtctgcacacagaatt

SEQ ID NO: 22197 - DNA, 373 bp, Homo sapiens
aaaagggagattcaaaagatcctggagtttgtggggcgctccctgccagaggagaccgtggacttcatggttcagcacacgtcgttcaaggagatgaagaagaaccctatgaccaactacaccaccgtcccccaggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatcaaacctgaccaagcggctcaagaataaaatatgaattgagggacc

SEQ ID NO: 22198 - DNA, 354 bp, Homo sapiens
  misc_feature 292: s=g or c
  misc_feature 293: k=g or t
  misc_feature 294: n=a, g, c or t
ctgtttctaggggagcatggcaacagagccccagctgtcaggccattctccctatctcagcatgttctagtgatcccagctgttctagtgattattgagaactacaaacaacaagggcgctgggggaaggtcagttcgatgctttctggagaactatccttccaaggtggaggatcccatcttggataccacattaccttaaacactgcctcagccaggtgatcaaggtcaacgtctactgtgataagtcatggttttggtgtgtacccttgatgtgatgtgataaaaatgskngtttacctctgtggtcttcctctgaaaaatcccgtaacagcagcctaatcatgagaagcc

SEQ ID NO: 22199 - DNA, 380 bp, Homo sapiens
  misc_feature 326: r=a or g
cataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacagctggctggggggacctataccagccccagcaaaagaagaagaacccacaggctgggaggaaccatccccagaatctatacgtcgcaaaatggagattgatgatggaacttcagcttggggagrtccaagcaaatacaactacaaaaatgtgaacatgtggaacaaaaacgtcccgcc

SEQ ID NO: 22200 - DNA, 338 bp, Homo sapiens
taaatttatatttatttaagaaatggccaaactgttttctaaatggctgtatcattttacatccccatcaacaatatattagggtttcctgtttctccacatcctatttgttaatggcttttaaaaattatagacattcttgtaaatgtgaagtagtgtctcattgtagttttagtttgcattttcctaataacaatgatgtttaacttttttgtgtgtgcttattagctgtttcacatgcccttatacatattccattttttacttactgtttccataaatcactgcatgtaaattcagagctctctctctgtctcactttctcttttgttgtattc

SEQ ID NO: 22201 - DNA, 167 bp, Homo sapiens
  misc_feature 45: s=g or c
  misc_feature 46: n=a, g, c or t
gcggcgaccggacgtgcactcctccagtagcggctgcacgtcgtsncaatggcccgctatgaggaggtgagcgtgtccggcttcgaggagttccaccgggccgtggaacagcacaatggcaagaccattttcgcctactttacgggttctaaggacgccggagggac

SEQ ID NO: 22202 - DNA, 446 bp, Homo sapiens
  misc_feature 230: y=c or t
  misc_feature 231: n=a, g, c or t
  misc_feature 232: v=a or c or g
  misc_feature 234: n=a, g, c or t
  misc_feature 241: v=a or c or g
  misc_feature 242: n=a, g, c or t
  misc_feature 243: d=a or g or t
  misc_feature 264: m=a or c
  misc_feature 382: r=a or g
  misc_feature 396: m=a or c
  misc_feature 402: r=a or g
  misc_feature 407: m=a or c
  misc_feature 422: k=g or t
taaaatcctttacagacaagcaaatcctgagagattttgtcaccaccaggcctgccttacaagagctcctgaagaaagcactaaacatgcaaaggaacaaccagtaccagccactgcaaaaacatgctgaattgtaaagaccatcgatgctaggaagaaactgcatcaactaatgggcaaaataaccagctaacatcatatgacaggataaaattcacacacaacaatgynvgnctttaavndgtaaatgggctaaatgccccmgttaaaagacacggactggcaaattggataaagagtcaagacccatcagtatgctgtattcaggagacccatctcatgtgcagagacacacataggctcaaaataaagggatggaggragatctaccaagcmaatggraagcmaaaaaatagcagggktgccatcctagtctctgataaaac

SEQ ID NO: 22203 - DNA, 363 bp, Homo sapiens
  misc_feature 126: d=a or g or t
acttccgcctccagcctcaaacctggaggagcgctcgggaactgcaacctcagccgagctgaacaacctcaggcagagagattctggtttactccccagtggctacggagacgccttggaggcctdggagtctgctcaccttgagggatggaggccaaaaggggcccagagcacaaggctgaggttagaaccagccctgcggacggggctaacctagggtggggtcggtggtgttggcaaagttagaggtgggggctcccccacaggatgtgcacaatgctcacaaaaagcttttattctcacctcctcccacgttcctagcaccctcaaaatgatgcttcctttgataatcctgccagtcct

SEQ ID NO: 22204 - DNA, 164 bp, Homo sapiens
  misc_feature 13: s=g or c
caagtccttcttsatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggaaccccc

SEQ ID NO: 22205 - DNA, 156 bp, Homo sapiens
attagaaggtggtgacatccatttggtcggttatgactaacccttagaagaatagcatagcgcagacagcacaacagaaactataatgcatcaaatgtcacaaaggctctcctaccaggatgacgaaaatcggcaactgatgctcccagaggaggt

SEQ ID NO: 22206 - DNA, 211 bp, Homo sapiens
ctcaacaaatatttgctgaatgaatgtatctactcaagtgtatttaggaacaaacaaaaacaaccaaatcaaaaggaattatcctagctcactaccgagatagctagttctagaaagcactagcaagtagctgataattaattgaactggaactagaaacagagtctagttccttgcccaccctccccttcattttttcctgacggccacc

SEQ ID NO: 22207 - DNA, 255 bp, Homo sapiens
  misc_feature 208: m=a or c
catcaattaaccattatggaattggtctcagttatctcttcttaccaatatcaagtgccaaaatgtttgaatttgggatactctaattaatctacttcctattcctgaatttattttgtgccattgaaggcttttatggggagtggccaaagaggaatgtttgcctctttctaagaaaaatgagccttctaaccacaacccctgccamtcctgaagtaataagaattttggtggttattgtttctcacttgttgc

SEQ ID NO: 22208 - DNA, 160 bp, Homo sapiens
  misc_feature 123: s=g or c
caccttttgtagttaaaacgcttcgacaatcgtgacgttcacttcttttcgtaagtcgatttcaaacggtgatttcagcacttccccgtttggattttgtaaaatgcgaacgacagggcgaasggatattcagggaaaatgtttgagacgacaccgcgat

SEQ ID NO: 22209 - DNA, 130 bp, Homo sapiens
ctttttgtactgaaaagatatttgtatttgttttacaaataatggacagtctttgaatgtttacttagtgccagattttgtttgaaatgctttatatatacttgtagacattattttgtttaagctagcc

SEQ ID NO: 22210 - DNA, 147 bp, Homo sapiens
agcggggtggaggggttgcactgcggtaatatggctcttccttagccagcggcggcaacggcggcagcggcggcagcggcggcggctactgtctgggctgagcagtagtgcctctcgggtggcgggtttctaggctgcaggggttaa

SEQ ID NO: 22211 - DNA, 363 bp, Homo sapiens
cttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagtggagat

SEQ ID NO: 22212 - DNA, 297 bp, Homo sapiens
tctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacacccta

SEQ ID NO: 22213 - DNA, 334 bp, Homo sapiens
tgagcagttgggctgaagataaaggattacgagtcatcggtgtggaggtgatagttgcagacacgggggacataggagatcatccagggagagaggggggttagctgaggagaggcctgaggactggaactttggggacattgttctataaggagctggaagtgcagaaggagcctgcaaaactgattgggtagttgtgccagagaggtaggagataaagaggaaagctagagggagagagttctatggaggaggatagaataagtttccatctacccttctaagttctaggctagtgcccctgtaacaaaagatagattaacaagagggatca

SEQ ID NO: 22214 - DNA, 143 bp, Homo sapiens
  misc_feature 128: w=a or t
taaacaaacaaacaaacaacaaacaaaaaaaaaaccctgaggctttcaattatccagcacactctgaacatggttttagtaaatattggttgaaatgaatgtgaaataaatgaaacaaaaaaactcawtaggaaagacagcaa

SEQ ID NO: 22215 - DNA, 393 bp, Homo sapiens
cccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgg

SEQ ID NO: 22216 - DNA, 358 bp, Homo sapiens
  misc_feature 56: k=g or t
ccttaaggagatccagtttaattcaaggtgatcttttatttacctgtacaggagtktaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttcttgaagacc

SEQ ID NO: 22217 - DNA, 209 bp, Homo sapiens
  misc_feature 13: s=g or c
  misc_feature 178: n=a, g, c or t
gttttttgtggasacagggtttcaccatgttgcccaggctggtcttgaactcctgggctcaagcaattttcctgccttggcctcccaaagtgctgggattggaggcatgagccttggccaacataataatctaactaaatgctgaagacaacctggataaatgagaagctatacactnctggtgggtgttcgtgtacatatacgggggc

SEQ ID NO: 22218 - DNA, 241 bp, Homo sapiens
  misc_feature 32: y=c or t
  misc_feature 177: r=a or g
ttcatggctccccattgcttaatgatagagtyaagtttgttaacatgcaatgaaatagctgttgatttattctgagtaattacacttacttttgattttcagaatataatggtaaaattcagttcttaaatgttactaaaattattaaggtaatattaataatataaaaagtaagtrccagtgacctaatgaaacatttaaaatgatgaatggccttgtgtagaaaaaatatgggctctga

SEQ ID NO: 22219 - DNA, 349 bp, Homo sapiens
  misc_feature 23: s=g or c
  misc_feature 271: r=a or g
attataactctgtcctgttgaastcagagcaaacacttttgaagtgaacagaaagaatgaagttctcagcaaggaaagtagaaaaagaaccaacagaaacttttaggataggaagtagcaataatccaaatatattaaaatactaaaatacctaaaaatgttctagatgagttcaacagcagaatggaggggacagaaaaaagattaagtgaaattgaagaaagggcaatagaaattataatatctgaacaataaagataaaagacaataraatgagcacagtgtagagatctatgggatgatagaaaaggtataacaattacgtcataagagacccagaggaggggac

SEQ ID NO: 22220 - DNA, 366 bp, Homo sapiens
  misc_feature 49: s=g or c
  misc_feature 187: k=g or t
  misc_feature 254: k=g or t
tggaccctgagggttcaccaggcagggagaagggagagctggtccagascagcgtggatgcactgttacctgttcataacaagacaggtgccatcagtaagagggtgcattgagagactgggcctttgctctgatatctaagcatgtggttattttctgatcatttaagtttattgtgttttttgtktgcttgttttttgtttgtttgtttttgagacagagtctcactctgtcgcccaggctggagtgcagtkgcgcgactcagctcactgcaagctccgcctcccgggttcacaccgttctcctgcctcagcctcccaagtagctgggactacaggcgcccaacaccacgcctggctaaatttt

SEQ ID NO: 22221 - DNA, 335 bp, Homo sapiens
  misc_feature 309: s=g or c
acaaccaaatgatgacatcagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgstcaagtccctgatataaaatggtagt

SEQ ID NO: 22222 - DNA, 125 bp, Homo sapiens
tgagattgtggcagaaatgacagaaacagagatagtcacctctctttgtcccatgtatggcagtcgatttggttatgccctttccaatggcacagttggagtttatgacaaaacatcccgatact

SEQ ID NO: 22223 - DNA, 363 bp, Homo sapiens
  misc_feature 340: s=g or c
tcagagtgatctctaagaatgaaattattgggttataggttactcacgtttaaaatattaatagttactactgcagaacacttttatatcctgtcagtataacagagtacccctttgcctataacctttcaatattattaggctttaaaatatttactaatctgatagataaaatgatggtcttggctgggcgcggtggctcatgcctgtaatcccagcactttgggatgccaagacgggcggatcatgaggtcgggagatcgagaccatcctggctggcgcggtgaacccttgtctctactaaaagatacaaaatattagccgggcgtggtggcgggcsctgtagtcccggctgctcggggg

SEQ ID NO: 22224 - DNA, 369 bp, Homo sapiens
  misc_feature 9: w=a or t
  misc_feature 369: n=a, g, c or t
gcccttggwgaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggcctggtacccctcttcatgcactgatttn

SEQ ID NO: 22225 - DNA, 98 bp, Homo sapiens
agtttattttgatgtagcagtgatatggtaggtctttcgaatttcaagtactgcgtatgaaattaaggatcaacatatttgtacctgaccccaccttt

SEQ ID NO: 22226 - DNA, 107 bp, Homo sapiens
  misc_feature 15: s=g or c
  misc_feature 76: s=g or c
  misc_feature 105: s=g or c
aatcctagcgcgcasagcaacagcagcagcagcagcagcagcagcagcagcagcacccgcatccgctgcgggagtscgagccggaaccacacccaagtagcagcscc

SEQ ID NO: 22227 - DNA, 155 bp, Homo sapiens
agtgatttcatatcaatttcatagaatgacttttctttacagacaacaaaggaggctttgaaaatgttttagaagaaattgctgaacttcgacgtgaagtttcttatcagaatgattacataagcagcatggcagatcctttcaaaagacgagga

SEQ ID NO: 22228 - DNA, 149 bp, Homo sapiens
catacaaaaagacacattactttgaagataccgaggattttaggagttgaagggccaggaaacaggaaggccaaatatatatttcacaatatcacaatatgttattaagagcaaatagtgatagaaaagtgaaagtgatgatagcagaa

SEQ ID NO: 22229 - DNA, 119 bp, Homo sapiens
agactccacggagcctttcaggaagactctctaggattggaagttgctatggcaatgaggctcttggaatactgaaagcagccaagccctagagaggctaccaccggtacgccccgcca

SEQ ID NO: 22230 - DNA, 102 bp, Homo sapiens
aacacccggctgaggcgccccgcgttgtgcggcgccacatccgggaagcggcctccaagcaaccgctccgggttgaggcccatcttgacgattccaagtccc

SEQ ID NO: 22231 - DNA, 285 bp, Homo sapiens
  misc_feature 10: w=a or t
attatatctwatagacaagtggctaccaaaacatcattcttaggacatatgaattagattcagttagggtgcttgttaaatattaagatttactgaatcagaaattggggactgactggagctccagaatgtgcacttttaacaagcaccctttgggatttttgcacagagagtcacggacatcgcaaataatacatattatttaatcttagaaaaatacttttttgtaacattggaatttggcttatttctaatatttaaatcatttaactgccatgcaattca

SEQ ID NO: 22232 - DNA, 185 bp, Homo sapiens
ctgattcattattgtatacacaatccctggtgtggtgattggtacataataggtacatacgtatttgtttacagtgtatctgtaactatcaaatactaaaactcttttaaatatacgtgtcatttgttaaacagttaaaacaattttattgcatatttaccatatgctaggagttagagggaggg

SEQ ID NO: 22233 - DNA, 79 bp, Homo sapiens
agattccacttagcagctggtccccagttacatctcttcagttgacttcccaagcaagcctcccagaggcatatgtgaa

SEQ ID NO: 22234 - DNA, 345 bp, Homo sapiens
cgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccata

SEQ ID NO: 22235 - DNA, 165 bp, Homo sapiens
atcttcaaagaggtcccgaggaacgacacgtgccccgagctgccacctccggagtggggctggagaacggcatcccacggggacctgatccggggcacggtgctcacctaccattgcgagcctggctacgagctgctaggctccgacattctcacttgccagtgg

SEQ ID NO: 22236 - DNA, 395 bp, Homo sapiens
  misc_feature 219: k=g or t
  misc_feature 371: n=a, g, c or t
  misc_feature 377: w=a or t
aagatctcttccccttgtccatagcctagatcgagctccctgtgtgcaccgcgcgctgcccgaggcgcgtaagtgggggaggagagcggcttcccccggggtggttctagccgtgggtgtggagcgtgggaaggctcagcttccggggcgagaacctggggctgcggtggacctgatcctgaggtctcagcgtagagatgctgagtccagaggcctgtkctagttcaccagtgcagtgaggggctcagtatccgggcctcccgagagaggtcaaccagaatcaagatgtctgggactgaggaagcaattcttggaggacgtgacagccatcctgctgctggcggcggctcagtgttatgctttggacagtnccagtwcacagcagaagagtacca

SEQ ID NO: 22237 - DNA, 133 bp, Homo sapiens
tggtgattgttttttatttgattcagctaaattttatgtgttgaatacttactctagaataactacttttggaactggaagggggaaatctgtaaatggaaatttatttttatgttctgaaatttgagggtta

SEQ ID NO: 22238 - DNA, 156 bp, Homo sapiens
catttttaagcaaccactttaattttcttcattagggagtatgagcctgatgtgggcagaatccagatgagctggccagtgctgtgaaggagctgagagcacccccgagagccgtgagatggcaccaaaaaccaagaaaggatgtaaaggctccaa

SEQ ID NO: 22239 - DNA, 178 bp, Homo sapiens
ggaaatgcaaagttagctgggcatggtggctcattcctgtaatccaagctactcgggaggctgaggcgggagagtcgcttggacctgggaggcggaggttgcagtgagccgagaccgcaccattgcactccagcctgggcaacaagagcaaaactccgtctcaaaaaaaaaaaaaaaa

SEQ ID NO: 22240 - DNA, 174 bp, Homo sapiens
cttggcatctatgtgactaatcccaatcatgtaccacctccgttgtattttttaaagagtaaaaaaaaatgtttttgagacagggtcttgctttgtcacccaggctggagtgtagtggcatgactaccgttcatagcagccttgatctctcaggctcaagtcatcctccctaaa

SEQ ID NO: 22241 - DNA, 70 bp, Homo sapiens
  misc_feature 38: m=a or c
caggaacaactttctccttattgacaatcccataatamaactcaggaaccaaggcaaaatgaattggctt

SEQ ID NO: 22242 - DNA, 77 bp, Homo sapiens
ccagcctcacaggcccattctattctgttgtcatttcataacgtcttccttgtaggttacaagccactagcccgcca

SEQ ID NO: 22243 - DNA, 235 bp, Homo sapiens
ttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagcta

SEQ ID NO: 22244 - DNA, 342 bp, Homo sapiens
  misc_feature 15: w=a or t
tactgtcagttgttwtacttgaaaagacaggttgagaaaatgtctggcaaaatctttagcctaaataactaaagtgagtgtgtcagtttttctttcaaagaaaaatggtttaccatgaaaaatgttcagcccacaactcaaatattcagataagtgcttttcctcaggacggaacattgtacaacagtatgagcgaaagtgttctgttcgttctttctactttgttacacagaatattaaaaagatgtgtactcaagagttgtgatttaataaaatgaatacttactgttttatcaagaacatttggaagtgaaacaggcttttgttttctgcaattcatgt

SEQ ID NO: 22245 - DNA, 322 bp, Homo sapiens
  misc_feature 250: k=g or t
aatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgtkacctacagagcaaggagtttcctctttcagggtagattatgtaagaatcaattccctggtcccaggagaagt

SEQ ID NO: 22246 - DNA, 315 bp, Homo sapiens
attcggagtgcggccgaggtaactaccgagtcttcggcgggctcgcgagcccggccgcggcctgctggtttcagacggagtcttactctctctcccggtctggagtgcagtggcgtgatctcggctcaatgtaacctccactctccgggttcaaggggttctcctgcctcagcctcccaagtggctgggaccgcagtgatggctcatgaagcaatggaatatgatgttcaggtgcagttaaatcatgccgaacaacagccagctcctgctggcatggccagcagccaagggggaccagccctcctccagcctgtt

SEQ ID NO: 22247 - DNA, 108 bp, Homo sapiens
  misc_feature 42: k=g or t
aaccaagtgaattgcaaagtcatctacacctgtattaaagtkcagctcagaaaggactgtttggactgtgtgtatctagcactacgtagaagagaaagtcaagggcca

SEQ ID NO: 22248 - DNA, 424 bp, Homo sapiens
  misc_feature 162: k=g or t
atagggggtgctgccgagaagtgcctttgctctgcttgctataatgaactgtgtgggtgcatgcacctgtcttccaagtctaaaaccacttcccctcgtgcgaactgggcaatgccatttgatagtgtgtgcgatttatggagtccctagaacccgagagtkagaacacaccagtgcgtacttcacctaagcctttttcttggtgagagggttctggccccggccgtttactctcgattataccaaatgagctgtctttgtcatggaatgcacatgcctgtataacattgcattgtcatggggctgggagtgcccctgggtaataatttggttgtatggtaagggtctcaccaaggagcaaatggtgtttttctgttgctttcctgcagtagtacttctgcttacatgcagtgacagaaagtaa

SEQ ID NO: 22249 - DNA, 347 bp, Homo sapiens
  misc_feature 8: w=a or t
  misc_feature 85: m=a or c
  misc_feature 86: w=a or t
  misc_feature 154: r=a or g
  misc_feature 216: s=g or c
  misc_feature 334: n=a, g, c or t
atcttttwatataaaactaagtgaataaccttgactggcaatccgagacctaagcctgttgactgcagggtaaggtcaatcttgmwtctgccaaagcaggtcatcaatagccccgtaatgtgttgctggtgaacctttctttcaggtgtctcarcctgctcaaattagacagggaaggagccctggaaagctgggtatccacaggcagaggcagtsagggtttggatgagaggaggttgtgatatcctctgagagggtgtaattgttattgtcatggggctgtttctacatattgtcaagtaaaataaattttgatgtaggtaagaagtgagtntattctaaggagt

SEQ ID NO: 22250 - DNA, 222 bp, Homo sapiens
ctgtttcctagtatcaggtttctagaaatacctttatttcaaaagctaacaaacctgagaagcatggttaaaataatcaagttagtttgggagatttaaggagagaagagtatgaattatacttgctgaatgcatactatatacaggcatgtggcaaacgatttattattattattttattttatttttgagatagggtctttctctgtcgcccaggcgtcc

SEQ ID NO: 22251 - DNA, 213 bp, Homo sapiens
  misc_feature 64: s=g or c
  misc_feature 65: s=g or c
ccagtttcagctttctacatatggctagccagttttcccagcaccatttattaaatagggaatssttttcacatttcttgtttttgtcaggtttgtcaaagatcagatggttgtagatgtgtggtgttatttctgagggctctgttctgttccattggtctatatctgtgttttggtaccagtaccatgctgtttttgttactgtagccatcg

SEQ ID NO: 22252 - DNA, 259 bp, Homo sapiens
ctgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacatcag

SEQ ID NO: 22253 - DNA, 304 bp, Homo sapiens
  misc_feature 188: w=a or t
  misc_feature 292: s=g or c
ttgtgacgtttctttgctctgcatatttcatttggtggtttgagaaattaagtttttactgttttctttccccattacagagacatgccttttaattttgagcttttggtatactgttcatgtaagaccattgttacttctcttcattttttcaattgctgtgtttagcagtttactttccttgagtwtttttttttaaacacagggtctcgctctgtcacccaggctgcggtgcggtggcctgatcacagctcactgcagcctctacctcccaggctcaagtgatcctccsgcctctgcctct

SEQ ID NO: 22254 - DNA, 303 bp, Homo sapiens
  misc_feature 283: n=a, g, c or t
aattacattctgtattgttaataacagctaacactaagtgtccgtgccatgccagatcctgtctacttggcttatagtcattgctccagttaatcctcctcttatcagcccccatggtcatccccattcacagatgagaagaatgaggctcagaagattaaacagctcacccaagagtgtgaagccaagccaggatttgagcccagatcgtctgactgcaggagacccctattttagtcaattcttgtttatttaatcccatctatttatttttacgtgtatnttttttctttagccagcaaa

SEQ ID NO: 22255 - DNA, 154 bp, Homo sapiens
ttactacttataagacttacaaatactttattatttagttttcttgggtgctttcaagggatttttaaaattttaaggttctgggagaggtagtgctagtacttctaagaaaataaacctcaaatgagagagacatgcacattaatatccttat

SEQ ID NO: 22256 - DNA, 335 bp, Homo sapiens
tgcataaacccagatgcagccatggctgatataaacaagggccacaaaagacaaagtttttgaagtgctcctaacaccacaaacgttgctggacaacatcccctacctaggacagctgatcacattacatgttctacaatcactggagggcactcactcctgcatggaagtttttttattcattgttaattgactgtaattcatattctccaatctgccaatttcaaacttttctaatgtatttgattcccaggccttggaattaactcaaagttggctcacactttacaaagaaagtaaaatctctgacataacttgcctctgcttgccccacc

SEQ ID NO: 22257 - DNA, 230 bp, Homo sapiens
  misc_feature 13: s=g or c
  misc_feature 36: s=g or c
  misc_feature 102: r=a or g
  misc_feature 132: k=g or t
taataccattctstccgtcacacacaggatgcgaasccgctggctaattaagtgtggcattttgtttcaaaattatccatagacagtcactagctgcaaaarcagcccactgtccttgtgctgatagatgtktttcttaatattttagggtgactcagtccatttatttcatgaattttaccttactttgaaataggtttcttttcttacacaagtgtctttgaccacct

SEQ ID NO: 22258 - DNA, 190 bp, Homo sapiens
  misc_feature 7: r=a or g
  misc_feature 32: w=a or t
  misc_feature 133: v=a or c or g
tcttgaraaatattgtatgattgcatagtgawatagcaagatttgtcaatatgctattctatatgcacccctagagcaagtcattagggtagggaataagccatttacattagtgcaagatagaaagcgagtvcagatgaatttcattgctatagtttttcataaagtactatgttatctagcagcaaat

SEQ ID NO: 22259 - DNA, 122 bp, Homo sapiens
  misc_feature 21: w=a or t
cagtttctctactctcttgtwatgtaccaaattctaatgatattttaagtcagttctattctcaccaaccagccttttcttttaacacatcggtattactgcaacactttctagccgacctc

SEQ ID NO: 22260 - DNA, 248 bp, Homo sapiens
  misc_feature 221: k=g or t
  misc_feature 234: y=c or t
tgagcaaagttatgttcaaatagtttggtatgcttgtgctaatttacatttgtcaccaatcatgattttaattaaatacatgggaaatggattcttattaaaattcaataaattttttttttaccccaaatgtggtcaagtgttttcccctggatttatgtaagcataactcctatgatatggtgtaaaatgaatcatactttttttttgaagatgctttkgtttgagtatctycaagaaaaatctgt

SEQ ID NO: 22261 - DNA, 371 bp, Homo sapiens
  misc_feature 97: k=g or t
ttgttgcaaacatgtagtgataaggagaactaacgtatcaaggggctgagagggtaacgttcccctcctcctccatgtttttattttggtgtctgtkttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatac

SEQ ID NO: 22262 - DNA, 266 bp, Homo sapiens
  misc_feature 37: d=a or g or t
  misc_feature 139: r=a or g
  misc_feature 147: w=a or t
aaatgtaattttatagaataattctgggatttgagadgatctaaaactatttttctgtataaatattatttgccaaaagtttgtttatattcagaagtctgactatgatgaataaatcttaaatgctttgtttaattaraaaacaawaatcaccaatatccaagacatgaagatatcagttcaacaaatactgtagttaagagactaactctccacttgtatgggaactacatttcactcttggttttcaggatataacagcacat

SEQ ID NO: 22263 - DNA, 212 bp, Homo sapiens
  misc_feature 205: k=g or t
ccaaagtggctgaaccattttacattccaaccagcagtgttttgaggattctaattcctctacatccttgtctgaacgtatctgtcttctaaaattattatagccaaactagtgggtgtgaagtagtacttcattgtggttttgatttgcatttctctaatgactaatgatgttgagtggacatctttccatgtatttgtcagtkgcataga

SEQ ID NO: 22264 - DNA, 176 bp, Homo sapiens
acattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttg

SEQ ID NO: 22265 - DNA, 168 bp, Homo sapiens
  misc_feature 124: w=a or t
  misc_feature 125: y=c or t
  misc_feature 137: b=c or g or t
  misc_feature 154: n=a, g, c or t
actcgctctcgcgcgctctcccaggctcgttctccctcgccctctctctctcacacacgcacgcacacacccacctctcccataaacacacacacacacatgcacacccacacccacgcgcgcwygcaccgccccabgcgcacacactcctgcncacgcccacgcagc

SEQ ID NO: 22266 - DNA, 215 bp, Homo sapiens
  misc_feature 51: k=g or t
cagagaatattgaattagtgccagctactggcattctctcacacatctgtkattaccagggtcatgcatatgtggaacaatcagctagaggcttattatttaagctgtgttctctctggaaactttaagacctaggagcttatcagaaatgcggaatctctggctgtgtcaagataccccagtgctccataggcatggtaaaattgagaagcgac

SEQ ID NO: 22267 - DNA, 244 bp, Homo sapiens
  misc_feature 10: m=a or c
  misc_feature 188: d=a or g or t
  misc_feature 212: b=c or g or t
agcagcgcgmctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccdtggtcgccttgcttgccagcagtbgctcccttagtccttggctcgctcgcacaccc

SEQ ID NO: 22268 - DNA, 111 bp, Homo sapiens
  misc_feature 50: w=a or t
ctatacaccaaagttttgacggtttaccatcattccattttgtaccagtwaaaggcattttgatgatgctttttcttgatgctaagatcactgcagaagaataactgacca

SEQ ID NO: 22269 - DNA, 240 bp, Homo sapiens
  misc_feature 22: r=a or g
  misc_feature 23: w=a or t
  misc_feature 26: v=a or c or g
  misc_feature 28: r=a or g
  misc_feature 66: s=g or c
  misc_feature 80: w=a or t
ttatattcagggcttgtgtgtrwgtvtraattgcttctgtgataactcttacaaaattaatttttsaattatttgctgtwttgtcatgacagctacatatgtatgttgtcgttatgtctgaacactaatagatgcttaagattttgttggcttaattatttctgatagcatttctaatgatactatgtaaaactcatataaccctctacattttacctctggctaaacattaggcctcca

SEQ ID NO: 22270 - DNA, 63 bp, Homo sapiens
agccgcctcgcgcccggtcccgcggtcgcagctccagccgcctcctccgcgcaccaccgccct

SEQ ID NO: 22271 - DNA, 405 bp, Homo sapiens
  misc_feature 101: w=a or t
  misc_feature 223: v=a or c or g
  misc_feature 225: y=c or t
cccaacatataaacctgatttctctctgagacctagtaccttctcttcaaatcattcacttttaggattttcctacaagtgagggatattgggtctgtgawcgtaaagtgattattttaaagacatggtcagccatttccaacgtttgattcatctgtaggtctgcttctattgactttgttctcttgattatgggccacattttccagcttctttgtgtgtvtyaaacttttgtattatgtgtacttttaccttacacacaagcacataagccatgtaaagtccctgttttggtgaggttgcaatttttgagcctcaaattctgacaggaagccccagtgaagtagaactcattagcaaaaagccattgtctgaaatggcaagcagcacagtacaaataccagc

SEQ ID NO: 22272 - DNA, 220 bp, Homo sapiens
  misc_feature 70: k=g or t
  misc_feature 71: k=g or t
  misc_feature 169: m=a or c
tgaacagaaaaattagaagtgctgatagttttgctctactcctcagagcaaaacaacagccttgctccakkaacagaaaatgcacatctttctttgaaaacattattaaattaaaccattttgttttatttgcaaattaggtcctccaaaagctggggaaagctgatgmgacaaaagacgaacagttcgaagaatatgtccagaacttcaaacggcaaga

SEQ ID NO: 22273 - DNA, 164 bp, Homo sapiens
ccgaggcgggcagatcatgaggtcaggagatcaagaccagcctggctaacatggtgaaaccccgtctctacaaaaaatacacaaaaaaattagctgggcgtggtggcgggcgcctgtagtcccagctactcaggaggctgaggcaggagaatggcatgaaccca

SEQ ID NO: 22274 - DNA, 139 bp, Homo sapiens
aattataaactataattattgtaatggtatatattaagcctttttgtctgtattgtgagactttccaagcagttgttatcttcttccttttagctgcttagtctcttacagcagaagggtgatttcatccatggcctta

SEQ ID NO: 22275 - DNA, 362 bp, Homo sapiens
  misc_feature 350: m=a or c
aatcctgggatagtggcggacctgaagttggcctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgccccccccccggggttggaaaagccaccgatcgttccagctgccgagcagctcttaaagctttggattcggctgtcgtggagataacgggcaccagaaaaacttgtaggagtagcaamagctatttggtc

SEQ ID NO: 22276 - DNA, 185 bp, Homo sapiens
ttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcact

SEQ ID NO: 22277 - DNA, 125 bp, Homo sapiens
  misc_feature 44: s=g or c
  misc_feature 54: s=g or c
  misc_feature 117: v=a or c or g
gtcgtcgccgccccccgtcccggcccccctgggttccctcagcscagccctgtscagcccggttcccgggaggcaggggctgggcagaggggagaggaagcacaagaagtgggagtvggagggga

SEQ ID NO: 22278 - DNA, 126 bp, Homo sapiens
  misc_feature 53: v=a or c or g
agagtcatagtggctctcaaaggaggtacctctccttgccttgggtgggagtvagtgggtacaaagagaatttcagagaaaggtagcatctgagctgaaacctgaacaacaagtaggagtccccca

SEQ ID NO: 22279 - DNA, 117 bp, Homo sapiens
tccgcccacccctccaggttgtcatagtgatgccgtatccactgagactccggatcctaacagctggaagctaaaaacaggcgccatggagtacacagggagcaaatatatcgggga

SEQ ID NO: 22280 - DNA, 280 bp, Homo sapiens
tgctggtctcacttggtgcccttcagactgtcgttctatgggtcgcccccgtgctcctgtacccccagctctcacccgtggctcaagagctggtcagtgagacagagctgaggcacctggcgttgcagtacagcaccctcagcaaatgcgatcacactctgtctcttcccagataccctctcctcccctgcagggcggctcctccctgggggcctttgcatctgggaatggagaatgggggcagctcatggggctttctcccttcagaaatgaagccacg

SEQ ID NO: 22281 - DNA, 221 bp, Homo sapiens
  misc_feature 13: w=a or t
  misc_feature 16: w=a or t
  misc_feature 37: w=a or t
cttaaagacctgwggwaaaattgcaggaagagggtgwttgtctttctcagtgtgttttctgtaatagtgaaggtttattggtttctcacttgcgtgccaccagcatgctttgaataacaagactacttactatctctatacatatggctgaatttctaaggtgtgcagcttcttcatattaattggtttaggacattcataaattacagcacccaggtgga

SEQ ID NO: 22282 - DNA, 178 bp, Homo sapiens
  misc_feature 138: w=a or t
gttttgacaacaattcgttcagggcaccgagcaaacatatttagtgcaaagttcttaccttgtacaaatgataaacagattgtatcctgctctggagatggagtaatattttataccaacgttgagcaagatgcagawaccaacagacaatgccaatttacgtgtcattatggaacac

SEQ ID NO: 22283 - DNA, 54 bp, Homo sapiens
atatcagtacattttacaagtatactaaattctgtgccacctacataacttttt

SEQ ID NO: 22284 - DNA, 135 bp, Homo sapiens
attttaaatattggcaaaagctttttttatttttttgagacagagtctcgctctgtcacccaggctggagtgcagtggcaggatctcagctcactgcaagctccgcctcccgggttcatgccattctactgcctt

SEQ ID NO: 22285 - DNA, 241 bp, Homo sapiens
  misc_feature 228: k=g or t
aaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttktattcccccttaa

SEQ ID NO: 22286 - DNA, 69 bp, Homo sapiens
  misc_feature 34: w=a or t
tttgatgttgagtgggatctttcaatatggaggwgcctgtcctttagtcctgggacattttctaacctt

SEQ ID NO: 22287 - DNA, 166 bp, Homo sapiens
  misc_feature 7: w=a or t
gtgtttwctttttggagtgggtgggaagccagcttggcaagccgggtgtgaatgaacaggaatgagcaggagacgctcgctgatgccttctgtgatgtgtttcttccccagctccagaagaaaaggaagtcattaaaggacagtatggcaagctcacggacgcaag

SEQ ID NO: 22288 - DNA, 184 bp, Homo sapiens
cttctgcttcccttttctaaaaaagaaccacctttcttaagaataattaggccaaaataaacttgagtaatttgtacagtcaatattttgaagtttcggagttaccagtgaaatagcaaagctgttctccaggaaaggacatccaggttcccacccaggccttccttcctcagcccccgcagcc

SEQ ID NO: 22289 - DNA, 420 bp, Homo sapiens
  misc_feature 408: r=a or g
  misc_feature 410: w=a or t
actcataaaactaaacatacaactgccatactgaccctcaattgctcctgggcatttatacaagagaaatgaaaagaggttcacacaaaaacttgtgcatgaatgttcatatcagttttatccataatgttcaaaaacttggagaaatcagatggcctttaacgggtggctggtgaaacagtggatggtgcctctatgcccggaatactactcagcgataaaaaagaactaattactgacatgggcaaccactgggatgaattccagagaattgtgctgagtgagcaaagccaatcataaaagtttgcacactgtatgattccatttacataacattttgaaatgcaaaattataggaatggagaatagattaggggttgccagggaggagtggggagaacaagagartwgggcataact

SEQ ID NO: 22290 - DNA, 205 bp, Homo sapiens
  misc_feature 146: n=a, g, c or t
ataatttaagccacttaaaatgtaattagctcttaccaaactaatagaatggagtatgttttacatataattccaatttggggggaggaggtaccctacatttagcttctcagttatatttttattaggcaaatgttaaatgagtntccattcctgaagctatatctactgatgtaaggtagaaaccatacttgaaagcaccgtc

SEQ ID NO: 22291 - DNA, 192 bp, Homo sapiens
aaaaggactaaaagtatgtcaatagttatgttgaaatgggaacagattttctaagcataacgtaatgggaaaatcacaaagtgtaaggttgaatggacaacataaaaatgaaagatttctggatgccaagcaagggtttatatgctttaatattgagtttagtaatttaatatgaaaaagacaaatgctaca

SEQ ID NO: 22292 - DNA, 245 bp, Homo sapiens
  misc_feature 5: r=a or g
  misc_feature 7: s=g or c
  misc_feature 157: s=g or c
  misc_feature 218: s=g or c
gtggrtsacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaastagccaaggaaggaagacttcaagaagtcattgaaacccttctctctctggaaaagcagastcgtactgcttccgatatggtatcgac

SEQ ID NO: 22293 - DNA, 139 bp, Homo sapiens
aggtgcttgggggccggcggcgccgaaggccggctaaacgcagaatggggaagaatcctgtgcgtcctccacgagctcttccacctgtgccaagtcaagatgatattccacttagtcgtcctaagaaaaagaagcccag

SEQ ID NO: 22294 - DNA, 204 bp, Homo sapiens
cagagtatgagagtttccattgttttgctgtttctctgtccctggcttttgtgtccctcattttagatttaaattttgccaggtgatggatgtgaaatggcatcttataattttaatttacagttccccaattgctaatgagataaatatatttttatatgtatataatgcattcatgattctactttagattcatagggaaaa

SEQ ID NO: 22295 - DNA, 105 bp, Homo sapiens
ctattagaatcccccctcccaagatggcatccacacaatggtaaattacacctggccatttattgtatgtatgttcaggcttgttacacatcagaaagagacaat

SEQ ID NO: 22296 - DNA, 166 bp, Homo sapiens
  misc_feature 154: b=c or g or t
tgaagacatgaatcattatgtgattctctccatttaggaaaaaattttccatctttttcagtggggattgggcaggtcattctcatccagggttctctagtttagaatttgttcttcttagtctgaaggaagttgttgactttttatgtgtatbataagggccatc

SEQ ID NO: 22297 - DNA, 267 bp, Homo sapiens
gaagtgcacttattctttccatattccacctagttaccttctactcatttttttttcaatccctaactcaaccctctcccacatggagatgttttcctgtccttcagccctcaaaacacagttgatcactcctctcttaatgctactactgtaccaaggagatacagtgcttcttgacttacaatggggttacaccttgataaacccattgtaagttgagagtatcttaagttgaaaatgcatttaatacacctaacctaccaaaca

SEQ ID NO: 22298 - DNA, 186 bp, Homo sapiens
  misc_feature 6: n=a, g, c or t
  misc_feature 7: n=a, g, c or t
  misc_feature 8: n=a, g, c or t
  misc_feature 14: s=g or c
  misc_feature 140: m=a or c
  misc_feature 150: y=c or t
  misc_feature 180: m=a or c
caccannncccgtscccaccccccaaaaaaacagaaccccacatcacaaacacccccaagccctggcccaggtctttcggataaagggggccactgcccagtgtgcacaggcccagaaggaagaaaagacaagaaaggcmaggtgctgaytgccttgggggttgtttggtgtaaacaggmagcctt

SEQ ID NO: 22299 - DNA, 433 bp, Homo sapiens
  misc_feature 7: m=a or c
  misc_feature 8: n=a, g, c or t
  misc_feature 9: n=a, g, c or t
  misc_feature 10: n=a, g, c or t
  misc_feature 33: m=a or c
gtttgtmnnngaccgtgcgccgtccaagggtcmattggttgccatagagatcgtcgagcgctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgccagttcatggccaccaaggcacatataaaactcaacactaagaagctttatcaagcagatgggtatgcggtaaaagagctgctgaagatcacatctgtcct

SEQ ID NO: 22300 - DNA, 462 bp, Homo sapiens
  misc_feature 390: w=a or t
tatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaawtaaaatgcacatagatttgaaaggatgaaatacaactttgttcacaagtaacatgattgtctttgtagagat

SEQ ID NO: 22301 - DNA, 408 bp, Homo sapiens
  misc_feature 329: n=a, g, c or t
  misc_feature 330: d=a or g or t
agaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctctndtgataaggctgaaccaaatataatcccaagtatcctctctccttccttgttggagatgtcttacctctcagctccccc

SEQ ID NO: 22302 - DNA, 368 bp, Homo sapiens
cttctaaattgtgttggagaataaccctgtactcaaaatgtttttattgattattttggccactggcaatcaaggcatctgaaaaaccgagaaactataatcataaagttactggctgaatttaaaattatttattcatactttcagaaagttaccaatcgagtcctactatatgcaaagaccatgttaaaaataatgagaaacagaatatcttggtggatatgtttctgccacccagaaacatttaccagggtggtaaagatcttgtattaaaatatacagagtttagtttcaaagtaatagtagtgaatatcttggtgaatccttactgcaatattaggaaatggatatgcccaatgcagagcaga

SEQ ID NO: 22303 - DNA, 161 bp, Homo sapiens
  misc_feature 19: w=a or t
acggacccgcgtgagttgwggaggtgcggcggaacccagggtcggtgtggggaggacggtaggaaaaccccaggcactttcggaggggttctgccggcagtcacggcgtcgggaggaagacatccccaccagcccttccctttctccccgcttccgcacac

SEQ ID NO: 22304 - DNA, 114 bp, Homo sapiens
  misc_feature 32: d=a or g or t
  misc_feature 33: m=a or c
caaatagtttatgttaattgtgtcaacagatdmgatcactggaatgtggggattctgaaacagaaatgaaactgtccttttgacaactctcttatataataaagtatcaccggc

SEQ ID NO: 22305 - DNA, 134 bp, Homo sapiens
  misc_feature 32: d=a or g or t
agtgtgggcgagtaaaatgccctgcgtgtgadgagcaggctcagattattgctattctgtattcagatcttcatgtgtctcttctaagctgaataaagctgttttggaactgtcaggtacctcaaagcgtaact

SEQ ID NO: 22306 - DNA, 270 bp, Homo sapiens
  misc_feature 10: w=a or t
  misc_feature 11: w=a or t
  misc_feature 32: v=a or c or g
  misc_feature 33: w=a or t
  misc_feature 35: w=a or t
ataaattttwwgtgacactacagaaaaacacvwgwaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaat

SEQ ID NO: 22307 - DNA, 194 bp, Homo sapiens
  misc_feature 10: k=g or t
  misc_feature 33: k=g or t
acgtcgcttktccggcttttccagctttcacckaggttgagatcgtgttttttccggaaggaagttactttgcggggtgacggtgggaatgcctcaccgaggctgccgcccccatgctgacgaatgtgtggggtgaattccaggggaaggaggccagcgagcagcgcatcagggagctgtgtggggggactcat

SEQ ID NO: 22308 - DNA, 124 bp, Homo sapiens
  misc_feature 33: r=a or g
  misc_feature 35: k=g or t
  misc_feature 114: n=a, g, c or t
agcagtcatggcgtactccactgcagagagtcrgkctggcttctgggcttgtcctggctctgtcgctgctgctgcccaaggccttcctgtcccgcgggaagcggcaggagccgncgccgacacc

SEQ ID NO: 22309 - DNA, 188 bp, Homo sapiens
  misc_feature 32: m=a or c
  misc_feature 33: d=a or g or t
  misc_feature 34: d=a or g or t
agagaacagttcataatataaacaatatattmddttattcctaaactaataagatgactatcaatctgtaagagactatgaaaatcaataccgtatacttggtatagttggtgagaatttcaggagcatgtttgttcttttatttgtgttttggaagatacttagcccactttttttttttttttttt

SEQ ID NO: 22310 - DNA, 213 bp, Homo sapiens
  misc_feature 33: v=a or c or g
attgtggctcatcagaacccacttggctttcavccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccat

SEQ ID NO: 22311 - DNA, 113 bp, Homo sapiens
  misc_feature 32: h=a or c or t
  misc_feature 33: r=a or g
agaaactcagagaccaagtccattgagagachraaggggaaagagaggagagaaagaaaaagagagtgggaacagtaaagagaaaggaagacaacctccagagaaagccccga

SEQ ID NO: 22312 - DNA, 349 bp, Homo sapiens
  misc_feature 30: r=a or g
  misc_feature 31: w=a or t
  misc_feature 32: r=a or g
  misc_feature 33: r=a or g
atcagatcagtactttgcctgggtgtaggrwrrcagcatggagattggttttaaacaggcacagcggaacagtttgggtgatggaaatgttcctggtgatagttgtgtataaattgtatgaaaacgtgtgcaattgtgtacttaaaatggataattttcatgacatgcaaattatacctcaagaaagccactaaacgtgggtggccactcaaaatttcaaattctctttaagatgaccattcaggtcaggcatggtggctcacacctgtaatcccagcactttgggaggccaaggcaggcagagcacgaggtcaggagatcgagaccatcttggctggcgcggcggaac

SEQ ID NO: 22313 - DNA, 193 bp, Homo sapiens
  misc_feature 31: r=a or g
  misc_feature 32: n=a, g, c or t
  misc_feature 33: n=a, g, c or t
  misc_feature 55: y=c or t
  misc_feature 58: n=a, g, c or t
  misc_feature 59: s=g or c
  misc_feature 184: n=a, g, c or t
tgtttaaatgataaatgctttccaataaaarnngatcatgggtctggagagtgcygtnsattttctgagttactcttaaatttggttgatttgaatttttttattaggatgttgtataatatgaatctcagccacaggctattccgtgtctaatgtgccagatttcccacccaaaaccatcttnggaccccct

SEQ ID NO: 22314 - DNA, 281 bp, Homo sapiens
  misc_feature 11: b=c or g or t
  misc_feature 31: w=a or t
  misc_feature 32: v=a or c or g
  misc_feature 33: n=a, g, c or t
  misc_feature 34: n=a, g, c or t
ccttttatggbtgcatagtataccatggtgwvnntgtgccatacttttttatccagtctgtcattgatgagcattcaggttgattccatgtctttgctattgtaaacagtgccacaatgaacgtacaaattcacgtatctttgtaacagaatgatttattttcctttgggtatattcccagtggtgggattgttgggtgaaatggtatttctgattctagatcttcgccacacaatcttccacaatggctgaactaatttatattctgaggggacacatcc

SEQ ID NO: 22315 - DNA, 181 bp, Homo sapiens
  misc_feature 32: n=a, g, c or t
taaggggtagttgttgttttatagctccaaanggtttttttattctcagtgtagcaactgtttgatttctttctggatacagctgtatgaacacttttctattttatactgaaatcacacaggtttgtgatctaagtgccagaaccatggaggagactctggccttatctgtagggaacca

SEQ ID NO: 22316 - DNA, 256 bp, Homo sapiens
  misc_feature 32: d=a or g or t
  misc_feature 33: r=a or g
cagttgtaaggcacaccattatgtgccacaadraaaaaaacaccttcggttgtacagcaccattggttataagatatagtcaatttcagagattaaactgtgaaaaaagtacatcttaaaatcagtgagatacagtgttttcatttgtataaggatatatttgggggttttgattgctttaaaaacatttacctttattctgtatcctttactcctagccccaggtgcatgtcagtaattacccacagactgcccg

SEQ ID NO: 22317 - DNA, 142 bp, Homo sapiens
tagccaaaagagatagcaagactaacatctggaagaagcgagaggaacgcccactgattcccataaattaactccaatggggattgtgtgtctgctgtctcgtgctgtttattcttgcttcttgttgtaaattgcagtacga

SEQ ID NO: 22318 - DNA, 67 bp, Homo sapiens
gaggagtcagggaggtgtgtgtgagagagagagagaaaagagagagacagagacggggagagagaga

SEQ ID NO: 22319 - DNA, 229 bp, Homo sapiens
actaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccgggcca

SEQ ID NO: 22320 - DNA, 333 bp, Homo sapiens
  misc_feature 284: r=a or g
  misc_feature 314: w=a or t
caatgtatttatgccatactagcccctttttgtgattgattgattgagacagggtcttgctctgccacacaggcgggagtgcggcgatacagtaatgggctcagtcccacttgagcctcccgagtagctgggaccgccggcatgcaccactatgcccagctaatattttctgttatttttgtagagacagggtctccctatgttgcctaggctggtctcaaactgctgggctcaggtgatcctcctgcctcagcctcccaaagtgctgggattacaagtgtgarccaccatggctggccacctttttgtgatawttgaactccagcaatattt

SEQ ID NO: 22321 - DNA, 210 bp, Homo sapiens
gctttggtaatggctcattcgggccgagagggaaattctgcaattctccaacccacacctccagtaaggggagagctgcttgagtggtgagcacaagctgggcacctccggcgtctccaggaaacgtgaataggccctttcttcggagggcacagaacttcaggatcagggcccaatggagactgagcggacttaaccctaactgtgctt

SEQ ID NO: 22322 - DNA, 168 bp, Homo sapiens
taatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcac

SEQ ID NO: 22323 - DNA, 421 bp, Homo sapiens
cccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagt

SEQ ID NO: 22324 - DNA, 128 bp, Homo sapiens
  misc_feature 32: w=a or t
aatgattatcttgtgctaaaagcatattattwcaggttcaacaattcctttagcttcacacctgtttccttttattcagttaaattccagaaagaaaatttaaacattttaattttaatagcacgtac

SEQ ID NO: 22325 - DNA, 227 bp, Homo sapiens
gacggtcatggcgcgccgggttagaacaaggacgcgccgccgggactccgccgagtcgcagctacgcccagcggccggagcgagttgcagctttttccacaaccatcgaaggctactctgatttgcaattagcaggataaactgaagataacaccttgcagaagcagatctcaattaacaactgatggaaaaaagaggaaactgaagaggccaaaagaaagggacac

SEQ ID NO: 22326 - DNA, 368 bp, Homo sapiens
cattaaggtttcactagcacccattaagacagccttctcctcgctcatggtaaataacactgaaaagaatatgacttcctattgaatcatggactccattataggcttttctaataataatcgtaaggagaacaaagcctcaagaaatctgttctctttaataacacagggtttgataaattagtatgatagaatcaagctggtgtagtgcttaatctcacaaggtactcattttctttcatacttttcttttcaaaatcacactctgattcccatatattatttcctgtgagaaatcataacatattttctatgtaattaaaactttcctgagttcactggaacacagagtgacatctaaatcaatt

SEQ ID NO: 22327 - DNA, 207 bp, Homo sapiens
ctgggtttgaattgaatgtccatttccattaacatctgtgtgtctccaagagcaactttaattcgttgttacagaaattctccaggtggctccaggcaccttgactatgtttttcatttagcagaaacttaagagcaatgaaggtgattttactgagagactccatcttaattctcagatcatctagacatttaggaaaagcccacc

SEQ ID NO: 22328 - DNA, 76 bp, Homo sapiens
tgttaggtttttaaaaagtatcttgatggttcttttctatttataatttcagactttcataaagtgtaccaaggtc

SEQ ID NO: 22329 - DNA, 220 bp, Homo sapiens
aacagtgtgtgagagttccctttcctccacatcctcgccagcatctgttattgcctgtctttttgatacgagcctttttaacaggggtaagatgatatctcattgtagttttgatttgcattctctgatgatcaatgatgttgagcaccttttcatatgcctgtttgccatttgtatgtcttcttttgagaaatgtctattcagatcttttgcccaatcg

SEQ ID NO: 22330 - DNA, 288 bp, Homo sapiens
agaaaagaagatccattttaatatttccatttggaagaaatactttgttttccagctctttaaaatgaagaacctgattgcaaatctctgaaataaagacttgctccaaaccagggtgtataagactataagtccaactgagaacctgacaacaaaattatctgcccaaaatgatatgtcttgtcaagggtagagtcagaaccagatctgaggtctcctgactttcagtctagtgtctttcctctaccccttctgtcccatcagtttctacttgagtctagatgccac

SEQ ID NO: 22331 - DNA, 488 bp, Homo sapiens
  misc_feature 473: w=a or t
cattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtwcatgcgtgtgtgtgt

SEQ ID NO: 22332 - DNA, 125 bp, Homo sapiens
agactgattatttcaggaccagctagagaaattcgcgaaggttcctgtgacaaatcgagaattttttttttttgaagggtagtttagagggtagggggagcccagagttctgaacagctagtccc

SEQ ID NO: 22333 - DNA, 291 bp, Homo sapiens
  misc_feature 288: n=a, g, c or t
ttctggtgtctgagtctgcgggtgacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcgggtgaganagc

SEQ ID NO: 22334 - DNA, 155 bp, Homo sapiens
taaatgatatttggtttttgaaaattatgaaataaggtatgtgaaacctccaaataaattgttgtagcaacaagaaattaatgctattttggaactatagtagcttgataaccttttataatgtattttaaaaaaattaatatgtggagtaggca

SEQ ID NO: 22335 - DNA, 352 bp, Homo sapiens
  misc_feature 317: w=a or t
  misc_feature 332: y=c or t
cattatttatttatttttgaggcagaatctcactctgttgcccaagctggagtgcaatggtgcaaacttggctcactgcaacctccgtctcccgggttcaagcgattctcatgcctcagcttcccaagtagctagaattacaagcgcccaccaccacacccaactaatttttgtatttttaggagagacgggttttcaccatgttagctaggctggtctcaaactcccgacctcaggtgatccacctgcctcggcctctcaaagcgttggggttacaggcgtgtgagatcaacttttttagattccgcatatgagtwagatcacgtggtggycggctgtctatgcctggcaa

SEQ ID NO: 22336 - DNA, 468 bp, Homo sapiens
  misc_feature 246: d=a or g or t
agctcggtgtgggtgagcatcagccaattccttgagggcctgaacagaacaaaaggcagagggaggagaaatttgcccctttgcttcctgctgtgtacttgagctgggacatcagtcttctcctgcccttggactgggatttacaccctcagcctctggttctcaggccttcagacttggactggaattatactcttggtctcctctccagtttgcagacagcagatcatgggacttgatctgctdgcctcaataatcacgtgagccaattcctcataataaatgtgtgtgcgtgtgtgtgtgtgtgtgtatttatatacacatacctcctattggttctgtttctctggagaaccctaatacagaggtgacctattttgtagagcgtgacagtccgatcaaaaagacttgtcaagccattaagaaagatgattacaatgctatatagcaagctggaaattgatcaca

SEQ ID NO: 22337 - DNA, 414 bp, Homo sapiens
  misc_feature 361: r=a or g
tttttggaaattaaaaatatgataaccataatgaaaactttggctggaggattagaaggtaaaatgaaggaaaacacttgtaaagtgaagcaaaaggacaaggaaatggaaaataggggtgaaaagataaaattagaggaccagtccgggaagcttagcatttcaataatatttctaaaaagagtgaacaggccactttgggaggccgaggtgggcagattacctgagctcaggagttcgagaccggcctgggcaacacggtgaaaccctgtctctactaaaatagaaaaaattagccgggcgtggcagcgtgtgcctgtagtcccagctactcaggaggctgaggcaggagaattgcttracccaggacgcggaggttgcggtgggccgagatcacgccactgcactccagct

SEQ ID NO: 22338 - DNA, 134 bp, Homo sapiens
  misc_feature 109: y=c or t
agagcggttactgctcaatgcagagaacccgagagggaccttcctcgtgcgagaaagtgagaccacgaaaggtgcctactgcctctcagtgtctgacttcgacaacgcyaagggcctcaacgtgaagcactaca

SEQ ID NO: 22339 - DNA, 189 bp, Homo sapiens
aatgaattccctcaccttttgttcatctgggtgtgtcttgatagtgccatcatccttaaagtatagttttgtcaaatataaaattcttgattaacaattttttcttttagcaatttaaatgttttcccactgccttttggcctccatggtttctgatgagaatcagctgttaattttattgaggatccc

SEQ ID NO: 22340 - DNA, 83 bp, Homo sapiens
cgttcaggaatttaaaaactgtttactaagcatttcccatgtgataggtgttgtggtaggttctcgggtttttgaagccccaa

SEQ ID NO: 22341 - DNA, 293 bp, Homo sapiens
gcaaaccatccaatcaggaactctgcaagggggacagggggcaatgttcaacaactccgcggggtcttcctgtttcgtgtccgctgcgtttgggttccggtctccgcttctccagtggccccggtggctccaccgcagcgtctggcgcgctgggacctgcacaggccggagagagccgtagaggaccccgggacaccctggaagccaggaaatgacggagtttcgctctgtcgcccaggctggagtgcagtgggaagatctcagctcactgcaaccttcgccttccgggttca

SEQ ID NO: 22342 - DNA, 102 bp, Homo sapiens
tttgatagcttttgacatatgtgtatacctgtgaaactatcaccataatcaaaataatgaacatatgtatcattcccttccaaacttttttttttttttttt

SEQ ID NO: 22343 - DNA, 339 bp, Homo sapiens
  misc_feature 295: s=g or c
ctgaatctataaaacaaaacaaacaagcctgaaagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcascgctcatttccttctcatgaagtcccatctggtcatggggacga

SEQ ID NO: 22344 - DNA, 195 bp, Homo sapiens
atctaccaattaccttcaaattgtgattcagtgattttcatggtcataaaatcctaagacttgaggattggaagggacttccaaaaatctaacccctggctccaaacctcttagaagctctccccagcaagtgcccttgctgctgctccagatatctggacattcaccccatccaaatagaggcttctcttccgc

SEQ ID NO: 22345 - DNA, 257 bp, Homo sapiens
ttgcccatttgtaaattgagttgccttttattgttgagttagagttctttatatattctggatacaattcccttactggatatatgattctaaaatattttctccaagcgtgtgtactgtcttttcatttccttcaggatctctcttgaagcacaattttttaaaattttgatgaggtccaaattgttaatttttttcttttatggactgtgcttctgtgatcatatctatgaaatctttgcataacctaaggccat

SEQ ID NO: 22346 - DNA, 118 bp, Homo sapiens
tcatggaagtcactgcaaatatatttaaaaatgtaatagaagagtggttcaaaaatcctagagcacccagctatgatttgtaatttgtggtccatgggaggggcttgaaggaaagacc

SEQ ID NO: 22347 - DNA, 325 bp, Homo sapiens
  misc_feature 148: m=a or c
  misc_feature 149: d=a or g or t
ctttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttmdtagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccatct

SEQ ID NO: 22348 - DNA, 125 bp, Homo sapiens
gtatgttggatattttcaaaacaaccatcccacatgttttgctgacatggagacctgtaggaatggaggaagattcatcagaaaagcatttggatgtggatctggaccgccagtctttaagcagc

SEQ ID NO: 22349 - DNA, 353 bp, Homo sapiens
  misc_feature 13: w=a or t
taaacagggcgawaagataatggaggttcattcacagaacaatcagaaacgtcctcagtaaaggcagcacaattatgtacatctttttaccagggctgtcatattttaccaggttaagtgtgaaaataccatttgatggcacaggacacgtatttgcctagaacagggtttatttttatgtctgatcgctcagtataagatctaggaagcaaacaatccagaactctgaacaaacattctgacagcctgaaacggaatactcaggtgaggggaggaagaggaggcaaaacaagagggttgacagggaaaggcatcagttgggctgttctccccagggtttccgtcttagtatt

SEQ ID NO: 22350 - DNA, 184 bp, Homo sapiens
atgtctgttatttcctgactctaataaaagagaacagttgtaaaacactgtaacaaatctactttctgtgcttctcacgattcaaatctgacttcagtttaaccatttgaatatttggccttaaatacaaattgatgacatagtgatggattgtgttttatgacatttattttatatgggcctc

SEQ ID NO: 22351 - DNA, 429 bp, Homo sapiens
taaaccatagctctttcctctgtttgtttaagctgtctcattcctaattcattccctcccccatatcccctccactgctgtatacaactggtctccttaaagccaaaacctttagctaccattttgctcgataattagctagcctacatttattggctgttgactatgtattctactatgcatattatagatatctacatacattgaatacattgtcttatctcccctcctagagtgtaaatttcttaaaatcaaggacaaagcattatctgcctttgcctctccttcgtgtagtgccttgcacttagtaagtgctgaataaatgaggccatcactgtgattatcactcgacttgaaatatataggaaatggatatgttagctattaggtgtgtattctcaccattgtatcctattccattcatttcca

SEQ ID NO: 22352 - DNA, 431 bp, Homo sapiens
  misc_feature 302: n=a, g, c or t
  misc_feature 353: k=g or t
aattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacntgcttataggttgtcaacccattttatctgaatttgaaaatctatctaggkttccagattaaattctacctttcatatagagagtttaattttaataaaatgtttaattagagcatccttcccttttat

SEQ ID NO: 22353 - DNA, 243 bp, Homo sapiens
  misc_feature 146: v=a or c or g
cattgtttaataagcctaaaacattggaataaggttttttttcaagactaaactgtcactgtgttacactcagttcagtttaatttccaagtattgaaactgtgaccgtaaacaagtctacaagcaactagaatcacagagaagcvtatttatgagccaatcagagattgcagtgtggtgcacacagcagcagacacaacagaagcagccctgttttactggagatgcaaatataagcaggct

SEQ ID NO: 22354 - DNA, 127 bp, Homo sapiens
tcttgcttccacttccccgcccgggatgaggagtctccacgacggggaaaggtcgcactgacagagaaggaagttacacgaagtgtagtggtcggacccgagcctcgagctcagtacacgcggggta

SEQ ID NO: 22355 - DNA, 325 bp, Homo sapiens
  misc_feature 18: s=g or c
  misc_feature 19: s=g or c
  misc_feature 213: d=a or g or t
gtttctccttctccactsscacccccaccccttggactattcccgcattctgtggttgttcctatgagaccacagctggcctctaacccttgttgtccttgggccctgacaggtgaagcaactcgtgcccatccgcgatcaatccctgcaggaggagctggctcgccagcatgctaacgagcgtctgaggcgccagtttgctgcccaagccadtgccattgggccctggatccagaacaagatggaggagattgcccggagctccatccagatcacaggagccctggaagaccagatgaaccagctgaagcagtatgagcacaac

SEQ ID NO: 22356 - DNA, 292 bp, Homo sapiens
tttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaagga

SEQ ID NO: 22357 - DNA, 300 bp, Homo sapiens
gaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaaga

SEQ ID NO: 22358 - DNA, 117 bp, Homo sapiens
taatatatagctctcaggttcttccatattattataagccaagctgttctttaatattgcatattttaggcatgattgaacatggtctcagtgactgttctcagtatagaccccggg

SEQ ID NO: 22359 - DNA, 114 bp, Homo sapiens
  misc_feature 98: n=a, g, c or t
ttccaccttccgccttcgaccttcttccaccttccaccttccaccttcttccacctttgaccttccaccttccgccttccgccttccgccttccatcntccttccaccttccac

SEQ ID NO: 22360 - DNA, 161 bp, Homo sapiens
cctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacaccgcc

SEQ ID NO: 22361 - DNA, 129 bp, Homo sapiens
gaacttgcacaccaggctgcccaggcttgagacccagctctgccacctagaagcttggagcccctgaacaagctgcaattctgtgcctgggcttttctgactgcaaaatgaggataatcacagccccat

SEQ ID NO: 22362 - DNA, 382 bp, Homo sapiens
tctagtccatttttctcaagaatgggggggaggttggtcctgctcacagtaatagtacttttcgattaataacagacattagagaactgctgtacccagtactgtactcggtgctggggaagcagaactcagtactagtgtcaaagaccttttgactccaacatttgttgtgttattgttgttgttattattattgttgttattattttgagacagagtcttgctctgtcacccaagctggagtgcagtggtgcaatctcagctcacgggaacctccgcctcccaggtttcaagcgattctcctgcctcaccctcccaagtagctggcactataggcgtgtgccaccacgcctggctaatttttgtatttttcgtagagacg

SEQ ID NO: 22363 - DNA, 181 bp, Homo sapiens
tttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccgct

SEQ ID NO: 22364 - DNA, 109 bp, Homo sapiens
cttattaatagtctccattctaactggcaagagatgcacttataccattttttgatgaagatgatgtctaataaatctgtgacaaaaagaaaaaaaaatcagagccggg

SEQ ID NO: 22365 - DNA, 313 bp, Homo sapiens
ttgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttat

SEQ ID NO: 22366 - DNA, 96 bp, Homo sapiens
aatataaaaaactaatcatttcagattgtggataataccaacaaaaataacagtaatcaccattttttgagcacttcttaccaaccagtaacccat

SEQ ID NO: 22367 - DNA, 235 bp, Homo sapiens
gttttttggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcatcccc

SEQ ID NO: 22368 - DNA, 484 bp, Homo sapiens
tatgtgaagtgtggggagagagcaggattgtgcttctttgtacacatttgcttctcccaggatagtgtcatagtgcctaggaaggtgatgtgtgtgtcagatacaatgatagtgaaaagaagggattggaattttcatacctgtgtcagtctaaatgagcattaccttgtctgaattgtctaagtggtaagcttcgtgatttgaaacagttttcactttgaaaaactgcttccgtggattaaaagttgtcaccactaaagtgggctgtggtggagtcgatgctgatcctcacttagggcagtggcctccaaggggaagagggcacacaggatggctgggtggggttgggaagaaaagattaggcctttgatttatattcattttgaggctcagccttatttagtttctcactttggatgtattttatatatatacatcaaatatacatcaatattagttcattagtacatgtaggtcattaatt

SEQ ID NO: 22369 - DNA, 439 bp, Homo sapiens
  misc_feature 8: k=g or t
  misc_feature 14: y=c or t
  misc_feature 15: w=a or t
  misc_feature 410: k=g or t
ttgctgtkgcacaywtactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtttcaaacacacactggatttcaaagactaagccaaaaaaatgtaaaatacatctcaatattttggttatactcggttaaagaaaataaaaattatttttgcctttttatgtttttaaaagtggcttctggaaaattttaaattacatgtatgactggcatcatctgtctttggccagcactagactagaataataggttttataaagatgtctattgttatactaaaagtgtkacgtaaactttagttatttaggagactct

SEQ ID NO: 22370 - DNA, 116 bp, Homo sapiens
atctctcgcgccctcgcctcatctcctaagcactcctttcccctgctgtccccttcgaccctcagccctctggtgccgctctgcccgatgcacagccacctcagccagccccccat

SEQ ID NO: 22371 - DNA, 84 bp, Homo sapiens
ctatgtcttcatggtttagtagttttgctgctattaggatcagtggctcacaacatacttggtacattcaaccccattgcctcc

SEQ ID NO: 22372 - DNA, 426 bp, Homo sapiens
  misc_feature 32: k=g or t
  misc_feature 225: w=a or t
  misc_feature 246: k=g or t
  misc_feature 249: v=a or c or g
  misc_feature 250: w=a or t
  misc_feature 251: w=a or t
  misc_feature 271: s=g or c
  misc_feature 272: s=g or c
tgaagcttccatatactattaaaatttaacaktaaccgtgcaattgttttgaacctaaatcaacaaaagattttttgtttagaattgcaaatgcatggtaagaatacaaagctgaccaaatgtagttggatttattattgtttttaaatttctgcagacaacacttcccctgttgcctacacaggtttggagtgcttcccctgccctgactctggcagtatgctwttgctcttgctagacccagakaavwwtcaggtttttgtaacactcssatagtaacaaaattaacaatagactgttgtacaattcaatacgtggaaaatgataaaatatacaatccatatacttttctttaaaaaatgacaatgtattccagccaacagaaacaactcaaaattgtaaacttaagaatgtggaagatataat

SEQ ID NO: 22373 - DNA, 121 bp, Homo sapiens
ttatatttcttgtctggtaattctaatatctgaagtctctgtgggtctgtttcagccctgtgttgtttctgctggatctcactcttaggaacttgttttgtgattttcttttttttttttt

SEQ ID NO: 22374 - DNA, 133 bp, Homo sapiens
ctatacattatatgtgtgtgtgtgtgtgtgtgtgtgtgtgtgtgtgtgtgtacatcgggtcctcccatgtgtggtgttcttctggaggacaagatacacacacacacacacacacacacacacacacacacac

SEQ ID NO: 22375 - DNA, 402 bp, Homo sapiens
agcaaaaactttccatttgagagaaaaaattcttcctgctctgtgggaaaatatttgctgagattttgtatagaataagagacatgtatgtaacatatatgtatattcagcacaagtctactgcaattatgtacacattttggcaagaagaggggattttgtttagtctttgtttatgacttctagtgtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatatttta

SEQ ID NO: 22376 - DNA, 375 bp, Homo sapiens
cctttgattccatgtctcacatccagggcacactggtgaaaggggtgggctcccagagccttgggcagctctgtctctgtggctttgcagggttcagccctgaagctgctcttaagtgctattcagtgcctgtggctttttcaggcacagtgaaagctgtcagtgaatctaccattctgaggtctggaggatggtgaccctttgtactcagctccactaggcagtgccccagtggggattctgtgtgggacctccaaccccacatttctcctctgcattaccccggtagaggctctttctaaagcctctgctcctgcagcaggctggacatccaagcttttccatacatcttctgaaatctaggcagaagctccc

SEQ ID NO: 22377 - DNA, 57 bp, Homo sapiens
  misc_feature 10: r=a or g
  misc_feature 15: w=a or t
  misc_feature 31: r=a or g
  misc_feature 32: n=a, g, c or t
  misc_feature 33: n=a, g, c or t
  misc_feature 34: b=c or g or t
cctgatcaartcgtwtcttctacctaggtarnnbaatttttttcttttcttttcttt

SEQ ID NO: 22378 - DNA, 200 bp, Homo sapiens
  misc_feature 32: y=c or t
  misc_feature 33: m=a or c
gttcaaaagcagcgttaatgttcgcaacttcymcttgctgagggccctagggagctggcccagcctagacttcatgtcctgcttcccacagcccaggaagaagctagagtccccttttcaacagatggggaaagtgagacatgcttggggtcacatggccaggacattcccagatgtgactcccctttactggcagacct

SEQ ID NO: 22379 - DNA, 149 bp, Homo sapiens
  misc_feature 32: n=a, g, c or t
  misc_feature 33: n=a, g, c or t
tatgccggcgagagcccgaagggatcgggcannggagagcccctttctgtcctggtgacttaagagattaaaattaatttggttgctgttggttctgaacaaataatgagttcttttatttgaggtatgccattttgaagactgagaca

SEQ ID NO: 22380 - DNA, 333 bp, Homo sapiens
  misc_feature 24: w=a or t
  misc_feature 32: n=a, g, c or t
  misc_feature 34: v=a or c or g
  misc_feature 51: y=c or t
  misc_feature 55: m=a or c
tgatccgactgcagagatcctgcwcttcaacntvctggcagaggctatgaytgamtgactataggcagacacaggggtgtctctttctcttcgtggaacttatttgttagctagatggtagacacttctcagagaatgtgtattttgagccttctaaccacagatctgctgaggaaggctttacctttaccaccctttggaacagggtttctcaagctcaagctcttttggactggataacttttgttgtgggagtctgtcctgtgcattgtaggatatttagcagcgttcctggcctcagctaactaggtgccagtagcacatccgatgtgt

SEQ ID NO: 22381 - DNA, 236 bp, Homo sapiens
  misc_feature 10: r=a or g
  misc_feature 11: r=a or g
  misc_feature 31: m=a or c
  misc_feature 32: n=a, g, c or t
  misc_feature 33: r=a or g
  misc_feature 34: n=a, g, c or t
atttttaaarrgatttgtttctaccaagcamnrngtgtttattaagcaatcatttaatttcctattttcctttcatagaaaaaaatccctatgtaccaatcataggcttctgaccagcatgggctcacaaccctgtgaccatcaactgtgcaggaccccagcccaaggcaaagcaacctgacatttcccttcatccgcgtgaccgtctaaaggagaaacgtaggaccccccccctt

SEQ ID NO: 22382 - DNA, 367 bp, Homo sapiens
  misc_feature 20: y=c or t
  misc_feature 32: n=a, g, c or t
  misc_feature 33: n=a, g, c or t
  misc_feature 34: y=c or t
  misc_feature 343: r=a or g
attcattgtctatgatatcygcaatggaaacnnycactaggcaatttcagccttgcaaatctaactgtgaagaaggtccttgcttccccttcaccttctgccatgattctaagtttcctgacgcctcccagccgtgcttcctgttaagcctgtgaaactcctttggaatgagtacacatccaggagtgaagaagacaagctcaactgccattctctgagcagttcaaggcatactgagttgcgggagttgtgtggtggtccactctgactgcaagcacccctttcttgaaccgaacagagtcaagtggaatcaaaggacattacctgttgattcttgggcaargcccagaatttggtggacatactt

SEQ ID NO: 22383 - DNA, 317 bp, Homo sapiens
attatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaagattcgaggcacaaacccagcagcctcaacctagttcatggagga

SEQ ID NO: 22384 - DNA, 88 bp, Homo sapiens
agaatcagctgtcctctcagactgtgtgggtggtttccccggccgcagctccgtacgggcttggattgctgggcctcggtgcacccgc

SEQ ID NO: 22385 - DNA, 75 bp, Homo sapiens
aaaccctcagggacctggtatagacgcagaatctgtttcacacaacaactgctatttgaaggaaaaaaaaaaaga

SEQ ID NO: 22386 - DNA, 157 bp, Homo sapiens
  misc_feature 27: r=a or g
ggccgggcgcggtggctcacgcctgtratcccagctctcagggaggctaagaggcgggaggatagcttgagcccaggagttcgagacctgcctgggcaatatagcgagaccccgttctccagaaaaaggaaaaaaaaaaacaaaagacaaaaaaaaa

SEQ ID NO: 22387 - DNA, 209 bp, Homo sapiens
  misc_feature 104: w=a or t
  misc_feature 123: w=a or t
  misc_feature 180: k=g or t
aagttaaaaacatcctgtaattggactcagaataccttttacttttgtgttaggatagccaaggtcatttgttctgaggtcgcctctgtggcatggtgaccgawcagtggtaagcaggcagtwaatacggaatgcttcctttctaggctagaacataagggactaggaaactcgtatatktttctagctagctgccgctttttaacttt

SEQ ID NO: 22388 - DNA, 357 bp, Homo sapiens
  misc_feature 32: w=a or t
tcattaaagaaaacaagctgatatgtgcctgwatctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttacgtaataagtatgtaatataaataaactatggtaa

SEQ ID NO: 22389 - DNA, 99 bp, Homo sapiens
tgtttgtttgtttttaagatagggtctccctctgtcacccaggctggagtgcagtggtgtggtcacagctcactgcagtctcaacttcctgggccccaa

SEQ ID NO: 22390 - DNA, 67 bp, Homo sapiens
  misc_feature 51: w=a or t
cctgatcaaatcgtttcttctacctaggtaggataatttttttcttttctwttcttttctttttttt

SEQ ID NO: 22391 - DNA, 363 bp, Homo sapiens
  misc_feature 14: k=g or t
  misc_feature 60: s=g or c
  misc_feature 62: s=g or c
atcgcacgtctgckgcagcagtctcctgtttctcctcctaccttctccatttttctagtscstgcagggcataattggaatatcatttggagaaagtgtcatggaagttctgcgtccacagcttataagaattgatggccggaattacaggaagaatccagtccaagaacagacctatcaacatgaagaagatgaagaggacttctatcaaggctccatggagtgtgctgatgagccctgtgatgcctacgaggtggagcagaccccacaaggattccggtctactttgagggcccccagcttgctctataagcatatagttggaaagagagggacactaggaagaaaatagaaatggagacc

SEQ ID NO: 22392 - DNA, 256 bp, Homo sapiens
  misc_feature 215: s=g or c
ccttcctcagcctcccaagtagatgggactataggtgtgtgccaccacaccagggtatttttatttttattttttgtagagacagggtctaattttgctgcccagcctggtcttgaactcatggactcaagaaatcctcctgcctcggcctcccaaagtgctgggattacaggcgtgatccagtgcacctggctgttttgtgtatgttgcgccascttgcatcccaggaataaagcctacttaatcatggggtcaa

SEQ ID NO: 22393 - DNA, 112 bp, Homo sapiens
tcacattcagacttcattatgttgttagtggcacatcttcattcttaacagtgtaagagtttccttttctcatgaggcacagatagggaaaggagaaaatgaaaataggagc

SEQ ID NO: 22394 - DNA, 143 bp, Homo sapiens
  misc_feature 11: s=g or c
  misc_feature 12: s=g or c
agatatggatssgaacacagccaaaccatataatctccctttctgtaggttgtcttttcactgtgttgtttcctttgctgtgcagaagctttttatttttatttaataccatttgtttatttttgctttagtttcctgtgcat

SEQ ID NO: 22395 - DNA, 198 bp, Homo sapiens
ttctcctgcttcggcctctcgagtagcttggactacaggtgtgcgccactacacctgactgattttttgtattttagtagagacagagtttcgccatgttgtccaggctgatctcgagctcctgagctcaggcagtccgcctgcctcagactcccaaagtgctgggataacaggtgtaagtcaccacgctcagcccat

SEQ ID NO: 22396 - DNA, 113 bp, Homo sapiens
atcttataacaatatacttctattttcaaactttccatcatttctactatttttggtgaaaattttatttctctgtatactacaaacaccacaatatatttttaaagcacacc

SEQ ID NO: 22397 - DNA, 400 bp, Homo sapiens
  misc_feature 32: v=a or c or g
  misc_feature 33: m=a or c
  misc_feature 49: m=a or c
  misc_feature 50: m=a or c
caaactgaagtaaacttttttaagcattgcavmttttctcttgggtttmmtgaggaaacttggtttctcatactagagtactcatataaaatcttatttcatttgcaaagttaattgagttctttttttccccatcccaagcaatgaagatgacattgttttaaataagaagggctaccattttatttaatgtgtttattattaaagcctattatactgtgatttcagttgttctcttgttctagagacaacaactgggagagctattctagcatttagctaccttactatatactatatgaaaagcactgtgatggggtcagggaacacactttagaaactgaaatatgtctgtgtagctagagtacagtgaggaaaacaaaattgaggccagaaaggt

SEQ ID NO: 22398 - DNA, 215 bp, Homo sapiens
  misc_feature 197: s=g or c
aaaagtcagcaaactcgggaaagatctataggtatctcagcagagagttctgactccaagtgaaaaaaatttcttttccttattgcatgtgaaaccaggagtatgccctgccgagctagttcccttcctctcatctctcatgtggcttctcagattgcttgctttctagtgctgctaatagaagacactatagtccstgaaagctcccgcacccg

SEQ ID NO: 22399 - DNA, 144 bp, Homo sapiens
ggattttgtcaaatgctttttctatgtcgattttgctgagggttttaggcataaagggatgctggattttgtcaaatcctttttctgcatgtattgagatgatcttgttatttttgtttttaattctgtttatatggcacattc

SEQ ID NO: 22400 - DNA, 304 bp, Homo sapiens
  misc_feature 20: v=a or c or g
tgtggaagggtaaaccttcvttactgattggggtcatgcctctgtgtgtttgttgggactgagttataagggataggaaacgtttaagatgctacagcgagctgcttctggctgtgctgtgggacagttcatctaagattcagaaacagaattgagctggtttgggggaaaagtgactttcgcctgtttatcttaaatataggatgattttgaaggtctcacccgaatatctgaaaattgccattttcaaaataaactcgtcaccaaaatgatttttttttcactataaaatgaaggcagacgt

SEQ ID NO: 22401 - DNA, 87 bp, Homo sapiens
  misc_feature 32: m=a or c
  misc_feature 33: m=a or c
ccattgatgttctgttatgtactgtaatgggmmgcgattctgattttgttttatatgggttctctggttctcaaaaaaaaaaaaaaa

SEQ ID NO: 22402 - DNA, 175 bp, Homo sapiens
  misc_feature 159: s=g or c
tttttaataacttagggagaataaggggccccagtggcaaatgcaagctcccctgcctcccaacccgattcctctgagaacctgctgccatctgcctggacctcctgtaagatggctcctacgcgaccacgctaccagagaatcagctctacgtgccascaacattgccaccaac

SEQ ID NO: 22403 - DNA, 67 bp, Homo sapiens
tgtgaagctctgctctctggacaggacaacttggtaaaatgaactattagatgatgcaggtggcttt

SEQ ID NO: 22404 - DNA, 364 bp, Homo sapiens
  misc_feature 101: k=g or t
  misc_feature 106: w=a or t
  misc_feature 108: r=a or g
  misc_feature 256: y=c or t
  misc_feature 257: r=a or g
  misc_feature 258: k=g or t
  misc_feature 335: d=a or g or t
  misc_feature 343: y=c or t
ataaatagtacaatcatttatatgattcccttatctttaattattattattattattattattatttttgagacagggtcttactctgtcacccaggctgkgatawartgcagtggcaatcatagctcgctgcagcctctaactcctgggctcaagtgatactccagcatcagctgcccaagtagctggcactacaggcacacaccagcagatctggctaatattttgtatttttttatagagacaggatcttgcyrkgttgcccaagctggcctcaaactgctggcctcaagcaatccttctacctcagcctcttaaagcactggaattacagdcatgagcyactgcaccctgccccccttgt

SEQ ID NO: 22405 - DNA, 360 bp, Homo sapiens
caatgtaggaactctctcttttcctttaaaaggaaacaatattctgaatgactcttgacatcatttagaataaaagccagtgcccttaccaggagctaagaggtcttagacactctgggacctcactgagtgcatctcagtgccacctcccccttcccactcccaactcttcatccacctcacctgacctccctgctgctcctcagcacgtgttcacactgacctctgcagagccaaggcctgtgtgtgtgctgcctggcctcccctgatgtgtgcatggccctttccctctcctcctggaagtctttgcagatgactccctccataatcaccatatttaaaatggtagccccacttgca

SEQ ID NO: 22406 - DNA, 242 bp, Homo sapiens
  misc_feature 2: m=a or c
  misc_feature 3: s=g or c
  misc_feature 44: k=g or t
tmsattccagcttcgtgcctctttctttgcaatctttctgtgtkagcagcacccctagtgagcctgggaatgcttgcctcttcctagcatctaaagttttattatttagcatttcatggttcatcacaagaaatttcattgtttatatgaaattaaaaaattcacaagtcatgcaacgtatttaataactatttgctggaaaaagttaatttacaaacttttccaaatatattagccctaga

SEQ ID NO: 22407 - DNA, 215 bp, Homo sapiens
agtgtggtaaaccagcggttgagagcccaggcagatttttgagccagcaagtctgagcctctggaaaggcttattcactaggcgtctacaaaggttgtggggcaaaagactgtttcccagctctgtctgaggttcagcttggcgacattccctggaagagcgtgacggaaagtgcaatggaggcgggaggagagcgatttcttagacaaaaggct

SEQ ID NO: 22408 - DNA, 313 bp, Homo sapiens
  misc_feature 153: m=a or c
  misc_feature 154: m=a or c
  misc_feature 203: w=a or t
  misc_feature 215: y=c or t
  misc_feature 227: w=a or t
  misc_feature 237: y=c or t
  misc_feature 255: w=a or t
  misc_feature 268: k=g or t
  misc_feature 273: k=g or t
  misc_feature 280: k=g or t
  misc_feature 283: w=a or t
  misc_feature 285: w=a or t
  misc_feature 299: w=a or t
  misc_feature 308: k=g or t
tttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattmmtatgacaaaaaaaattaagtcttcaaattttttaaaggttttttttttwaatttaattttyccttttgggggwaaagtttgcyctaccaaatagtgattgwaacaaattgatckgtttkggatgtkgcwawagtgacatgcagtwatatatttkgtttt

SEQ ID NO: 22409 - DNA, 173 bp, Homo sapiens
  misc_feature 39: k=g or t
caacagtgccacattagggatcaggtttcagcatgagtkttgggagggatatttaaatcacagcagatatggagaaattggaaccctcatgcactgctggtggtaatagtaagatggtatagccactttcaaaacagtctggcattttctcaaaaggttaaacagagttacca

SEQ ID NO: 22410 - DNA, 202 bp, Homo sapiens
cctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcat

SEQ ID NO: 22411 - DNA, 322 bp, Homo sapiens
cagattattggtttcctttccaattttagcagaaagtcagtggactatgaagattagcctcattccctcagcaaacatttagtgagaatgcacctccagacactgggctaggcaccaggggcatgaaggtagtgaatgtgtgattgcagctctcatagggctttctagtaagggaagtggatatataaattggaactaaaaggctttggaaagtgcagtagtagatgaatagaatatctttgaaaccttgagttgggagtttcttaacccagagggttcccaagaccaccttcaggttcaaagtttcactagaaggacatca

SEQ ID NO: 22412 - DNA, 106 bp, Homo sapiens
agaatgcgcctcacccctggcgaccccggaagtgggtcgggggcttggcctctgcccggccacagagccggagctggaggtgctgtcccgtctggcggcgatcccc

SEQ ID NO: 22413 - DNA, 202 bp, Homo sapiens
agattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgccaga

SEQ ID NO: 22414 - DNA, 128 bp, Homo sapiens
agctttacatgggcagtgtcatttcatcttcactacagctttaggaagttagtggcattgtgacacctactttctagatggggaagcaggcagaggggttgactagtctgcccaagaccacacagccg

SEQ ID NO: 22415 - DNA, 181 bp, Homo sapiens
taaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctctttttttttttttttt

SEQ ID NO: 22416 - DNA, 423 bp, Homo sapiens
cggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccgcctcatggagggacggagagggtccagcctgcgtgtaagccctacgtctgcccagaggctggtcgagcacagagcagctggtttgcttgtgcactcagcagatgcactctgagcacctactgtatgccccgtcctgaggcagccgctgtaggcacacagagggcaaaacgatggaaagccct

SEQ ID NO: 22417 - DNA, 230 bp, Homo sapiens
  misc_feature 178: b=c or g or t
  misc_feature 179: n=a, g, c or t
gtgaaatgtacatacagaaaaagtgcatataatttatacactttataagtgtatgcattttttataataattataaaggaaagttcatgcatttatacacctcggtgaggaaactgccagcatcaggacaccccagtgaggctctccctcagcaaaagttcatctttcttcccatagbnggcactattctgaattttgatcattattgtcttaatttttttactacccat

SEQ ID NO: 22418 - DNA, 336 bp, Homo sapiens
taactttttaaagcagattaggttagtggagtaataattctaaatcttactgtatttcaaaggtgctttattcttcagacgtaagaaacagaagagatttctagaaacgctattttaattaacattgtttttacaaaagtttgtgcttatcattgcctgttttatcatgttagtttccttctgaggcatggcctagaagcaggccttctgaggaaagccgtaaacagtgcctctctggggtgggcctgctgttggcagctttagtgtcatctggaagcttgtttaatgcaaattctcagccccaccccagacctactggatcagaatctatggggt

SEQ ID NO: 22419 - DNA, 188 bp, Homo sapiens
ctactgcattgtactttcattagcagctcctgagccaaatgcatggttgatattgcaagttgtctcctctgctttatgacccattttgaactcaaataagaaaattgcttgactttgcttttggtctaacatcattttcatagtctaaaataaacataaaataaacagcaagtaataagtcatcagct

SEQ ID NO: 22420 - DNA, 423 bp, Homo sapiens
  misc_feature 11: s=g or c
  misc_feature 12: r=a or g
  misc_feature 184: b=c or g or t
gactctatagsrcaaatggttaagaacatatacttgggagtcagttgatctgggttcaaattctagctgtgctactttctacctatgctgtattggacaaatgatactgtgtatctgtttcttcaaccgtaagttgggtatattaatatccttacctcaaaaggtcatgatgattaagtgagtbaatgcatgtaaaatgccttctgtgccgggcagtcagaaaccactcaataaatattgattattctcaccaaagatgtgcttcctgacctcaaaagcctgtcagcctaatataaagacagtgtgacaaatgccaatcctgcctcaggacatcttgcacttgctgatccttctgtctggaacatgcttcacttggattcttttgtggcttccactctcccctctgttgggcctgaaatgcta

SEQ ID NO: 22421 - DNA, 350 bp, Homo sapiens
  misc_feature 128: s=g or c
  misc_feature 129: v=a or c or g
  misc_feature 131: n=a, g, c or t
  misc_feature 132: d=a or g or t
  misc_feature 177: m=a or c
  misc_feature 178: m=a or c
gagaggagctgagaagcgctgagatgcctgtttggagcatctgatctgtagaagacgaatcttcactgtgccatggagatgttctgggagggagagccggcccagctgcctgaaggaggacgcgagasvandgggacgggtgagaggaatgcttagcggagacggactggaggtgcmmggagaggaaaggggaacggaggctggatctcgggaaacctcgtcggcagtgtcattagaggaaggatcgcgtgtctcggggatacggattttggaggaaaagcagaatagggacaaaggcttcccaggtggcttcccctcttcccctgggggctgatttccactgagcagcc

SEQ ID NO: 22422 - DNA, 116 bp, Homo sapiens
  misc_feature 12: s=g or c
  misc_feature 116: m=a or c
tgaaggcttgasacccagggaggcagaccagaaaatggaacttggctgcacataccaaaatcaaatcaaattagaaagtatatctcatgaaaatcttaatgaaagtgatgccacam

SEQ ID NO: 22423 - DNA, 72 bp, Homo sapiens
agttggcgcccatggagccagagctgctggttcggaaggtgtctgcattgcaggcctgcgtccggaccagca

SEQ ID NO: 22424 - DNA, 116 bp, Homo sapiens
agaggaggggcctcagtccacactggacgcggctgtctcgacttagccaaggccagcccgcctggaagggcagcaggggcggcacggggcgcctgagcgtggcacgagcaccccaa

SEQ ID NO: 22425 - DNA, 357 bp, Homo sapiens
  misc_feature 345: r=a or g
acagtaaatcaatttatcaaagtgatacctccattcccatatttatagcagaactattcacaatagcaaagatatggaaccaacccaagcgttcatcaatggatcaatggataaagaaaacgtggtgtatatacaaaatggaacactattcagacataaaaaagaatgcaactatgtcatttgtggcaacatggatagaacttgaggtcactatcttaagtgaaataggccaggtatataaagacaaatatcacatgttcccacttacatgtggaaactaaaaaatgggaaaacatggaggtagagagtggaaagatggataacagagcctggaaagggtgagtrggaagggaggaa

SEQ ID NO: 22426 - DNA, 71 bp, Homo sapiens
atagtttcaggatcctcaggaaaccctggtactggcagcagccagcctctgctgtgcccacatgacccagt

SEQ ID NO: 22427 - DNA, 366 bp, Homo sapiens
tactgtgaagtcatgaaaacttttattctagtagaaaaaagccaacagctaatgctggtggtaaaagtagagagagatttaggaggtcttaagcgtttatagttcttatttataaaattgttgttgggatttaaaaaatggatgttagatatgacattgactcagatctgtgtaacaaaagaaaaagtggttttgaaactactttagtcaaaatagtacagcagttgtttttgtggaatcataggaaaggtgttaacttgagtaaggacattccccaggaacatgtcattttctgtgaaaaatttggttagagaaaagatctgagcctgtataagcatttccgcatttattaacttaggaattaga

SEQ ID NO: 22428 - DNA, 116 bp, Homo sapiens
  misc_feature 79: k=g or t
taggcagctcggtcgggtggaggaagcgatggcatccacgctgagctccagtcctgggtagttattagccgcgtgactktggccaaattactgcacctctctcaacttcccgaacc

SEQ ID NO: 22429 - DNA, 304 bp, Homo sapiens
  misc_feature 16: w=a or t
agttttcgcttctctwctggtgtgcacacatgaaatagcctcctgcctggttaagtacggctggacaagctttcctccatactgctcttgaagttgccgggagcggtctctagacagagctgggaaatgctatttcccttgtttgatgagtgatctgtgggttcatcgcctcgagcaaagatttgctctctcgaaagcctccattttatatcatcaagcacagtgcaaaataggttaaccttaagtaccgtctattctctcacagacgttggaatgaaatagatgtgttattaaaacagtgccc

SEQ ID NO: 22430 - DNA, 112 bp, Homo sapiens
  misc_feature 42: y=c or t
  misc_feature 86: w=a or t
agagaaggagaacaggaaaagaagagctagtaagcgagacgygagcacagaaaagaaaaaaaaaagccttaagaggaccgaagggwaggaaaggaaaaggatggacaacaca

SEQ ID NO: 22431 - DNA, 188 bp, Homo sapiens
caatgtgcaagatttgcttctgtggtataatacaatccaactttcataatttgaagtttgataagctgcatcttgatgccttcccctgtgtgcaaggaatatagaaccccgcactgtaatagcatgtaagtgtgtgttcttgtctctgaaagcacagtgatataaccttttgccattgccaacaatgc

SEQ ID NO: 22432 - DNA, 256 bp, Homo sapiens
catgaaatttggaggacacattcaaaccacagcaggctatcataacaaaataccatagactgtgtggcttattctcacagttctggaggctggaagtctaggattggggtaccatcatggtttctggtgagggccctctccctggcttgcagacagccacattctcacggcgtcctcacgtggcccttcctcagtgtatgcaggtggagagagaaagctttgatgtccctccctgttcttatagagccaatcaccc

SEQ ID NO: 22433 - DNA, 469 bp, Homo sapiens
cattgattcaagtatcagtctctcctggaaacatcctcacagacatacttaaaaataatgctttaccagccatctggctaacacctaaaactaaccatcacaaggaggattatggagagctctccacgtgcctacattttcataacctaatgccatttgtctggatataaaactttccaaaatatttgtctggagagaaaggcttactgcatcagtgacagcatgcagtggtttgccctaatgcctcacttacatcagtcgtgcactgctgccttcttgctatgcttgcatactactgaatgttagcatgataaattaaatgggcgtttttctttattccaaatcagtgccagagatcaaaaagctgctaaaagtcctttccacaagaacgcctctcagaaaatgatgagttatagttattctcgccaagagatgccttctgttgtactctatcacttcctacgatcca

SEQ ID NO: 22434 - DNA, 376 bp, Homo sapiens
tagagacagatgatttggaagtgggaataaaaagctttcttccttattttaaaaagatttgcctttgttttatgaaattataacaacaacagttatcagtaagactttagtgcttcagagagatgttggacctcagataagacacaaaaggagatctcacttagccataccctcagcctgcaactagctctgcccttaggctctgggtatttcctgatctttgggatgtctactgtggtaatccgggaactggttaccagcatctattccctgggatatggaagcatctcaggaatagtaatgacttataattttatacttagaaaaccaggatgtcagtgtactaggtgactgtgggttggggaagaatattaga

SEQ ID NO: 22435 - DNA, 296 bp, Homo sapiens
caaaaacgtctccagacctcgccaaacgtttcctgggggacaaaatcaccccagctgacatccattcgttcaatattatctcatttaaccctcctaatctaattagggagatagttctatctccactttaccaacgaggaaactgaggctgggagcagttcaaaataaaaatccatgtccacggtcacacagctcagcaagtgggatttgaaatcgggtctttgtaactccagcttcccagaacccacacgcttagcgactgtactccacttcctactcagaaccttcccaacaca

SEQ ID NO: 22436 - DNA, 240 bp, Homo sapiens
atgttttaaagtatacatacatcgtagaatgattaaatctagctaattaacatatgcattacctcacatagttatcatttctgtgatgagaatactttacaccaactctcttggcttttttcaaaaatacaatgtattattaactatagtcaacatgttgtacaagagatctgttgaaatttactcctcctatctgaaattttttatactttgaccaacatctccccaacggccagccac

SEQ ID NO: 22437 - DNA, 147 bp, Homo sapiens
tagtagagatggggttttgccgtgttggccaggctggttttgaactcctgacctcaggtgatccacctgcctcggccttccaaagtgttgggatcacaggcatgagccaccacagctgactgatcctggtgagttttaaggccattt

SEQ ID NO: 22438 - DNA, 224 bp, Homo sapiens
  misc_feature 7: y=c or t
cactgtytaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcaccca

SEQ ID NO: 22439 - DNA, 342 bp, Homo sapiens
ttttttcccctgacattcacaggaatattatacagacagattttctatttaaagataactttgactttgtataaacctcactgtgccatttaagtgataaatattggtgcatgaactggtttgactttctgctgagaactgctaaaagccttttaatagaaaacaatagggaatgtcaaacattgaatcacgatctcactgaagcaatttttcttagaaagactttcatcacacagaagttttatccttgctcaaattttgccagaaattatgtctggttaaaatctattgtgatgccttgtgcagcttgtttacccaatcttttatgaataaagggcagca

SEQ ID NO: 22440 - DNA, 192 bp, Homo sapiens
catgaggatctctttaatttcctggttgtcccatttattccagtgctatcccatattatccatactctgaaaatgtgttatctaccatgtggcatttccaagtgtcatttcacctgtactttttaaagtagggtgtcatatctactcaaataggacaacatctgctgttgtcctatttatgcagggtcgatt

SEQ ID NO: 22441 - DNA, 238 bp, Homo sapiens
cacaattacaacaccaactaggtgacaatactttgcagggctggggcaaagttctccagaaggttgtgtatgctctgaatcagtgttcaatatatggtactgtttctcccatagccaggattcatgggtccaggaatcaaggggtagaagtggaagtggcactacttaccgtaacgcccaatgatccactagcaaatatttgcttcctgttcctgtgacattacattctgatggccta

SEQ ID NO: 22442 - DNA, 167 bp, Homo sapiens
  misc_feature 133: s=g or c
  misc_feature 134: n=a, g, c or t
  misc_feature 156: w=a or t
aaattgggtcaagtgttgagcattgctcagcaccgctggtagcaactgcccagagcggtagggattgagggtggggggtgtgctgggtgtaatagagacaggtttttctcctttggagaattccccagtatasnttctgtccttgaaacttgagtwgcagaggagca

SEQ ID NO: 22443 - DNA, 157 bp, Homo sapiens
taggagaacctccagcccattcagataaaaacttacaaaaacttccgaccccctcagataaagaaagaaggcctgacataaaaatgcctttgtcctttatataatcaacaggctcccaggaaaacttttcttctccttttgtgggcatgaacacggc

SEQ ID NO: 22444 - DNA, 255 bp, Homo sapiens
  misc_feature 51: w=a or t
  misc_feature 64: w=a or t
gagaaaactttgatttagcaagcaatggttggggcatggaatgattgtgtwggttttagatgtwccacaagatataaacacattcatcacagaaaacagatattaaaccagggtacaaagattgactttccaggagcaaggaaatcctggaatgcaggcatgttggatgctatgacttccactgtgggttttcttaggctccattagacatttaaaagccagtggcttcaaaggtcacatctgtaatcggcaact

SEQ ID NO: 22445 - DNA, 139 bp, Homo sapiens
  misc_feature 12: y=c or t
  misc_feature 39: v=a or c or g
  misc_feature 40: w=a or t
  misc_feature 41: w=a or t
  misc_feature 86: n=a, g, c or t
ttacagtgcatyctaattactgatgggtgcaattacttvwwaatcgtgttttataaaatagaaaaaaagtggagttttcatgagtnatagtaaatcccacgattattaagaaattcaataaaacatcctgcgcaacaag

SEQ ID NO: 22446 - DNA, 144 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaa

SEQ ID NO: 22447 - DNA, 263 bp, Homo sapiens
aaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagccc

SEQ ID NO: 22448 - DNA, 233 bp, Homo sapiens
  misc_feature 210: k=g or t
  misc_feature 212: d=a or g or t
ctaccccttagcagagggccaggtgagggtgcttggggcccatgggggctgcggagtgtagacttcagttacacccccagcccccaggggaaagcattagccttgaatcctcaatcccaggccctctactaaccactctcaacctatggtatttatcttttgattattctgtgcatctataaaaatgggattatattgtacagaatgctktdtaagctttctctccccacacg

SEQ ID NO: 22449 - DNA, 267 bp, Homo sapiens
gtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatggggat

SEQ ID NO: 22450 - DNA, 186 bp, Homo sapiens
  misc_feature 141: y=c or t
  misc_feature 142: k=g or t
cttaaattcttcaatataagggttgatttattcttatattgaagggttgattttcaaatttgtcagcatagagttatatgcagcattttaaaaaacttttggttgtgtgaagtctttgttttccttaattttgttttataykatactaatgttttatccattttaatattttatttccaaagaact

SEQ ID NO: 22451 - DNA, 280 bp, Homo sapiens
  misc_feature 25: m=a or c
  misc_feature 92: n=a, g, c or t
  misc_feature 249: b=c or g or t
actcgggcagcaggagccgcggcgmggaggggcgtcttgggcctggaggtcagtgtggcctcgcgtttgtcttcggtgacgggaagtgagtntcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttaggtaacttgagtbagtagattaggaagaaacagcaagaagtagt

SEQ ID NO: 22452 - DNA, 185 bp, Homo sapiens
attcacttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggat

SEQ ID NO: 22453 - DNA, 129 bp, Homo sapiens
atattacaataaggactgggaaaattttatggatgtaatgtctattacggtttgcgatagtatttctctctagttctcagtgatttaaatgtgaccaagccttctgtactttgtcacaaaaagcgggca

SEQ ID NO: 22454 - DNA, 169 bp, Homo sapiens
  misc_feature 124: n=a, g, c or t
cattttcttgcattaacccttttgggagagaagccccacccatccctggtttctagaatgtctggggttgcggcctgctttactgagcgtggaggtctcatagcttcctgttgggaaggcagtntctgtatccatgaagatccccaagtgacatataactggccctaga

SEQ ID NO: 22455 - DNA, 276 bp, Homo sapiens
acttttagtatttctttaaagttcgttaaagagaaaaataacagcagctcatagatgtcaaccccaaacaaagatgaatgcttttattttgtaaagatggcttttcttagacaaaacaaccagagctttaatctaatacttagacaaactgagcttctataccaagggaaaagctatttactttaaggctcagtttgttaaaaaggcttttgaaaaactgagtgaaaggaaaaggacttagctgagttacaatttgattactatcaataaggacat

SEQ ID NO: 22456 - DNA, 250 bp, Homo sapiens
  misc_feature 109: s=g or c
  misc_feature 125: w=a or t
acagtaatggcagcgctgtgagcaggggaacgcgagctgacagccgccgccgccgccgcctccgcccaccttcctcgccggggcttcgtctttcactccttcgggctgsctccccctccccttgwcccctgccccttgccctgcttctgcagaagatttcaacactacacttgcacaatgtctttgaaaccaagagtagtagattttgatgaaacatggaacaaacttttgacgacaataaaagccgtga

SEQ ID NO: 22457 - DNA, 312 bp, Homo sapiens
  misc_feature 307: k=g or t
  misc_feature 309: k=g or t
ttatagaacaaacccaccctcttgtagatattttttaaaaacaaataaacataaagttttgttgcttgtatttctatgcccctgggacctaggaagtatggtatgacacacggagtttccccagcagccttgtcctatggcccctaatttttctggggaatggccttaaatgtttaaggtctagctttgctggcagcttgatgtagtttgcaatggtgctagcctgcagatgagctttaatgcattactgtgaactttatgggagggggcaggtgtatggagggtgggctgagaggaaaaatgggtkakgat

SEQ ID NO: 22458 - DNA, 78 bp, Homo sapiens
aatggggccgccgacctcgaagtttccgaagaagtaaaatagaaagaagaccttttttgaaatgacctgtgttagtca

SEQ ID NO: 22459 - DNA, 187 bp, Homo sapiens
aggtctccacccacagaaagagagttgagacaatcatgagagcctcagcaggcacagaaatccctgagaggaactgatgaggctctacactttgctgaatccaaatttaccccctttctgaagggtacccacataagtcacctaccatggtgcctagcacataagacattcaggaaacaggaattgg

SEQ ID NO: 22460 - DNA, 132 bp, Homo sapiens
  misc_feature 48: s=g or c
taattttcattaataccgtcaccagaggtgaaaatgtaacaccacatstgctataattttcctttataatggttggggggaagggaagggaggttgccagaaatgatgttgtcaacaagaccacgggggacc

SEQ ID NO: 22461 - DNA, 404 bp, Homo sapiens
tttaatacaatgtcctctaggttcatccatgttgtcacatttgacagaatttcttttttaaagctgaatagtattccattatgttgtatataccacatttatatcccatccatcaatggacacttaggatgattccatatcttggctattgtgaataatggtgtacctaacatgagagtacagatacctctttgacatactgagtacattccctttggatatatatctggtagtgagactgttgggtgatatggtagttttatttttaattgtatgaggaacctccatactgttttccacaatggctatactaatttacattgctaccaacagtgtgcaaagggtccctttctccctacattctaacacttgttgtctttcatcttttttataatagcgtttcc

SEQ ID NO: 22462 - DNA, 168 bp, Homo sapiens
gtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccaggccccc

SEQ ID NO: 22463 - DNA, 241 bp, Homo sapiens
  misc_feature 207: m=a or c
tgatcactgccgtcttacacctgtctggtattctctttcagctcagcaaacatcccatttggttgtggttccttgtctgatagggtgacccacacattcattcctcaagatctaagtcattagtagttctgcctaaattgggtggttctagttttctgtttacttaatcaccttgacacaccctagaggatcacctgcattgcagamgtattcctcgttactccattggaaagcagcctta

SEQ ID NO: 22464 - DNA, 367 bp, Homo sapiens
  misc_feature 6: w=a or t
  misc_feature 17: m=a or c
  misc_feature 102: m=a or c
  misc_feature 330: r=a or g
gttctwcgcttctcggmtcgaggccccagtctcgaccgccgaccgcctcggaaccgggctgcatccgagctgccacgcggcgtgtgaaccttgaagcgcggmcggggaatccgcaaggcgccgactctcttcctccttgcaagcccttcgaaagtgagatttctcaccccacccttgcagggtggagagaacacgtttcaaaaaggggatgcctagaactcagccgtgggaagtgcctgtctaaagccttgtgctggtgccagtagcaaacccgtgcgcgtgctcgactttgagcgatcatggagctctgcaaatagctcaactgcagarcgtgccccttagagctcctgtgctgctgggaggcctc

SEQ ID NO: 22465 - DNA, 345 bp, Homo sapiens
tttttggaattggagccaggagaccaaaaataacaaattttaaaaagtcttgacaatttaccatgatttagtaatgttaaaacatcatcttgtgactgagaaaatgaactagagacagccaagaaaatgttagaggagaaaagagaaaaatggaataaaaggcagggaactgtatgattccctttagtcccccccaaaattcatattaaccctaaaaggggaacatttgcttaaggccatcctcacccacttatggtccaagtcaaagacagacttagaaaaaatattctcagccactccaatagatgttgagataaacagaaaaaaaaatatcttgcccgacat

SEQ ID NO: 22466 - DNA, 257 bp, Homo sapiens
aatgtatccattctactattgatgaatgcttagaatgcttctaggttttggctattataaacagtgctgctatggacattcttagacattcctttaggatggtatatacacattcctgttgagtatattcacatagtggaattccttggtcataatgtgtacttaccttcaaattttggctggatgccatggttcatgcctgtaatcccagcactttgggatgccaaggtgagcaggtcacctgaagtcaggaggta

SEQ ID NO: 22467 - DNA, 183 bp, Homo sapiens
ttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccatcc

SEQ ID NO: 22468 - DNA, 354 bp, Homo sapiens
  misc_feature 327: k=g or t
aacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggatagaaaatgcatcttcaaacattttttggaatctcaccacatatactttgttagatttgtgtattgtagggtgtttgttttgtatttttgtattgtatatgaactttttttaaatgtgacagtkaaacacatctttaaaagcatagtcaca

SEQ ID NO: 22469 - DNA, 57 bp, Homo sapiens
  misc_feature 9: s=g or c
gctaacctsttccccgcgggtgagccgcgcggaagaggttagcttttcgattcggac

SEQ ID NO: 22470 - DNA, 407 bp, Homo sapiens
  misc_feature 11: y=c or t
  misc_feature 12: k=g or t
  misc_feature 16: m=a or c
  misc_feature 329: r=a or g
  misc_feature 330: r=a or g
  misc_feature 331: r=a or g
agcggctacgykagcmgccggcactggtgccatcacacagtgacacggacggtgtcctgccaggtgcagaatggctcggagacggtggtccagcgcgtgtaccagagctgccggtggccggggccctgcgccaacctcgtaaggactctgatcagacccacctacagagtgtcctaccgcacggtgacggtgctggagtggagatgctgccctggcttcaccgggagcaactgtgatgagggaacagggtcctgatccagacgccaagagaggattcttggatttcacacaagaaacaattcatagctcacctcagctttgaactcctrrrctcgagagatcctccttcctcagcctcctaagtagctggagaatgcatgaactgcaccggctcagtgacatgagta

SEQ ID NO: 22471 - DNA, 75 bp, Homo sapiens
aaaaccctcagggacctggtatagacgcagaatctgtttcacacaacaactgctatttgaaggaaaaaaaaaaaa

SEQ ID NO: 22472 - DNA, 106 bp, Homo sapiens
taaaaataggtaaacatatcaatatttttatatataccttctataaatatgcttattattttcccagaaggctgtaatagcttttttggatactaaggagtgcctg

SEQ ID NO: 22473 - DNA, 243 bp, Homo sapiens
gattccattgatgagcacaaaacagtaatctggttcaggatagaaatataaacattaggccgggcacggtggctcacacctgtaatcacagcaccttgggaggccaaggcgggtggatcaccaggtcaggagttgaagaccagcctggccacataacgaaaccccatctctaccaaaaatataaaaaattagctgggtgtggtggcatgcacctgtaatcccagctactcggaaggcagaggt

SEQ ID NO: 22474 - DNA, 269 bp, Homo sapiens
  misc_feature 52: w=a or t
  misc_feature 54: w=a or t
  misc_feature 189: s=g or c
  misc_feature 190: n=a, g, c or t
  misc_feature 191: m=a or c
aacaaacaaaggctgcagcatcaaatcttgcctgctggcctgccccacagawtwcaaccttgccagcagcacccataattgcatgaaccagttcctaagagtaactctccacccaaccatcatctatgcatatttcctgttggttccgtttctctggagaaccctaatatgggtaagttctgttatttsnmccattttaatcatggagaaggcggggtctgagaacaatttgcttaaatagctggtaagcagaacctggacatggacgt

SEQ ID NO: 22475 - DNA, 254 bp, Homo sapiens
cttgaatattgatatttttccctgaatttgggaagttctctattattatccctttgaataaactttctactcctctctctctctatctcctctttaattaaggtcaataactcttagattctacccctaccctgcctttttattttgagacaggtcctgactttgtcacccaggctggagtgcagtggcatgatcttggctcactgcaacctccaccttccgggttcaagcaatcctctcacctcagcctccga

SEQ ID NO: 22476 - DNA, 334 bp, Homo sapiens
  misc_feature 217: k=g or t
tcccttttatcttgcctaagttctattcacccgttgtgaaagttgcagataccaggacaaaatcacttttgtcagaaccaaattggaggtgggaaagcaggaaggagaaggacccacgcttgcttgagataagagtgtttcaaggactttctaaaataagcccctaagaaattccttcacgtccttcacacatctcatgcttttcgtgatctatatkttatacataggcacatatttctaggaccaggtttatcactagacattctttaggactacagcaattcagaaaagatactctcaaaagactacttgcctagtaacagcatctccacca

SEQ ID NO: 22477 - DNA, 226 bp, Homo sapiens
tcaagtcttgattctccattaaaaatgatgagtctttctaagcattattcatctcatctctgtggggcaaataatgtaataatttaacaaatgtgtatgtaaaagtgattataaaccttaattcatgaagttgaggtaagccttgtcccaattgtatttgctttccttaatgaaatttaatcatgctcatcttttttccttcctaggatatagtatcccccctcat

SEQ ID NO: 22478 - DNA, 395 bp, Homo sapiens
  misc_feature 320: r=a or g
  misc_feature 326: y=c or t
  misc_feature 364: k=g or t
  misc_feature 391: r=a or g
gaagaagaaggctaacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgargcagtyacagacggatttgcagctgagcctgtctatctggtgtkggaagaagatggggagttacttgtcartccc

SEQ ID NO: 22479 - DNA, 177 bp, Homo sapiens
acacaaagaaaggcacaaggctgaagcaaagtcagaaacaactggagagtaagatgagggcagggggcaggccctatggaatactatttccattcagtaaacatccacttctaacctgtcatttggcaattcagagcatggtaccttccctcctcaactctttagtaggtcccaccc

SEQ ID NO: 22480 - DNA, 358 bp, Homo sapiens
  misc_feature 135: s=g or c
  misc_feature 299: k=g or t
  misc_feature 358: n=a, g, c or t
gcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgsagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcakggcttcagtgcagagcactattttccggtttcccatttcaccatgatctcacgtacgan

SEQ ID NO: 22481 - DNA, 137 bp, Homo sapiens
  misc_feature 52: m=a or c
  misc_feature 124: s=g or c
gaggacggccaacatggcggcgcgcagggctgggccgggccgcagccgcgcmtgagcgcctcaccgcactagctcggctcgcaggacccaagcccgcacccagcctggcccggctgctgcggasacccgggacagga

SEQ ID NO: 22482 - DNA, 164 bp, Homo sapiens
aaattgtttcccagagcccggattcgtgaagcagttgagtgctgcagcggcagtcgtcgcccctgccgccgctgccaccgaagaagcatcccagacaccgggaagatggaagatggtaccccaaagcatatcatccagatgacaggatttaagatggaagaaaa

SEQ ID NO: 22483 - DNA, 155 bp, Homo sapiens
  misc_feature 8: s=g or c
agcctctsaggagcgccatggccgatggagccatcttgcagggcattctcctcggaaccccagctgctgaggagacagcaggcggggactggaactctgtgtgcgagcgattcggtgcctggttttaccagggccccaggggccaaatgaagcac

SEQ ID NO: 22484 - DNA, 146 bp, Homo sapiens
  misc_feature 27: d=a or g or t
  misc_feature 81: n=a, g, c or t
acaaggggcctgtggtcaacgcgattdgcttccaagggacggccaccagtcggcacaggaaaggggcagaggcagtgagtncagcgtgtggacgagggtcaacaagtttgggatcaagcggctgccgctcctccaaaagcgaccta

SEQ ID NO: 22485 - DNA, 406 bp, Homo sapiens
  misc_feature 2: w=a or t
  misc_feature 314: k=g or t
  misc_feature 319: k=g or t
  misc_feature 363: r=a or g
twatgtaatggaatgaagtcagtaaaccttttcacgttctggaattgacagagggaccatgagaacacccatcccatgtcaagaacacgtgcagcgtgagcaggaaggacgctggcatgtggccggactctgttccgcggccccgggcttctgtccacaccatgcttcctttgaaacatggagctacataagcctaagaattgagcctgtcattgtgaaataatcctccactgaagaccacttgctccaatacaacagagccatgttctctgtgtacaagtggcttatgatcaaacttgtgtcttatgactatkttgtkttaatttactatgaagaaactaaaccatgggctctgatgttgtracagatatctgtggagtaaattcaatgtgtcagatgctggcta

SEQ ID NO: 22486 - DNA, 215 bp, Homo sapiens
  misc_feature 100: w=a or t
ataatttcaattttcttaaatttattgaggcttattttatggcctatcatatgatctatcttggagaaagttccatgcactgttgagtagaatgtgtgtwctgcggttgttggatgaaatgttttctaatatctgttaagtccatttgttccagggtatagtttaaatccattgtttctttgttgtctttctgtcttgatgacctgtctagtgca

SEQ ID NO: 22487 - DNA, 134 bp, Homo sapiens
attcccgcggccgcacgtcaccgccacttgccgcatccgcaagatctctctggaccagctcgggtgcagggcctctgcgggagccctcctagacctctgcggcttctcctctaacatggccgactcggaaaacc

SEQ ID NO: 22488 - DNA, 244 bp, Homo sapiens
  misc_feature 12: w=a or t
  misc_feature 13: d=a or g or t
  misc_feature 14: y=c or t
tttctcccctgwdycccctcctcaggcacatgggagccatgcctcgtgcctttgtcatgtgggcccctctgcccgatcggcacaggctcacagggccaggttcaaaggaccttctagactctttggcttcagaggggctgtccacacacctggccaaactgctcctcacagccacctttccatctgctctcccctgccttccttgccctggctaaccctactcagccctcaggtctcaccacca

SEQ ID NO: 22489 - DNA, 126 bp, Homo sapiens
acccaggttggagtgcagtggcgcaatctcggctcactgcaagctccgcctcccaggttcacgccattctcttgcctcagcctcctgagtagctggtactacaggcgcccaccaccacgcccagac

SEQ ID NO: 22490 - DNA, 370 bp, Homo sapiens
  misc_feature 8: w=a or t
attttgtwttgttattggccatggtcttaatatatatttacatatattagaagtatagagttgtcacttttagagggaacataccatgtatgaaggaatgattaaattagaaattgttttttcaggtgaactttgccaccatatcaaaaaaatgtaaagttatttcagtttccgaaactaatttaaatgagtacttaatgatgtcaatgaaaaatggaaagtatgaattgtgtcttctttgaggatctttttctttaaaagatgaacatgattattttaacctgctaaatgtatatttttaaatgtttcactacttggtataataatacaatatttctaaaatgacaaaatgataattttagctaagcca

SEQ ID NO: 22491 - DNA, 311 bp, Homo sapiens
ctgaggtggaaggattacctgaacccaggcgactgagtctgcagtgagccatgatcgcactgctacactctagcctgggtgacagagtgagatcctgtctcaaaaaaaattaaaaacaaaaccaacattcttagctcacaagctgcacaaacactagcagtgggctagatttggccatgagccaacccctctaccctagactattggcaaagatcaagaagtatgatagcagaggaaaaacagacacttgaactcctcttggtgggatgtcactggcacaacaaggagtgggagtagacagtggttggcat

SEQ ID NO: 22492 - DNA, 314 bp, Homo sapiens
  misc_feature 249: y=c or t
catagcctcctatattgtgaaaaaagtaatatatatatacgtagtaggtgacaactaaggcctttattgtttcttggccttttgccaaatgtaattttgaatgctagtgtttgtatgataaatcttcagacagacaatgtcttacgaagaaaatattttggaaggattttaagtaaaacccaaaacttttatttgcatatacttgcatactgtcagcctagaagacaaactcagcactgtgtgtaagtyacttttaaaaattgactttgaatgcctgtatcagaacttatttggttgcagcggcatacaactca

SEQ ID NO: 22493 - DNA, 328 bp, Homo sapiens
agtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaa

SEQ ID NO: 22494 - DNA, 255 bp, Homo sapiens
tgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcat

SEQ ID NO: 22495 - DNA, 155 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaaaaaaaaa

SEQ ID NO: 22496 - DNA, 366 bp, Homo sapiens
aaaatgtattcgaagaagttacttttaggtcttgttattgtgtcaacagaaccaaaggaaagttcaattactgactgaagcaagggcaggtagcacctcaactttgccaaattgatttaggttagatatttttatcattctaaattttctggacaagagtatgcccttccagttgatttttgctgcattaatacaacttgttagagaaagaggaagatagcagtcacatcaccaataccacacactttgtggatgtctccttacatgacacttccagttagggaaatctgctagagaaaccaacctaatgggtcacacatactctgatatatgagcagaaccaaaaatgtaagcatttctgccatt

SEQ ID NO: 22497 - DNA, 292 bp, Homo sapiens
  misc_feature 94: m=a or c
  misc_feature 202: y=c or t
ctgtccccgcccagaaggactcctgcacccccagaacccggcagcccagcccccggtgaggggcccagtgggcggaagaggcggcgagtgccamgggatggacgccgagcaggaaatgcgctgactccagagctggccccggtgcagattaaggttgaggaagactttggctttgaagcagatgaggccctggattccagtygggtttctcggggtccatacaaactgctgccctacccgaccctggccagcccagcctctgactgacgcatgcccaataaaccgaccccaa

SEQ ID NO: 22498 - DNA, 233 bp, Homo sapiens
cctttaaatactttctagctttttaacatactaaattagaaaaaaaatgcctacatttatctttgaatgctactttgggctacaaaccaaagggatacaggacagcacccttaagattcttagaagctctttcgcttggtcagagggtctgaggtcttaacaaagtgttttacagccacgcccttggtttgatcttgaccctaaggtcacattttactgccagtgccctgaac

SEQ ID NO: 22499 - DNA, 415 bp, Homo sapiens
  misc_feature 17: w=a or t
  misc_feature 18: w=a or t
  misc_feature 19: r=a or g
  misc_feature 20: w=a or t
aaatttcttgttctggwwrwcagtatgagacattagacaaatagccagattttctgttcttatttctttaaaacaaaattatttttatcatgattttcctaaagacctttaagattcttatgtgaaagagtcttttgtaagcttctagtaaataggaattgtacctctctttacctgatctcacaaggtgcccagggtagcatggtacatgtgcttgtgcctaaaaagtagctttggatgatggtggtatttgaaaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagt

SEQ ID NO: 22500 - DNA, 111 bp, Homo sapiens
atgattttggggagtgataccgaggaagtctcaactatatgtgcaatatttggtttctttaaaaaagatctgaagcaaatgtaacatcaagataggaagaagtgggtgtca

SEQ ID NO: 22501 - DNA, 317 bp, Homo sapiens
  misc_feature 16: w=a or t
  misc_feature 24: m=a or c
  misc_feature 26: h=a or c or t
  misc_feature 27: y=c or t
  misc_feature 35: w=a or t
  misc_feature 36: r=a or g
  misc_feature 48: d=a or g or t
  misc_feature 54: w=a or t
  misc_feature 55: w=a or t
  misc_feature 67: m=a or c
  misc_feature 68: w=a or t
  misc_feature 71: w=a or t
  misc_feature 72: w=a or t
aatgttgcctttgccwaatgtagmghygactttcwraattgtggagadgcactwwtccaagccaatmwtawwtgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacat

SEQ ID NO: 22502 - DNA, 84 bp, Homo sapiens
agtgctagagcgggagcctcagccctcaggcgccactgtgaggacctgaccggaccagaccatcccgcagcgccccgccccgca

SEQ ID NO: 22503 - DNA, 319 bp, Homo sapiens
gctagatttctcctctcttgtctcttaaggacaatgaccattatcttgtataatacccaatttgtaattattttcaatttcagttacttggccaatgtggccttttattttgaccatttctctcacatgtttttcagattccaataatagaaagagctctttgtcaccctcacaaaacttgctttcttaggatattaaaggatatacgagatacaatgtacttaagtaaaatgaccatcatctcaccctccaaagaccaggttgagtgtcaaatatatggttctgtctgtctttctatcttcttacttttccccaccca

SEQ ID NO: 22504 - DNA, 399 bp, Homo sapiens
agacttattcagccaacatgtaagatgatattgcttgtggaaaaagtactattgaaacagttactatttttgttgtgtgcaaatgccattaatggcataactaggatagttcaaaatcagagaccctgagattttatttggcgtctctgagctcttgatttcttttattaaatgttggctgcgtggaatacttagagttctgttagtgtcttttgagagtgattgagcaagtcctgtaatattactttgcaactggtactttggtgttttacatagtaaaattaatggttcatcaaatgtaagaggaaatttactttgcatatgggcaatgagcccatcatccattttaaataacagagagagtatcagtaaatgctggttcagaaaataatctacatt

SEQ ID NO: 22505 - DNA, 288 bp, Homo sapiens
  misc_feature 70: w=a or t
  misc_feature 71: w=a or t
  misc_feature 97: r=a or g
  misc_feature 98: w=a or t
attactaaatcattccctgccactctaggagtgcatttattagagaaatgctaggactattggattgtgwwcttccagtgttatgcttttgaagttrwgggaaggcaggcggattgtccccaaaggaggtgcccttagttgatgtctgtcatcctacacaggtggggtcttttatttcatggccagggctctcaaaggcttccttttggccacaatgagagaaatctgggggtgagtgagtgtcctcccaggtaaattaatggtgggtctgtaaataaccagaggccc

SEQ ID NO: 22506 - DNA, 268 bp, Homo sapiens
catagtaaagcaatcagtgccaggcatttctttttttaggagacttttattactgattcaatctcattatgtgttattggtaagttcagattttttctttctttctttcttatgtatttatttatttagacacggagtctcactctgttgccaggctagagtacagtggcatgatcctggctcactgcaacctctgcctcgggttcaagtgattctcctgcctcagcatcccaagtaggtgggactacaggtgtgcgccaccccgtcc

SEQ ID NO: 22507 - DNA, 147 bp, Homo sapiens
acatccatgtgggagaaagtctgagtgaacaaatatgttgcctctctgtggtaaagtaccttcaagtttatattttaactttctactcagcagccttgtggtgtggttagggcaagtgcttttattttattttacaatggaaatgta

SEQ ID NO: 22508 - DNA, 276 bp, Homo sapiens
tgtgaatcctagtcctcggctttttttggttggtaggctattaattactgcctcaatttcagaacttgttattggtctattcatggatatgacttctacctggtttagtcttgggagggtgtatgtgtacaggaatttatccatttcttctagcttttcttgtttatttgtatagagatgtttatagtattctctgattgtagtttgtatttctgtgggatcagtggtgatatcccctttataaatttttattgtgtctattttactcttcccatt

SEQ ID NO: 22509 - DNA, 274 bp, Homo sapiens
ttttagttctgagtagtggtccctttttaaactcctggaaacatttttgttaccaaataaatcatgttttatggtactcagccatccaaaagtgaaagacctagcatttgattctgtgcaggacacaaatctcacaggaactatagcactttggaaaagcatcaaagtagaaaagaaatacagtgcaattctattatgagaatgttttacatttaaactggtttagcaccttttaagtttaaagcccatagcttcttattactagtgacctaag

SEQ ID NO: 22510 - DNA, 150 bp, Homo sapiens
taaggaaagattttgagatgggtggcatatgttttgccataacttgacatgctttgcaaatctggattccaatggacctttcaaaaccacaacaaaacctcagttttagatgagttctctatgtgaccaattttactggatgcaattgac

SEQ ID NO: 22511 - DNA, 63 bp, Homo sapiens
gagcccaaaccccagcatcacccaacatactcatgtaacaaacctgcacgtgtacccccagga

SEQ ID NO: 22512 - DNA, 142 bp, Homo sapiens
  misc_feature 26: r=a or g
gagaatttccagcaggcaaggcagtrgccgctttgactgcttgcttcggagatccgagacgacggagaaggcactcttatttaccgaccaagaaagctcctcccccgtcctccgttagctaattaaaacatttttcagggac

SEQ ID NO: 22513 - DNA, 139 bp, Homo sapiens
atcctgcgggcggcggcggcgggcgaggcgcctgcagccgggcgcaagatgatgaagtttcggttccggcggcagggcgccgacccgcagcgcgagaagctcaagcaggagcttttcgccttcaacaagactgtggagc

SEQ ID NO: 22514 - DNA, 328 bp, Homo sapiens
taagtgttaactaggctaagcggtgggaaagagtagtgtgtgctgaaggaagggaagaggaacctggcaagttcatggcaggctgtaattggatgctggtctccctccacacttgactcctacagtctgatttctacacagcacccaaagtgatctcttaaaaatacacatgtgatcttgtcacttcccagcaccaaactctacagtgaatttccatcttagaacaaaattcagactccttaccatggccaccaagaccctacacaatctggcctcccaatttccttttccaaggtcaccttttaccactatccatctcactcacaca

SEQ ID NO: 22515 - DNA, 76 bp, Homo sapiens
taatgttcctataccacagccaggatctatttcactaacagcaccaatgaatgcaaaactttatggaagcctatat

SEQ ID NO: 22516 - DNA, 174 bp, Homo sapiens
ctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcc

SEQ ID NO: 22517 - DNA, 269 bp, Homo sapiens
cttcagtatattcttttggctttgtcatgtcaaccacataccttggccaggtctctgatgatttccaaatgtttaatcatcctaatttgtgatatccttgttctgtcacttttttagtatcttcagcctaacgtgtcttgaataggtctttggtctgtgcttataatcaggttagtagtcctgtcgtttttccctcctccaataaatctttcatattttaaaggaagagcagcttccttgttaaaccaatcataacaaaagcccccaca

SEQ ID NO: 22518 - DNA, 237 bp, Homo sapiens
  misc_feature 229: k=g or t
acctactcatctgacaaagggctaatatccagaatctataatgaactcaaacaaatttacaagaaaaaaacaaacaactccatcaaaaagtgggcaaaggatatgaacagacactattcaaaagaagacatttatgcaatcaaaagacgcatgaaaaaaatgctcatcatcactggccatcagagaaatgcaaatcaaaaccacagtgagatatcatctcacaccagtkagaacgga

SEQ ID NO: 22519 - DNA, 212 bp, Homo sapiens
cagagggaaaaaaggaatggaaagaagtgaagaaagcctatgagatttatgggacagcaagagagctaccatttacattatagaattttaaaaagaaggagagaatagatggaatggacggaatgtatatttaaggagatattgacttaaagcatttcatgtctgcaaaaagatataaatacctagccagaggaggtttaaatgtctcaatc

SEQ ID NO: 22520 - DNA, 172 bp, Homo sapiens
cattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccagttcaaatattttcgtcctga

SEQ ID NO: 22521 - DNA, 314 bp, Homo sapiens
  misc_feature 18: w=a or t
  misc_feature 298: w=a or t
tagcttagggtttcttgwgaagttgcaggcaagatgtcaggttgagttgcagtcatctgaaagcttgactgtgctagagtgtctgcttcacttacatggctggaaagttggtgctgattgcgggaagccacagtttcttcacaaatagactcttcctcaggactgcttgagtatccttacaacatggcagttgatgtcccctagagcagtcaatctaagacagagaaaggtggaaccctcaatgtattttataatctagctccagaagtcatacaccatcatttccacagtattctgwtggtaatacaggcggt

SEQ ID NO: 22522 - DNA, 263 bp, Homo sapiens
cctaatatcctcttgcagattttacaaaaagagtgtttcaaaactgctctatcaaaagaaagcttcaacactgttagttgagggcgcgcatcacaaaaaagtttctgagaatgcttctgtctagttttcaggggaagatatttcctttttcaccataggcctgaaagcgctccaaatgtccacatccagatactacaaaaagagtgtttcaaacctgctctatgaaagggaatgttcaactctgtgacttgaatgcaaacaca

SEQ ID NO: 22523 - DNA, 291 bp, Homo sapiens
  misc_feature 209: y=c or t
  misc_feature 214: k=g or t
  misc_feature 218: y=c or t
  misc_feature 229: w=a or t
  misc_feature 231: k=g or t
  misc_feature 245: y=c or t
  misc_feature 249: k=g or t
  misc_feature 252: w=a or t
  misc_feature 255: y=c or t
  misc_feature 258: w=a or t
  misc_feature 275: w=a or t
ggaatccttggaaggacttctcggaaggactcctctctgacaggtggggcgagcctatggtcgtttggacgtggagggatcctttcagaaccggcgatttcttttatttaggtagccctatacatacattaagcatattttcccatttctatgatataggtaaataattttcccactgtcttttgattatgggtatgtctttttttttyctttkgttyctttttttgcwakgtagtacttttgayctckgawttyccwacggattttgtggtttwatcattcacatttaga

SEQ ID NO: 22524 - DNA, 276 bp, Homo sapiens
ttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatac

SEQ ID NO: 22525 - DNA, 406 bp, Homo sapiens
  misc_feature 15: w=a or t
  misc_feature 395: n=a, g, c or t
tattagaggtatgtwcataaagaggacttaagtctcttgtctttgttaagaagccacaagaagaatgaccagcatgttctaaacaaaaattacccaggattatgatctcttgatacacattgtgcagaatgtaggcatatctttcccatggttttttttccagggaatctccactgcctgtctatagcataggaggctgcttagacacctaacagattgcatatttttctctggtaatgaagaggcacatggaggactattctgccattaggaaaattacctttgaattccactaacgatacaatgcaagatattgagatgctttcatacatgaacatataccactgtctttggggaaacaaggttttttttcactaagcatttaaaatgcacantggcccaaaat

SEQ ID NO: 22526 - DNA, 271 bp, Homo sapiens
tttggattaaaagaagttttccatttgatacttctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaac

SEQ ID NO: 22527 - DNA, 205 bp, Homo sapiens
  misc_feature 19: d=a or g or t
ttttttttccttagcagtdatcccaatttggaattttttatttattttcttatctggtcttccttaactggatgtaagttccataacagcatggactatgtccatcttactcaccactacttataggccttcagtagatactgcttaaatgaataaatgtatatatgatgaaactgtaagaataagtaagaacagagagccggac

SEQ ID NO: 22528 - DNA, 258 bp, Homo sapiens
cacaaaaaaaggaataaatttaaccaaagaagtgaaagacctggaaactgtaagacattgatgaaagcaattgaagaagccacaaataaatggaaaggtattctgtgttcatgtattggaagaattaatattgttaaaattcctacactacccaaagctttctacagtcaatgcaatctttatcaaaacaccagtgacattttttacagaaattggaaccacaaaagagcttgaagacccaaaataatgttgagcaaa

SEQ ID NO: 22529 - DNA, 138 bp, Homo sapiens
tatcattctagtattatatgaactgtattctgtcataaatgttttaaaattgatatatatgttttaaaacatcagctcttaatatgtttgagctgcaatattcctatccccagttctcgtgtgcttttatgccccctc

SEQ ID NO: 22530 - DNA, 329 bp, Homo sapiens
ttcatgatctcagctgcatgaactgtagcaactgttattatcccagtttcacttatgaggaaactgaggcacagggcaattgtataacttgcccaagtctcaagagttaaagaaagtggagctgagctatgagcaaagcctcctgactcctcagaatacacctctcccctctgacacaggaactgtgggttttagacaagctggactttgcctcagcttcctttgtctgcccaggctgccccaagactccctggtcccccctgccactcatttggctgctgtgatacccaagtagtctactgggcacttcgcattcattttctcaccac

SEQ ID NO: 22531 - DNA, 158 bp, Homo sapiens
ttttataaattcgttcatttttcctgttatgttttatataatatatggactaaacaaaataaaataacagtgcaaaagaggtcacgccactgcactccagcctgggcgacagagcgagactccgtctcaaaaaaaaaaaaaaaaaaaaaaaaaaaaaa

SEQ ID NO: 22532 - DNA, 259 bp, Homo sapiens
  misc_feature 72: s=g or c
  misc_feature 109: k=g or t
  misc_feature 111: k=g or t
  misc_feature 114: b=c or g or t
  misc_feature 120: b=c or g or t
  misc_feature 259: k=g or t
gagtttcaggattctatcaaggaagccaagacctaaggagacagagggatatctatttttacaatatttttstttattttctttcttccttgcgcgtggcaagcttttktkttbcttttbcttttttcttaccagcctccccccaatgaggtaagaccgttttcaacaatttgctaatgctcttgtggcgcccggtgggggtcggaacctgagatcccgaatcgctgtgtgtgtgtgtgtgtgtgtgtgtgtgtgtgck

SEQ ID NO: 22533 - DNA, 307 bp, Homo sapiens
aatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggc

SEQ ID NO: 22534 - DNA, 180 bp, Homo sapiens
aaaagctgggaccggaggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagactc

SEQ ID NO: 22535 - DNA, 279 bp, Homo sapiens
  misc_feature 51: v=a or c or g
  misc_feature 164: r=a or g
tttaaatgtctttgattgtgttattccatactagtgtcttaaatgaaagcvtgcgttttttgtcagcatcctcagttaatttctttcttattctaaaaataaagaaaatgagatgtaaatgctgactcagattatcagtttgctggcaatttgcttttaagtcrcatatggaattagagacatcaatctatgcacaatgttgccaccttctgctgaacactttacatctttgaaaagatctgttttactttcagagtcagcatcaacttaagcaaatgt

SEQ ID NO: 22536 - DNA, 235 bp, Homo sapiens
  misc_feature 204: s=g or c
ttataaccaactacggcgtgggggagcggaactgcgagaaggcggcaccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctstgaactgtgctgatgggcaggaggatgggat

SEQ ID NO: 22537 - DNA, 394 bp, Homo sapiens
taatgcttccatgagcatggtgtctcaaaatatctgttggagacattgtttttaattcctcttgatctatatccagaagtggaattgtgggatcatactgtaattgtatctttaattttttaaggagctttcatactcctttccacagtgaatgcaccattttcactctcaccagcaatctctttgacttctgactccctgtctgacctccccatgaaaagtcttggagtattagttgtttcgtttcagattatttgtacgaaggacagggtccctcttgtgttccatctatcgtgacttaatttggcatttattgcctccttatccttgttttactttgtaattttgctcagaggtcatgcactagaggcataggtttaaatccttacaaaga

SEQ ID NO: 22538 - DNA, 452 bp, Homo sapiens
  misc_feature 201: n=a, g, c or t
  misc_feature 202: m=a or c
  misc_feature 235: n=a, g, c or t
  misc_feature 236: n=a, g, c or t
ttgctgcagcccagggtggctgtctgtagaccttacgttcaggacacttgtcattaggtgttaacaagtgtcagggtgagggaacaaaagccacgggtggccagtatgagcagtttctctttcttctcccagacaggaaaaaccatttgtttctggaacctgacactgcagggggtgggcttggtgtatgtggccgccttnmtgggccatttacaagtgcagcacatgggtctgnngagggggctgggccggggtggcgatgtgtttattggtggaagctagattagggtgtctggcaagatgtttttgacacctagaccattccactcagtgaaacccaacaggtggccaggctgttgctttagctggaagcggggcaacctccccgccctgccctgttcagtttattgttggaatgagatgggtcctaaccagtccttcctctcttccct

SEQ ID NO: 22539 - DNA, 151 bp, Homo sapiens
aacagatgaagaaaggctatggaagagacagattctggaggatgcagcattcaaggttctatcttggaagcagagactgtgccctcaccagatgctgaacctgctgagcaccctgatcttccacttcaccttcatcagaactactggggtc

SEQ ID NO: 22540 - DNA, 463 bp, Homo sapiens
aaatcgaaaatacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgca

SEQ ID NO: 22541 - DNA, 229 bp, Homo sapiens
  misc_feature 63: s=g or c
gctcctgggctcgggcgatctgcccacctcggcctcccaaggtgctgaggttgcaggcgtgascaccatgtctggcctggtgagcattttttcataagtgctcattaagggttagctactaactgctgcttagtttcattaaggtataggtgacttttactctattaggaatatgggggtcctgggtataatatctccccctgactacaactctctttttactctccca

SEQ ID NO: 22542 - DNA, 422 bp, Homo sapiens
  misc_feature 377: b=c or g or t
tgaggagaattccttctgcagaaaacctttgtcattgctcttaaggcattcaattgattgggtatagtcgacccatgttatctgctttattcaaagtctacttatttaaatattaatcacattttaaaaataccttcacagcaatgtctaggctgtgaagacattgcctagatatgttgaaacatagaattaaccattatactaacatattctacagcagtatggagtgaaggggcaagccatgcacttatctgggagaagtacattcacacagagggagggataggagtgtcaggactttcaggccatgcaagatatttggcttttatttgagaatgatgagaagctagtggaggctctgcacagaaaatagtgabgactgacttcactaggcttgagctgggaacaggtcagctggatac

SEQ ID NO: 22543 - DNA, 338 bp, Homo sapiens
tagcagctattgagattgtactctatctcttaaaaataagaatcatcctagataagacctgcatgccaacataactgaaggcctatttaaataaagatatctcatgtagagattatgctgaagtatctgatttataagctctttaactgtctcaaggaagtttcctcaatatctggaaattatagcaagttaatgggcatagacaagaaaaattaggtcgaacttatcctcaaatttggaaaatgtaccaaaatgacaacatgtattttagcccttaaaataatgtttacacatattttaatatgctagataatatgctgatttataacctggctcct

SEQ ID NO: 22544 - DNA, 132 bp, Homo sapiens
ctttcttcaggtaacattctgacaagtctgtatgatttaaaagtttcaattataaggaactctgattgtcttttagcattattttaaattggaagtgtgaaagtaacagttgacagtttcagccagggtaag

SEQ ID NO: 22545 - DNA, 433 bp, Homo sapiens
  misc_feature 4: n=a, g, c or t
  misc_feature 171: v=a or c or g
cctnttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcvtggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagact

SEQ ID NO: 22546 - DNA, 152 bp, Homo sapiens
  misc_feature 6: n=a, g, c or t
  misc_feature 10: d=a or g or t
  misc_feature 18: v=a or c or g
ctcgtntttdaaggagcvtcaattagtgagatctctctctctctcacacacacacacacacacacaaaatatatattacactattagatatagtcattgaacttgtaatcatactccgtgttggcctctgtatattcaaatgaaccaggcat

SEQ ID NO: 22547 - DNA, 386 bp, Homo sapiens
  misc_feature 349: s=g or c
attattatggactgaatgtatccccacaaattcatgttgaccctctgacctccagtgtgatggtctttggagatgaggcctttggcaggtgattagagctagatgaggtcatgagagggaggccctcatgaaaggctcagtggcctgataagaagaaacaccagagagcttgctctgtttctctgcctacctggcgcacacatacagaagaggtgatatgaccacacagcaacatggtggccaccagcaagctaggagagggatcagaatgaaacctattttgctggcaccttgatcttgaaattctagcctccagaactgtgagaaataaaattcttttattgaagcsacccagcctatagtcttttgttgtgacagtcccagcc

SEQ ID NO: 22548 - DNA, 425 bp, Homo sapiens
  misc_feature 7: n=a, g, c or t
  misc_feature 297: d=a or g or t
  misc_feature 298: n=a, g, c or t
  misc_feature 299: d=a or g or t
ataaaanttataaatgtgtaaaacgctgatgagctaaatggatctattttgtactgctgagcataattttatatgttatcataatcattaataaaaattagatgaatttaaaagtcagttgcttgtaggctagtgaaatagtgaaaggactagagttttcctttaactggaagaattattactgcttaacatacacacatttaataccgattggtttgctatggaggaataactgagaaaccaaatgcactgagtagagtttatatgaatgtttcaacacagctgctcttacatgadndatatttttttaatgcctagcaaaaatccattataaggcttcaaaggattaaacatcactcaggattgacacggtactcagctgtggctggaggcagcaactttgcagtggtcaattttatcttttt

SEQ ID NO: 22549 - DNA, 484 bp, Homo sapiens
  misc_feature 241: k=g or t
gtgatgtctaacatgcactgggtgcatactattggccaagtttggggtcaacatacttttctctaaaggaccagatagctttgtaggccatgtggtctctcttgctactcagctactcaactctgccattgtagagtgaaaggagtcataaacgatacataaatagtgggcatggctgtgccatcctaaaatttggtttataaaaacaagtttgagggctggatttggcttcatgggactkagtttgtcaacccctggtttaagtcctcttctaagcattttatatgcatttacccagttaatcttcactataaacgtttgaagttggcactgttattattctcactttacagataagcatgttattgcttagagagaaattataagaaacttgctcaaagtcccacagctacaaagtgacagtcctataattcaatctagttttgaattatgctttttaaaatctatgctatactactttata

SEQ ID NO: 22550 - DNA, 208 bp, Homo sapiens
ttttcttctcgtctgtcgccatgtgagatgtacctttcactttcctccatgattgtgaggcctccttagccacatggaactgtaagtccaataaacctgtttcttttgtaaactgcccagtctcgggtatgtctttatcagcagtgtgaaaacagactaatacaacgacttacagattatgaagaaataatgttttgtacaaggtgat

SEQ ID NO: 22551 - DNA, 287 bp, Homo sapiens
cagagattattcccatgtttctgggttgaaaaactttgaaggtattggtacagatcagtaatccagtgtttccgggcgtggtgtttctcaacttttttttaatcaccttcctaaggaaactttttagacctttttttccccctaatgtacctgccctatgacatattaacactgagataaactctgtatctttttatgtaccatgtctgtgctttatacataagagtaagtgtacaatttagtttttattcaatgcatggttaagaaagactaaacagggcggggca

SEQ ID NO: 22552 - DNA, 130 bp, Homo sapiens
  misc_feature 15: s=g or c
ctttttccgcgcgascccagagctccgatccctgcgcgggctcgagagctcgccccgaacgggggtcttcctcctccgccgttgacaggttttgacctgtagcagagaaccaattctggagaacagccac

SEQ ID NO: 22553 - DNA, 468 bp, Homo sapiens
tattttaagaaacaggctttctgctccttaccctgagcttgagaagaaacatgccttgtggaggaggcaaatgtggataaaacccacagctctgtcccatccttcccatttttccagctgtagaaacatgtctcctaatacagataggctatccctgttcccatactgctttgcacatagcaggatcacagtatttaatgaatgaatgaatgagtgaatgaatggtatcaccagcctccggacttcagaggcttccttagctcctgtggtttgtttgtttattttgagacacagtgtcactctgtcacccagactagagtgcagtggtatgatcttggctcactgcaacctctgcctccaagattcaagccattcacgtgcttcagcctcctgaatagctggaattacaggtgcctgccaccgcacctggctaatttttgtattgttagtagagatggagtttcacca

SEQ ID NO: 22554 - DNA, 220 bp, Homo sapiens
tgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggccca

SEQ ID NO: 22555 - DNA, 246 bp, Homo sapiens
cggatgagttttttttacaaaagcgcaaaagcaattccatggacaaaaacaaaatcttcgacccacgtctcaccccacacaaaaataactcaaaacggatcctggacttcaacgtaaagcataagacaatcaaccttcagggccaggcatggtggcccacatctgtaatcccagcactttgggaggccaaggtgggcagattgcttgacctcaggagtttgagaccagcctgagcaacgtggcgta

SEQ ID NO: 22556 - DNA, 294 bp, Homo sapiens
  misc_feature 226: s=g or c
  misc_feature 273: k=g or t
aggatacagcattcttccttggtattctgccaacattttattcacatctcatcatattatgttgatgttatgtgtatatatttttccctaacatcctaagttaaacttctccagggaagaatgctgtatttatcatctcaagtacatagatcagtgtctaacatttagtaggattttagtaaacatttttgagcttgacagaaaggattaatttggattaatgaasccaaccaaaggtaagtaaaggctcagatacagccatatatgcctggkcttctaaacctcatagcttta

SEQ ID NO: 22557 - DNA, 325 bp, Homo sapiens
  misc_feature 305: r=a or g
  misc_feature 307: s=g or c
gtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacrcsaacatcctcagtgggaga

SEQ ID NO: 22558 - DNA, 175 bp, Homo sapiens
tacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaaagac

SEQ ID NO: 22559 - DNA, 155 bp, Homo sapiens
cttgcacacatgggagagtggccctctagggagatatctagaggtggacttggttagtcacaggtatgcccattttcagtttcaatatagcctagaattgcagtacctagaggcagcaggcttgcagagtacctgtttccctaccatctggccgc

SEQ ID NO: 22560 - DNA, 207 bp, Homo sapiens
atttagaaataaaataagaccttcttattgctttttcttgctgattaggaaaaatagccagccagttctaagtttggtcctttgtgagaaatgtgtcctctgcctggcgtcagtcatgctctcatgtgaacattcccttgaatttgtcctgtttccagctcatcctctgctaccttgatgcattccaggaccacaatcattgacaat

SEQ ID NO: 22561 - DNA, 253 bp, Homo sapiens
  misc_feature 11: n=a, g, c or t
tataccacatnaatagaatgaaggacaaaaaccatatgatcatctcatctcaatagatgcagagaaagcacttgacaaaattcaacatccttttatgactaaaaagtttcagaggggcggttccaagatggccgaataggaacagctccagtctacagctcccagcatgagcagcgcagaagatgggtgatttctgcatttccaactgaggtaccgggttcatctcactggggcttgtcagacagtgggtgca

SEQ ID NO: 22562 - DNA, 116 bp, Homo sapiens
tatagtcctagaatatgtgttccttctgctttcatgaacatagtgcaaaacatgtatttatgtatataagtttgtggtttgtgaaatcttaggtgatgcaaaatatttgaccattt

SEQ ID NO: 22563 - DNA, 248 bp, Homo sapiens
  misc_feature 221: n=a, g, c or t
  misc_feature 222: r=a or g
atcctgggtgcaaactttttcatttttacatcaaagtccttagccacatctgtaaagttccttttgccacgtaaggtaacatattcactaattttgaggattagggcatggacacattttggggtccttatttcacctaccatactaaggaaatatcaaagagtctggcacctaacccagtttaggagcccaggaaaagcttcgaggagcagatcagctgnrgtctcaaactgggtgaagcgggagcc

SEQ ID NO: 22564 - DNA, 413 bp, Homo sapiens
  misc_feature 31: m=a or c
  misc_feature 49: m=a or c
  misc_feature 323: n=a, g, c or t
  misc_feature 324: h=a or c or t
  misc_feature 325: w=a or t
tcttgcacattaattatgttgcttgatcgcmgagcattgggtgtctgtmtattgtcctagatgaggctggaaatattcttcagctcaatagtttgagtcgccatgaagttttgactacctccttcagatggttgacctctttcagttggtgactgcattactcatttaaacaattatacagccctaggattcctcaactgaccgctggctctatctctcagcaaatcttcccgtcccactggacacatggaaactttggatctctatgcaacaatcaaagggaacaagcaactgtagggaaagtaggaagtccaacaatttcnhwcttcatagaccgttttgcctgatcttcctgaggaaagagagctagaagacatagacaaggatgagaagagctattcttaggggagagc

SEQ ID NO: 22565 - DNA, 330 bp, Homo sapiens
tttttacttcttaggatgaaatggtgacttccagctccttatgtgctggcctggaaactggaggtcagtcattcctttgttactgataaataaaattccattgtatgaatacatctttattttcttagctgttcacccactgaaggacatttgcttgcttctagattttggcaattatgaataaaaccattataaacatttgtgtgctggtttttgtgtgactgtatgttttcaactcaattgggcaaaaattaggagcacaattcctggattgtatgcaggactatgctttcaaagaaactgctaaacactgttttgtaaaatcacacg

SEQ ID NO: 22566 - DNA, 189 bp, Homo sapiens
ctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggacca

SEQ ID NO: 22567 - DNA, 159 bp, Homo sapiens
aggaaccgtgctgcgtctgagagaagaacctgcagtagctgtttaagtgtgcggtgctggcagagtacctccctgaaggtgtcctggggaaagtgtggtgtcagcacagcggcaggtcaccgttcaggaaggacccttgtaccgcacggagggctccct

SEQ ID NO: 22568 - DNA, 79 bp, Homo sapiens
  misc_feature 2: m=a or c
  misc_feature 7: k=g or t
  misc_feature 41: r=a or g
  misc_feature 43: k=g or t
  misc_feature 44: y=c or t
  misc_feature 65: m=a or c
amaaggkacccgggggtggggaaggcccctggccgcggcarakytccctgccaccggccctgtcmtgcttgccgaccca

SEQ ID NO: 22569 - DNA, 364 bp, Homo sapiens
  misc_feature 118: r=a or g
  misc_feature 122: m=a or c
  misc_feature 319: s=g or c
tagcttcgtaatctttggcaaggccattggattcttcagctgtacaattaggagactcgatcaggtgattgcctttctcagctgtcagttctctaatttcaggcttggtagcttgtarggamctgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataastgcacatattaatttattgccagaataaattgcattgcatgcact

SEQ ID NO: 22570 - DNA, 359 bp, Homo sapiens
tagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctgtctcattggtaaacctcacatttagttacttgtggctactgcccgcacatacacttctgtaattgagaactcttaggagaggactagggt

SEQ ID NO: 22571 - DNA, 303 bp, Homo sapiens
ccttgaaatctttgcttatgccctgcagtactttaaggagcaggcgctgaaggtaggactgatagttgaggccagccagctgtgtgctaggcggtggcacccgtgccagctccgtgtctcgggctgctgcacctgctggccagggtaggaggcacagcctggagggagagtgtgggctttggagtcaacacaacaggatgaaccctcacacgctgctggtgggaaagtaaaatggtgcggcctctttggaaaacagtttggcaattcctaaaaaagtaaagcacagagttaccgtagacctga

SEQ ID NO: 22572 - DNA, 177 bp, Homo sapiens
  misc_feature 30: k=g or t
  misc_feature 48: k=g or t
  misc_feature 49: k=g or t
  misc_feature 56: s=g or c
  misc_feature 98: r=a or g
tcttcttccgtccttacctaaccaccacgkcccctcgcctgcccttgkkcccccasacccctcccgtccttacctcgtcacgtccctaacttgtcctrcccccgacgttactcttttccattcatatacccccaacctccctcgtcccctctttcattcttaccgcccaagtccccc

SEQ ID NO: 22573 - DNA, 204 bp, Homo sapiens
aactttacccagatatactatatgccaaacaatgtttgtcaccagggataccacaacagaaaacaaatacactaaaaatgttcgctttcctggccgggtgcagtggctcatgcctgtggtcccggcacttcgggagactgcggcgggcggctcccttgagcccagagtttgagaccggcctgggtaacatggtggaaccccaat

SEQ ID NO: 22574 - DNA, 136 bp, Homo sapiens
ataacagaatgatttacattcctttgggtatatacccagtgatgggatatatgtgtcaatggtattactgtctttaagtctttggggcatctccacactgtcttccacaacaattgaactaatttacacccccatc

SEQ ID NO: 22575 - DNA, 137 bp, Homo sapiens
agatttctctccgttcagggtccctgcgaccgcagctcagctcgaggacctgcagaaacaggggaatgcctcctggggcactcctctcaggagtaggagccttaggtcagaaaggtctccctcgtatccagccccgg

SEQ ID NO: 22576 - DNA, 211 bp, Homo sapiens
  misc_feature 40: r=a or g
  misc_feature 184: k=g or t
  misc_feature 202: k=g or t
tgttcctgagtacccaatgttttgttcccacttatgagtraaaacctgcagtatttggttccctgttcctgcatgaatttgattgggataatggccttcagctacattcacgttgctgcaaagaccatgacttcatttctttttgtggcagaatagtattccatggtgtatgcatatgacattktttatacaatccactgtkaatgggacc

SEQ ID NO: 22577 - DNA, 294 bp, Homo sapiens
  misc_feature 33: w=a or t
  misc_feature 119: m=a or c
  misc_feature 195: k=g or t
atccaatacatcatgcatagaataaacactgtwgttttctctaggtagtctttgctgacctaagctacactagatttttctcactataaatactcagcttcctctttttctttacagamtactatcacaatattaattttaaaatgtgttttaatttgcataacagcaagaattatatgcagaatctctcatgtkcaatgtagtatatttgacatataacgggtattcatatataacctttgatacatgaatgattgattatacgaatgtatgaattaaaaagctagctgtcca

SEQ ID NO: 22578 - DNA, 261 bp, Homo sapiens
  misc_feature 217: s=g or c
ttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtsctgctcaaacccaacttcatctttttcttttagatacgatttta

SEQ ID NO: 22579 - DNA, 218 bp, Homo sapiens
acttaacagcaccatcaatcaactgatatcagtagactacttcattcaacagattacacattcatctccaattcccaagacattcacgaagatagacgcaattcttagtcataacacacatcttaacaaatttcaaagaatagacatcatataatatgtgctgtcagaccacaatggaatgaaaccagaaatcagtaacagaaagattaaaaggaaag

SEQ ID NO: 22580 - DNA, 230 bp, Homo sapiens
gtactagtggagacacgaaaggtctcctcatcccgcgagtggatcggcctccaccctagaccgaggagagaatggctctgcctggaccgacccccgcgccgggcggacccgatcttcggcctaaagcgtccacctgtctggaagccgccgccaccaagcttttattaatatatccgttcccgccgggttggctatacagatgcgaatcaactccgggggtggggtgagga

SEQ ID NO: 22581 - DNA, 75 bp, Homo sapiens
aaaaaagagctatacacttaaaaatgtttaaaatgggctgggcgtggtgtctcgcgtctgtggtcccagctcttt

SEQ ID NO: 22582 - DNA, 456 bp, Homo sapiens
  misc_feature 404: n=a, g, c or t
aaacatgctactgggtccaattcctgaatcccagtgcctggttcattttcaccacaacatggtggcctacaggggatctgtggcaaccctgcggctgtttcactctggggcactgtcacactcagatagaaactgactatcatccacccttcagctgctgagactggcagaaaatgctctttgctgactttaagttgcaggctagatgggtaggtgactttagtcataggtgcaggactcctgctatgtgccaagcaccgtgccaggaatttacacagacattgtctcatttcctcatccaccaagggagggatgatgaaaccttccatacaggtatctccttaggacccaaggaaataatatgtatcatagtgcattacatgtgacaattggagtagatcgtngtttaaagtatttcatgtaaaagtatgtattcatagaacatctagtatgatc

SEQ ID NO: 22583 - DNA, 316 bp, Homo sapiens
  misc_feature 277: k=g or t
  misc_feature 278: r=a or g
  misc_feature 283: w=a or t
  misc_feature 286: r=a or g
  misc_feature 287: r=a or g
  misc_feature 304: y=c or t
tttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggkrcaatwagrrgggataattttttatcyatatataatttc

SEQ ID NO: 22584 - DNA, 259 bp, Homo sapiens
  misc_feature 13: h=a or c or t
tattctgtgagthgaagccttggttgccgaacacgtttgtctaatacccacctcccacttctgaacaactactgttgagttgaataaggatgccctgggtccaatgtgacattctaattcatctttcatttttactccctcggtttttatgcgtgtacattgccttctttcaaaagcattgcaaaaaaataagacataagtaaggtttataagacagtctcaaaccaattgatttaatataaaatttcatagcacataa

SEQ ID NO: 22585 - DNA, 113 bp, Homo sapiens
atccctgaccgggccgaggctgctggatgccgcgtctccgcttctgctgcctgccgggcgggctccggtggccgcagcaaagtggggcaccaaggccctgtgctaagcactca

SEQ ID NO: 22586 - DNA, 155 bp, Homo sapiens
agcttctaacatatgcccagacacctggagctgggttttatggggaagagagttgttctgaggccaaggcaggtagtattagtgatattctgagacacaacagcaaggtcagctctgaaagctggcacttgctggtggcaacagttgcaggccta

SEQ ID NO: 22587 - DNA, 122 bp, Homo sapiens
aagacatgaagtccttgcccatgactatatcctgaatggtattgaccaggtttccttctagggtttaggctcaaaataaagggatggaggaagatctaccaagaaaatggaaaacgaaaaaa

SEQ ID NO: 22588 - DNA, 88 bp, Homo sapiens
  misc_feature 36: r=a or g
aaaaaagccccacctcgcctcagccgggcgggagaragggaggtctcgcgctttccccggggttgcgtcccgccccgcaggctgcccc

SEQ ID NO: 22589 - DNA, 243 bp, Homo sapiens
  misc_feature 140: w=a or t
ctttttgaatttgttgctggtacagttgcatgtattctcttaaaattattttgaggcctcatatctggttatttctcctttctcattccttatcttgcgtgtttttacctttttttcataactaagtttttgaggatgtwagtgttcttttcaaagaaccggttcgaaatgtacttttctttgctactttttgttattttattgatcacatctttaatcttttgttctctatacgtggcgcgt

SEQ ID NO: 22590 - DNA, 102 bp, Homo sapiens
gcacacaccgcaccccacgacgcccgcgcccccaccctcgcacagcctccagcaacaccctgccaccctcccctccgcgcagcaagcaccctgcatgccaga

SEQ ID NO: 22591 - DNA, 225 bp, Homo sapiens
cttccttaccttaacaagtgtcaaaataaatttttctttaacatgttgaagcatgaacttgagaatctagagcaggagtccacaaagtatggcccatgggccatatccagcccgctgccggtttcggtaccactcatgacttaaaaatgggtcttacaattctgagtgattgaaaaaaaatcaaaagaaggataatatttagtgacccatgaaccttatatggct

SEQ ID NO: 22592 - DNA, 389 bp, Homo sapiens
  misc_feature 184: s=g or c
  misc_feature 356: s=g or c
agtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcascgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgscatcgtcttcaatgcttctctgaacagccttta

SEQ ID NO: 22593 - DNA, 261 bp, Homo sapiens
  misc_feature 70: s=g or c
gtgtagctgttggcagtggcgctggggtggaagtgtgtggggtcacagatgtgtaagggtgggcgcggasagacccccgaaggtccctgaggtcaggctgaggcattggaccaaatccgtacataggcatttctctgaactgcgcgccaccttttgagtgccatctgtttccgtccaggactctgatacaactatccagtccgctgcagggaccggtcactgcgtcacaggttctccagagggccagaactaacaggataa

SEQ ID NO: 22594 - DNA, 305 bp, Homo sapiens
  misc_feature 304: s=g or c
actagcgccggagggagacgtacctggacctcgtcgtccttgcggatgggcatggagcggacattgtacttctgccgcagctccttggagagcggggatgacatgatcttcctgcgcacgtgtgagggggcattgaagtgacgtttgcggtttttactgcggtccgagagtttcgctcttgttccctgggctgcagtgcagtggcaccatctcggctcaccgcaacctccgcctcccaagttcaagcgattctcctgcctcagcctccccagtatctgggattacagtaaaataaaacaggcasc

SEQ ID NO: 22595 - DNA, 305 bp, Homo sapiens
cagaggggaaggaaaatctaagcaagaatgctcaaggaggcattttgaggcccctgtggagtggaggtgccccctttgaccttttcatcagtcttttcattcctcaccaggaagattccacaaagacaatttgagaatcttatgtgaagcagaactaagctcttgcagttagttatatgtgatgacagaaacagaattacatggtttgaacagcatgggtacagttatatgtggattttcttctggctctgccatccgtgaaacagcaagaccaacccctctcttcctcatcctcctcagccccc

SEQ ID NO: 22596 - DNA, 110 bp, Homo sapiens
aagtacaagcacccagctcctattcaaggatctgcttcaaaacacggatgcccacaaaagagcattccatgaaatctaccggaccaggtctgttaacgggattccagtga

SEQ ID NO: 22597 - DNA, 134 bp, Homo sapiens
actacctacactgccgctcagctccaggcgcgagtggaggtcggtgtggggagacgcgactcctgcccgggatggctgacactctgcgagccccggcggcccgcggccgggccgggtgactagttggagggact

SEQ ID NO: 22598 - DNA, 284 bp, Homo sapiens
ttagacagatttaagtagctaattgaccgattgtgaagttttccggttgctgataaaactattgagcgggtacagtcgagtagcaacctgtcatccgtgggattggtgcaccatttttctcaccgtggaagggcagcaaaggtgtttgctaagtaaaactgagtggatgagattggtatgaaaatcatggttgatctctgagcgggatgttagtgtttaagatccacggagtcaggcgcaaaatgagcacatttctctcagtattcagaaatgagtagatgccg

SEQ ID NO: 22599 - DNA, 374 bp, Homo sapiens
  misc_feature 82: s=g or c
aggggtcagaggccgccggatggcgtaggatcggccgctggtggtggtgataccgggtacccgggctatggcgccggcgcasgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaacaaa

SEQ ID NO: 22600 - DNA, 407 bp, Homo sapiens
  misc_feature 7: w=a or t
ttcatcwtgagctctgcgctttctctccatttgttgtggcatagcagaaataattaaatttattagtaggcctgtcttcaaaaaaaggcttttatttcaaaatgtgcttgaggacatagtggggagcaccatgagttaagccttagtttttcaggaggtagaactgctaggatataaacgtgtggttttgcaggatgaagagatgcttgtaccccaatataacgcattcttactgcaaataacaagttttctggcaacttcttcctggtatctacagttgattgtgtgtgtgtgtgtgtgtgaaaacgatgatttttagatttactgtcttgagggtagtttagcagtggtcctgaccattcattcattcattcattcattcattcattttgtcaatccatctgtga

SEQ ID NO: 22601 - DNA, 145 bp, Homo sapiens
  misc_feature 8: n=a, g, c or t
  misc_feature 57: r=a or g
  misc_feature 80: r=a or g
  misc_feature 128: s=g or c
caattttnatttctagtgtttattgctagtatgccgaaatacagttacttttatgtrttgacctgtaccctatgactttrctaaacacacttagaagttctagggctttattttctagattacttgasattttctatgaaaggca

SEQ ID NO: 22602 - DNA, 206 bp, Homo sapiens
ttttttacatcaaactcaatctcagaaagactggtggtgttagccacattgtcggccagtgaaactgaggctcgaaggagaaataacttgctcaggtcatacagttagtttgtagctgagttgtgactaaaacccaggtctctcggattccaaagcttgtgctcagaacccctgcagtgtacaaagtacccaaatagtgcccatcc

SEQ ID NO: 22603 - DNA, 173 bp, Homo sapiens
cttggacttcgttttaaagacatgaagcttcctgaattaaaaccacaggggtatatttaagagctacttatcaaagatggtaattttatccataaagcaattgctaaatggaaatcagaaaggtcagctgtaattcactccagggaatgaagatgacacactaagtctggcga

SEQ ID NO: 22604 - DNA, 343 bp, Homo sapiens
ccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtat

SEQ ID NO: 22605 - DNA, 135 bp, Homo sapiens
tatttgctgtatttactggttgaattaattgtaatgattttgatccagggaaaagatccatcaacaaattggattctcctgatccctttaaactgaatgatccatttcagcctttcccaggcaacgatagccctg

SEQ ID NO: 22606 - DNA, 138 bp, Homo sapiens
ctaacctcttaacatttcagtgtcccattgcactgttcttgattcttttttctgtctacactgactctccacccttaaccctggtaatctaatcttttctcagggctttaaaaaccatgcatatgcctatgagttccc

SEQ ID NO: 22607 - DNA, 176 bp, Homo sapiens
  misc_feature 117: s=g or c
  misc_feature 118: s=g or c
  misc_feature 164: s=g or c
ggaattgtgggcgactcggctaatggcgtcggcgagtcttaggggcctggggagctggcgctgaagcttcttgccaggttggctggtgacacccggtgtggctgggccccgcggcassaagggacctgcccgccttgtgggtttctcggccagagtcggcggasctagcgggacat

SEQ ID NO: 22608 - DNA, 105 bp, Homo sapiens
aggcgccgcggacgcaccgacggctgaagagcggcgatgcacatgcactagcagcaccccctaactcactccctccacatcccgcgccgccgccgccgcctcctc

SEQ ID NO: 22609 - DNA, 291 bp, Homo sapiens
ttactgcggccttgacctcctgggctcaagcaatcttcccttctcagcctccttagtagctggggctacaggtgtgtgccaccacacctggctatttcttttttaaattttttgtagagacagagtctcgctgtattgcccaggctggtctcagactcaagtggtccttctgccttggtcttccaaagtgctgggattacaggcttaaaccacagtgcccaacctataaaacttttaaatatttttcacctattcaccctttctaacattctttcttcttgccacctgtaa

SEQ ID NO: 22610 - DNA, 426 bp, Homo sapiens
  misc_feature 7: d=a or g or t
  misc_feature 283: n=a, g, c or t
caggttdtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagangttatgacttgcaattaaaagctgactttgaaatcattaaacaaatatgtaggactgtctctgcctgttggcattcagttatagttctgttaattttggcttgggatggtctccatgtgcttttttctgcctatttataggtt

SEQ ID NO: 22611 - DNA, 147 bp, Homo sapiens
agctgaggtgggaggatcgcttgagcccaggatatggaggctcgatgagctatgatctcaccactgcactccagcttgggggacaggggaagtctgtctccgcagctgggtgcagtggccttataatcctagcactttgggaggcca

SEQ ID NO: 22612 - DNA, 433 bp, Homo sapiens
gtgaaattgtatataatttttttaatggtataaagtactgaagttggcatattaaagaacattgaattttgagatggaagaattagattctagtcccatttctttttatatcttaataaactgacttttgtcaaacaattaaaaatgagaccgaggttttcctctagacataaacaagttgcacccagcttgtgggttttttgagcaaattgcaggggaggggatgcacagaaaatgagtgacagatggctgggtgtgatggctcacacctgtaatcccaacactttgggaggctgaggcaggcggatcacgaagtcaagagatcgagcccatcctggccaacatggtgaaaccccgtctctactaaaatacaaaagttatctaggtgtggtggtgaatgcctgtaatcccagccactcggaaggctgagaca

SEQ ID NO: 22613 - DNA, 190 bp, Homo sapiens
agcaacaataaaacaggtctaccctggagtcatactctaatttcttctattttcctccctttctgatcctttatcccactttttttttcttcctcctccttctttgtcaaagacatagaggattgagttattatcattgatccatacaaagtccctctctcatttattttctttcattcccaccctccaa

SEQ ID NO: 22614 - DNA, 200 bp, Homo sapiens
  misc_feature 184: k=g or t
tggcatcagaaacttctttcagaagttgaaaaagcatcccctctcccctctctggttctaaaccagattttaaaactgtcgttgacttgtaagtcgtccagatagttttatctcactgttacttcaactatcattttgaaggagttgtcatggccttaactgctgtcttcccctccttcttcckcccttcctcccctcct

SEQ ID NO: 22615 - DNA, 360 bp, Homo sapiens
  misc_feature 155: s=g or c
  misc_feature 339: d=a or g or t
  misc_feature 342: w=a or t
gagtagctggggttacaggcgcccgctaccacacccggctaatttttgtatttttagtagagacgaggtttcaccatgttggtcaggctggtctgaaactcctgaagagatccgcccacctcggcctctcaaagtgctgggattacaggcgtgastaccgcgcccggcccgagacccctttcttgtctctgcatagcgcccacccctggcctagagcctcttcagctttccatcactaagctaagctctcacctctactttagcctcttccttacttagacttgtgttatgggcttcctccactctgattaacccatccacatgctccgatcttctcadcawtcctgaagtcatttgata

SEQ ID NO: 22616 - DNA, 253 bp, Homo sapiens
ctgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaaac

SEQ ID NO: 22617 - DNA, 339 bp, Homo sapiens
aaatacataaataaataatttttttattcttactgtatgtggagattttatctttagtattttttgtatccactctagtaagaaattatcatgctataatttactctttgtagaatttttgtcaggagttcatattaaaattacattgacataaaataagtctctgagtgtttcttctccattttctgaaataacttttgaagacatatataatttcattaaaattgtcagtgtgaggaaaaacattctgaatttctaaaccacttaagacatggataagcatatggaaaattatacctggttatgagaccttcccaacacaaatgaaatgcagcaaca

SEQ ID NO: 22618 - DNA, 174 bp, Homo sapiens
  misc_feature 156: k=g or t
caatctattggttattggttgcaaagtgcctaaactctggctcaaatgaccttatgcaaaatatggggaaattactggaatattgactaccatccaaagatagatgtagcttcaggtataggtaggttcagggtttcaaatgatgcccagagggckttctttctctctcagttt

SEQ ID NO: 22619 - DNA, 278 bp, Homo sapiens
  misc_feature 193: r=a or g
  misc_feature 266: w=a or t
attaattctactctgcctacttcacagggtgcattgccagaggtctgctctctgtaagcctctcgaagaataggaaagtatttctgccctccaaaagcttacagtgctgtggaaaatgttggcaaatcagatgaaataatacatatgcaagtacttaagttttatcaacttttaatgccattatatacatgaragacactatttttctctctattttctctcaaagaaaatgggatttaggaaaatgggaaagcatcaaaaaacawcagagggactat

SEQ ID NO: 22620 - DNA, 157 bp, Homo sapiens
  misc_feature 54: r=a or g
  misc_feature 57: m=a or c
  misc_feature 58: d=a or g or t
  misc_feature 75: r=a or g
  misc_feature 83: w=a or t
cagttaatgtctctagtccttcctgtaaaggtgaaaataagcattgcgcatgtrcgmdacacacacgcacacgcrcacacacwcacacacacacacacacacacaaatcccagtgtctttttatgcatgtggtgagatgaaattgtgatctttgtgt

SEQ ID NO: 22621 - DNA, 227 bp, Homo sapiens
  misc_feature 24: s=g or c
  misc_feature 73: w=a or t
  misc_feature 146: r=a or g
  misc_feature 183: m=a or c
  misc_feature 189: m=a or c
ctttttttttttcgccagccttasgggcccgaaccctcgtgtgaagggtgcagtacctaagccggagcggggwagaggcgggccggcacccccttctgacctccagtgccgccggcctcaagatcagacatggcccagaacttgarggacttggcgggacggctgcccgccgggccccggggmatgggmacggccctgaagctgttgctgggggccggcgccgtggc

SEQ ID NO: 22622 - DNA, 68 bp, Homo sapiens
gagtatcaagggtgccttcatagacatttctttgtctgtgtattttcctcaaattccagctgccaaag

SEQ ID NO: 22623 - DNA, 242 bp, Homo sapiens
cattctcttaagtacaagcctatttctcagtttggcatagtgccaagaacattgataaatgttggccccaaaatgattgtcaaagttctgttcacttaaattcactgtaattagtaagaatagttatcatttattttgggtgccttcaaagtagactgtgctaggcaacaatttctcttgataatctcacaatagccttggcatttgaagaaactttggcctagaaacatttatgcccccaa

SEQ ID NO: 22624 - DNA, 147 bp, Homo sapiens
ttttttgtgggaggtgagaaaaaacaggacactatgaatatagcacccttttctataaggggcaaagagatcagggaatatctgtcattttttaaagtggagaactctcacagcctgtttgtatgctgatgggaatgatggagaggg

SEQ ID NO: 22625 - DNA, 122 bp, Homo sapiens
  misc_feature 17: s=g or c
ctgagtgaccggcggastgcggcagggagcagcattgtccacgggtcacttcaagatgagcgagatgacaagagccagaaacaccattttgaaaagttgcaactgaggccccttggccggca

SEQ ID NO: 22626 - DNA, 326 bp, Homo sapiens
  misc_feature 60: m=a or c
  misc_feature 265: m=a or c
  misc_feature 277: d=a or g or t
actttaaccaggccttccacctgccctgccgccacatcctagccatgctcagtgcccgcmgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggmcgacagctggadtgggccttatgagcaggtccaactctgattattctcgatgcccagagat

SEQ ID NO: 22627 - DNA, 276 bp, Homo sapiens
gttagcaaagtatttagcacaggaaagatcttataaaatgaaataatgcatgtaatgatgcattttccaagtagatgattttaacaaaccgtaagcttttatgcctgtccttcattgtgtcttttctgcctctttcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattaga

SEQ ID NO: 22628 - DNA, 316 bp, Homo sapiens
  misc_feature 209: r=a or g
cttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaaggraatggtcagcctaagggtaatgtacagcccgtgcttggagaaccatggaagctacacccctacaggtgcatactgttctgcttttccaataaatacgagcggcgaag

SEQ ID NO: 22629 - DNA, 83 bp, Homo sapiens
caaagaagtaaaggtaatacggtggaggcaagattatcttttcaacaaatggtactgaaacagctggctctccacatgctcac

SEQ ID NO: 22630 - DNA, 224 bp, Homo sapiens
  misc_feature 40: s=g or c
gagcttgtaaaacaccctggagagaaaatggcggcggcasagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacaga

SEQ ID NO: 22631 - DNA, 328 bp, Homo sapiens
  misc_feature 305: s=g or c
ttgtgaaaacaggatgagtagaaaatgttatactgttgtttctatcgtggcaccgctttcttataaattccatttgctttttgtcatctgaactgttacaaccatgggaaacctcagtccatatttttaaaagcactatatacttacaggaaaaaccgacttatgccttcattgaaaaaatgttgaagttaatatcccaaatgtttaatgagcatgttttagaatatttacagctaaagtctgtcactttagggatttgacaaaacttgagactgcctgccaccgaagagggaccaggcagaatsttctcagccttgtaaccagctgt

SEQ ID NO: 22632 - DNA, 197 bp, Homo sapiens
acactgccaggagatcctgggaagctaggtcacttccctgagcctcagcatccttatctgcaaaatagaaattgctaatagactaaaaggcaattctgaaagatggatgagaaaggaatataatgactcagggtagagcctgcaaaacaatatgggatgagaagatgcagggactggtttcatggagagagcaggta

SEQ ID NO: 22633 - DNA, 122 bp, Homo sapiens
aatagacataaaatatgagctatatcacccaagctacaatttaaaatacaacaatctataaacgcttaagtctgcaaccttgtatcgtttcatgcagtccttctttgtcctgccaggctaca

SEQ ID NO: 22634 - DNA, 177 bp, Homo sapiens
  misc_feature 67: k=g or t
tatgattctgactgtactgctcattctacttcacccacacctacttctccactggagtttcctattkgccattattataaacatctatctacctcctttctcaggccacataccagggagtcattcttaattcctccctcttcctaaaacatacacttcttcctaacatgtgccgaa

SEQ ID NO: 22635 - DNA, 135 bp, Homo sapiens
gaattaaggctttgtaggtaacctgaaattatttcatagcacatacaacaactataattaatgaaatatgcgtgtaatttaaaaatagaattaaaacttcataaatttcttaacattttcctttgagacttcccc

SEQ ID NO: 22636 - DNA, 317 bp, Homo sapiens
  misc_feature 3: k=g or t
  misc_feature 4: n=a, g, c or t
  misc_feature 5: d=a or g or t
tgkndtgccaacattgcctatttcagtggcacgtcatctagttttaaaaaaataaaacattttaaatggacagagaaaaataactgtcttgtcggtaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggct

SEQ ID NO: 22637 - DNA, 375 bp, Homo sapiens
  misc_feature 355: s=g or c
  misc_feature 363: m=a or c
atttctacaaagaaaatggagtcatttaatatcacaacctgaaatgtagtacatagcaggtccctagttcattgctttataaaaccttcacgtttgttattttattttacaacttttatttttttattttttattttattttatttttttgagagggagtcttgctctggtgcccaggctggagtgctgtggtgccatctcagctcactgtagcttctgcctcccaggttccagcgattctccttccttagcctcccgggtagctgggattacaggcatgtgtcaccacacccagcaaatttttgtatttttagcagagatgggattttgccatgttggccaggctggtctcgasctcccgamctcaggtgatcc

SEQ ID NO: 22638 - DNA, 122 bp, Homo sapiens
cgcgctggctgcagctgacccggcgaagggagccgaccgggccctgggctggaggtaaaaccccacggaaagaacatgaggttcccttggaaatcattcaagaggaagatggaaggggcgca

SEQ ID NO: 22639 - DNA, 191 bp, Homo sapiens
aatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccc

SEQ ID NO: 22640 - DNA, 138 bp, Homo sapiens
attttgtcccggctccctggctgtctgtcaaactgctgagactgctgcagtgctacccacccccagaagaccctgcagtgcgaggccgcctgactgagtgcctggagaccatcctgaacaaagcccaagaaccgccct

SEQ ID NO: 22641 - DNA, 142 bp, Homo sapiens
acttcgtcgtcacctcacaaaaggcttccaaattcactgcggcagacaccgcaaaataaaaatgttaaatacatcctagctgggaggggattgaagcctccaggctcaatcaaaggtttgcaataataggattcatttaaaa

SEQ ID NO: 22642 - DNA, 175 bp, Homo sapiens
acgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcga

SEQ ID NO: 22643 - DNA, 120 bp, Homo sapiens
  misc_feature 9: s=g or c
tgactattscaaatgaagctgctctgaacatttctgtgtaagtttttgttggaacacctattttccagttcttagggatatgtatttatatcaagccaaactacctacctaaccaccctc

SEQ ID NO: 22644 - DNA, 327 bp, Homo sapiens
tgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaatacctttttttaggaggaaccacttctttttaatattgaaatctgctggttactttatgttttctcaagttcagttgactagagctgaccacagggtgtcatcaattcagattcctaaataaccctttctctccacacccagtcc

SEQ ID NO: 22645 - DNA, 130 bp, Homo sapiens
  misc_feature 109: n=a, g, c or t
gctccaggaatcgggtgtgcctggccctggccgggggctgcccccgggagcagcgtccaggcccatggcggatgcagtctagaggactgcctggaggaggcggcgccgnggcgagacctccagagcgcaa

SEQ ID NO: 22646 - DNA, 131 bp, Homo sapiens
ctgctttagccttctaggcccttacctggcattctgtgcttttgccgcacaaaaattctatcagcaactcaaacatgccatactgcctctttaggtctttgcatatgctattttctctccttaaggcccac

SEQ ID NO: 22647 - DNA, 390 bp, Homo sapiens
tttcatctagaccattggttttcaactccaaatgcaggtggcttatgaagactcagcctgaatatataaagagaacagcaaacaatcatagttgcatattaaagacaatctatttctccgtaaaggaaagtaaagtgagtcatattacatacaagccacaatacagaactgatctgaaatacactgcggaatggcctttcagtctatgctggactctaacaggaaaaaggcagaaggtggtcaatggtgcatttatttaaacccctcatttcctccctgacgagaagaaggacaacagttcttatttttcatattatttttgaaaaggcagaaaggttaattatatattgacatgatttggatctgtgtcctcaccataatctcatgtca

SEQ ID NO: 22648 - DNA, 414 bp, Homo sapiens
  misc_feature 191: v=a or c or g
  misc_feature 192: n=a, g, c or t
ctggtagaacagtgtggacattgcagaagctgtcactgccccagaaagaaagcaccccagagccaaggcaaagaggtgagtgcatctgtttctgcaaagggctcagattgctacagactttctgcttggcttcatgttgtgctcagcgtgaacgttctccctcacccccgccttcctgttctcctccctgvnctgggtctgtggcaagcttgagtctatgtgatgaatgctagagtgaaatattcctgtactgccttctctcattcaaaggccaattcactcccagaaagaactgggtaggtctggttcttagtggggaagcaggaaatggttcctactaagtgaattatctttgctgagatccaagaagacgtttaccaggaaatcattagacaaatcccattacagtagact

SEQ ID NO: 22649 - DNA, 363 bp, Homo sapiens
  misc_feature 220: k=g or t
  misc_feature 260: r=a or g
  misc_feature 331: m=a or c
atttattagttcttacatattataggccccaaatttatttttttcaatttactgataaatgtaattcagtatatttggatgtgtttatccaagttactaggtaccattatgtagtttacaaaaatgccttaaatgttatttttctaaaatttgttttgaaataattctagattcacaagagattacaaaatatacaaaagtttcctgagtattctttgcktagcatcatcaatgttatcttacataaccataataataaraaccacggagttctgctcttgttgcccaggttggagtgtaatggcgcgatcttggctcactgcaaccccgmctcccaggttcaagagattttcctgcctcggc

SEQ ID NO: 22650 - DNA, 243 bp, Homo sapiens
cttattttaaccaacctaattaatctacctgattaatttatcaacctcagaagtttggggagaaaataaaatcagtgtggcagagacttccacagtgatacctggattataaatttactgttacctcaaagaaaatccagatccaaaatctctctgcctcttttccagtaacaaacccagcacatcttcatttagggcaatatcctcttgccctgcccctcctctaatttacagccccataca

SEQ ID NO: 22651 - DNA, 131 bp, Homo sapiens
gctgacacagtctcgctgccaccagaagtttgtcaacatcaaacttctcctgtgtggggtacgttcaccttccacgagtatttaatcgagccaacaagcaaacaaacaaacccaaataaacctgcccataa

SEQ ID NO: 22652 - DNA, 136 bp, Homo sapiens
tatttattaacttactcgataattgttctctgaatctgaagtgatggccagaatttttaaaaagtgtgaacatttcttatccaatgaactagttataaaatcaaacaaataaatgaagaaaaaaacaggagccgac

SEQ ID NO: 22653 - DNA, 354 bp, Homo sapiens
ccctgaaaatttcttaccagacttaggacatctaagtaattcccaaaaactcagagaactacagtgttcatacgccttcattgccaagcaagtctctaaaagcttttgcccaatatgcataaatgttcgttgtaggccaatgtgtagtcacccaacacaattgatcaaatagcaatgaaatgcctactatgtaccaaaaacttttctggatactgcacgtgtgtatgtgtgtgtgtgtgtgtatttggtgaaaaggtactaggaaactctgaatacaatctctgtccctcagaaaagtatcatttacctatgttagggtatttctttattaatttatcttatatacatgcatgc

SEQ ID NO: 22654 - DNA, 282 bp, Homo sapiens
  misc_feature 70: k=g or t
  misc_feature 269: r=a or g
tcaatatgctgaaaaagtgtataaacatttggaatgtataacccagggatccactgttttccaaatggckaatgcatgatattacagaatcatgcatggataaaagacccatttaaagtacaaggtcaatgaattttagtgcaacaaaagcatgagaagttcatcgttataggttttgttaacacatagcttttaagagaccacttactttctagttctgatgtagtgtcaaataagactattcacatttatcagaaaaggctattaaratgcccctcctct

SEQ ID NO: 22655 - DNA, 124 bp, Homo sapiens
  misc_feature 122: m=a or c
agttctggcgctgctgccttcctgagtgagcggtggagggaaccctagaggacagagcccccagcccggcagcaggccccctctccgcccgccaccacggaggagaaggaggacagccagcmtt

SEQ ID NO: 22656 - DNA, 296 bp, Homo sapiens
aatggttaagaaaagaggattctataccctagagacatgaacgtatttatgtacttaggagttgggcttagtggagagggaatgagtgaggagaaaactgaagtggtggcaattgatgaaggtggtaggaggagttagatcatagatgtgaacattgaaaataagtaagtatactttagcctctgataaagaagggaagggtaaaaagaagtttgaagataaaaagaaacttttagaatggagaagagtgtctaaaaagtttattttttatgacactagccttttcaggaaagcaa

SEQ ID NO: 22657 - DNA, 334 bp, Homo sapiens
  misc_feature 262: k=g or t
  misc_feature 273: k=g or t
  misc_feature 278: k=g or t
  misc_feature 281: k=g or t
  misc_feature 282: k=g or t
  misc_feature 311: k=g or t
  misc_feature 315: k=g or t
catttgttttagatttaattctattttgtatgctacatttctttttctgattttctaggttttattcctttccttagtccaggtttcttacacttcagagtatcaggtgttccatgtcagttctttgaaattatatggggttgtatgctctctgtgatactaattgcttagttctttaggaaagaatagcatttgacatacatatacagattgtactccttttacagattcatcatgtttttgaaatgtacacttgtgagakacttataaatkatgtkttkkctttggcattcttaataacttcggatatktgtktcactgtcattttgagaga

SEQ ID NO: 22658 - DNA, 155 bp, Homo sapiens
ccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcacaa

SEQ ID NO: 22659 - DNA, 217 bp, Homo sapiens
  misc_feature 127: n=a, g, c or t
  misc_feature 174: s=g or c
  misc_feature 192: s=g or c
attactgattcacagcgagaggcagcagcagcagcagtagcagcagcagcagcaacaacagcgctgcttgtcacgaatcgaggattgcaatgagctcatcgttttctccttgcagcttcacaactgngctggcttcctggctactgctgctgctgtcttctcacacatagacasgcacacacaccctttctsgcacacacacacacacacacacaca

SEQ ID NO: 22660 - DNA, 139 bp, Homo sapiens
caagggatttatgtctacatatttgtgtgtgtgtgtgtatatatatgtaatatgcatacacagatgcatatgtgtatatataatgaaatttatgttgctggtattttgcattttaaagtgatcaagattcattaggcaa

SEQ ID NO: 22661 - DNA, 281 bp, Homo sapiens
  misc_feature 73: m=a or c
  misc_feature 76: w=a or t
  misc_feature 195: r=a or g
  misc_feature 238: r=a or g
acattgcggagatggtcccgccccacgtgcctccaatcccggactcggactctggcttctgctgctgatgcamggwatcccctgggctcccgtccactccactgctgaccagcccattcgcctgtgctgagtcttcctgcaggcctttccttgcctctgtgggaccctgtgggggtccatccggctggagaagaraagcctctcatgctaacgttgcagaccccagagggtgagagaragggggacttcattcagtcttgaaacctgtgtgctcagcccca

SEQ ID NO: 22662 - DNA, 302 bp, Homo sapiens
gtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacaggtatataatcataacacaagaggctttagttctattgtaagctgctgttcttaccacaactgtgtctgtaaattttccattttgtcttaaatattgaaatgggccctac

SEQ ID NO: 22663 - DNA, 280 bp, Homo sapiens
aattatctgcttgatttgaatgaagttcctgacattccagttaaattattttatcttcacttcaaattattaacagtgttacttctcagttgccaatcagggacatgaaataggcacacacacaggcatatttagaaggtaaactcgtatatggcaagcatgccttcaactcctaatgtttcagaaatagggtgtctaacttaaaacctattctccaaataaagtggccattcttcctcagccccaccccatcacacacacacacacacacacgcacacg

SEQ ID NO: 22664 - DNA, 302 bp, Homo sapiens
  misc_feature 203: r=a or g
  misc_feature 204: r=a or g
tatgaataaaatatctaggaatacagctatcaaaggaagtgaaggacctcttcaaggagaactataaagcactgctcaaggaaatcaaagagggcacaagcagatggaagaaacattccatgctcatggataggaagaattaatatcatgaaaatggccatagtgcccaaagcaatttatagattcaatgctattcccattarrctatcattgatattcttcacagaattagaaaaaaaactggctgggcatggcggctcacacatgtaatcccagcactttgggaggccgaggtggatcac

SEQ ID NO: 22665 - DNA, 143 bp, Homo sapiens
ctggcaaagtggattatgcacctgcctgctattctccagcggtagcataagctgtccctcctcccaggacagcaatggctacctgacagcagattgttaaatagctctcatttcattctgcttcaaatctctgaccccaacta

SEQ ID NO: 22666 - DNA, 221 bp, Homo sapiens
  misc_feature 14: k=g or t
acttactgtaagtktgagatgttcgggtaggagatccttcagctgggcgatgcactcgttaatccggtcacgtctctttttctcgatgagccggtgcggcaatttgtaggtctcctgcaagacgcacggggaggcggtgggcgcttggggaaggagatgagaagcctatcctcccagccccgcagcaacagtccggcagaggagcagagtagcagagatgt

SEQ ID NO: 22667 - DNA, 179 bp, Homo sapiens
gacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgccgt

SEQ ID NO: 22668 - DNA, 387 bp, Homo sapiens
  misc_feature 322: s=g or c
  misc_feature 356: w=a or t
  misc_feature 357: k=g or t
  misc_feature 360: y=c or t
  misc_feature 381: y=c or t
gtgcacaggaccctaggactccctggattatatgccctttgtcttccactaccacggtgcgtagggaaggaccatcaggtgggggcagggctaggcatgtctgagctcagacactccttgggtgggtcttgctgcagagtatttggggtgtctcctaggtcctgcagtagcagtccacttccttcaaagggtctgtggctcctcttgggattgctggtttgttcttgaagtcgatccagagctaaagttcacatgcaagcctctgcacactgctctgttagtccgagtcagagctgcaatctagtcctgcctctcgtctgcsatgatcccacctcttgggattggcttcttttttwkttyctttttttgacagagtctcaytgtcgc

SEQ ID NO: 22669 - DNA, 137 bp, Homo sapiens
ttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccaag

SEQ ID NO: 22670 - DNA, 69 bp, Homo sapiens
gcattcttcaggtaagggtatagacttgggatgtgaggcgttatgctgaaaggttctgtcacgaggggc

SEQ ID NO: 22671 - DNA, 166 bp, Homo sapiens
gttcagcggacacgggagcaagatggcgattccgggcaggcagtgagtgatccgggagttagggtcaggctgggggatgagaaactacggcgactgtatctttggccgaggagttttaaatgcgctggaagtgaagggactgtgtcgtcaagggtagagacgggcg

SEQ ID NO: 22672 - DNA, 340 bp, Homo sapiens
ctaaagggtttaatgtggttatttatataattaaagttccatggttcttaaaattaccttgaatgaatgagatatttgataattgctttgttctattaatacttactggacacttccttttataagaacgatctttgtaggactatatgtgtcagtaattatgagcttcaatcctgacattaataacttactgttgagcagagaagagttgcttctaaaccttgtgcttttatatactaatttaaaaacttaaagtgatagtgagctatgaagtaccaatcatgtatgatatgtaaatacaaagcacagtattattaaagtctcatgtggaaaagtctac

SEQ ID NO: 22673 - DNA, 303 bp, Homo sapiens
atcagtttcctgagaataggaatattacctgtctcatggggttgttataagggtgaaataaatgagttcatacatgtaaagcgcttaaaacagtgcttggcacttagcacagcataggtactgttctccgccattatttgaacagggccctagtcactgctttcagttgcattgctccttgcttcacagccctgattgaatgccttctttagttgcatccacactaaaatagatccttcagttcctagggcacgcacggggcagcagcatcttcagagaacagttctctcttccacgtcccaa

SEQ ID NO: 22674 - DNA, 126 bp, Homo sapiens
attttagtagagacggggttttaccatgttggccaggctggtcttgaactcttgacctcaagtgatctgcatgcctcacctcccaaagtgttgggaatacaggcatgagccaccacacccggcaca

SEQ ID NO: 22675 - DNA, 280 bp, Homo sapiens
  misc_feature 83: s=g or c
caacataaggtaaaagtcttcaaaatctggcattttacactttcctcaacactcagtttgtctagccacatcataagtgctcsgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccca

SEQ ID NO: 22676 - DNA, 361 bp, Homo sapiens
  misc_feature 46: n=a, g, c or t
  misc_feature 47: h=a or c or t
  misc_feature 294: s=g or c
  misc_feature 295: r=a or g
  misc_feature 334: y=c or t
aattactagcataagcaatgttgatagcacccacaggatgggcctnhgaagagctccaccagctcagacagcccctagtactacatgtggctgtcattactggagatgccctggcttcttccttcatgggcacttttagctgagagcaatatctggcagcacccaagaggcatttgatctttctgctgaaagtcacaagtagagacaggtggcattgccatcaaggcatgtcattagggccccctgcctcccatttccatgacacttccttccttcctgccctctttttgtgtsrggcacattgttttgggccaccttggggcccaagtatgtyggaagcaataatgtagttggtagcgga

SEQ ID NO: 22677 - DNA, 170 bp, Homo sapiens
ttatataagtgtaatcatgttatttattcttttgtgactggcttatttcacttagcataatgtcctcaaggttcagcatgtgttagaatttctttccttttcaaggctgaataatatttcattgaatttatataccacatgttgtttatttgtggatgaacacctgggca

SEQ ID NO: 22678 - DNA, 446 bp, Homo sapiens
  misc_feature 263: k=g or t
  misc_feature 327: k=g or t
  misc_feature 331: k=g or t
  misc_feature 389: w=a or t
  misc_feature 423: w=a or t
ttgggaagagacaagggatagattttcgtctagagcctccagagggcttggaattctggcttctagaactttgagaaaatttatattgttttaagctgagagttttgtgataatttgtcatggtagccacaggaaactgatacacagatactgctatggccattttaggaaaagtacaatctgtgcaacagtaccgccaccatcaatgctattaagcgtgcagtcaccacacctgtattgaacattgtttgaacaatgttaaktgcctggctttgttttctcttactcctcacaatgaccctgtgaatggggactattatctcctckttckatgtaaagaaactgaagcatagaaggcttaattcacctgtccaacctttttagctagwgggtagccaggtcaatatataaaccaagatatgwctaacttcaaagcttatgctttt

SEQ ID NO: 22679 - DNA, 378 bp, Homo sapiens
agttctaatcatgaagcccaaatctgacaagagaagttaattataagaagatgtcttattagaaagaaccagaagccgggtatggtggctggtgcctgtaatcccattgcttttggaggctggggagggaatactgcttgagcccaggagttcgggaccagcctgggcaacatggcaaaaccccatatctacaaagaagtcccagctcctaagtagctggaactataggcacacaccaccacgccaggctaatttttgcatttttttgttgagatggggtttggccatgttgcccgggctggtctcgaattcctgcactcgggcagtctgcccacctcagcctcccagagtgctgggattacggtcatgagccactgt

SEQ ID NO: 22680 - DNA, 192 bp, Homo sapiens
aaggtaatttatgttccttgggaattgaaatggtcagtggcccgttacagaaacttatcagtcatatatcagcaccagttcattcttttgcaccttagggaccatctgtcccctgaggtgacctgagaaacaaccagttgcccacagactgttatttcttcaagtgagccaggatttgatttcactgcccaa

SEQ ID NO: 22681 - DNA, 106 bp, Homo sapiens
tctcagatccttggacccagccctgaccccagtccagctaagctcaaccctgaccggtcctccttcgagactctttcagcctaagatctccaaccagacccgccca

SEQ ID NO: 22682 - DNA, 246 bp, Homo sapiens
  misc_feature 3: m=a or c
  misc_feature 76: m=a or c
  misc_feature 103: r=a or g
agmcacagagacagacgccagagaggaaggcagacaaagagacgggtggagacaaagactcccaccaagagacgcmgaaggaagatgccgacggtaaagacaraacaggagacgcgcgcaaggagcaggattggaacatcagttaacatctgaccactgccagcccaccccctcccacccacgtcgattgcatctctgggctccagggataaagcaggtcttggggtgcaccatgatttcaccgct

SEQ ID NO: 22683 - DNA, 115 bp, Homo sapiens
  misc_feature 24: v=a or c or g
  misc_feature 25: s=g or c
gtgctggctagggctttttatttvstagggagcagtttccccgcgcgacagttcgggagcgcgcaggcagtcgcgcgcacacacgcacgcaggcacacacacacacacacaaaca

SEQ ID NO: 22684 - DNA, 116 bp, Homo sapiens
tttcaattaaaaaggtagtggaagaattggaagacagaccagagctacagcatgtgtatttgcataagcttttcactggactagtccagaagcttcctgaatggtctcccagcttg

SEQ ID NO: 22685 - DNA, 150 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaaaa

SEQ ID NO: 22686 - DNA, 95 bp, Homo sapiens
  misc_feature 12: s=g or c
  misc_feature 24: k=g or t
  misc_feature 25: k=g or t
  misc_feature 85: r=a or g
gccgacggctgsctcaaacatcakkgtgagtttctcacaatgtagcaatttctctttaaatctcttaactctctctacctgcgartcggggtttt

SEQ ID NO: 22687 - DNA, 125 bp, Homo sapiens
ttttagtagagacggggttttaccatgttggccaggctggtcttgaactcttgacctcaagtgatctgcatgcctcacctcccaaagtgttgggaatacaggcatgagccaccacacccggcaca

SEQ ID NO: 22688 - DNA, 370 bp, Homo sapiens
aattaaatcctaccgtaactagtagtgaatcttgttcaataaactagattgtaattttacctaaagtccatacacctaaggcatgaatggtaggtagatatatggtttgtttcaagcatcaactctccaatttttcatcagattttcaatccttaagccctggagctttgtcagtgacaggcttttatgaactagcaaaaccaggacagtggaagtgaccctaaaagaaacagtaaagcatattgtttaagaccatgaactgaccttgtgttcgtcccaggtccacccctaaaatgctatgtgaccttgggtgacttaatctatgtaagcatctgtttctcatgcattaaataggaatgatcataatagt

SEQ ID NO: 22689 - DNA, 154 bp, Homo sapiens
tctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaat

SEQ ID NO: 22690 - DNA, 300 bp, Homo sapiens
  misc_feature 72: k=g or t
ctcatttccctgggcatctcccacgtataggtaagatgtacatgttataaacttgttttttttttctctctkgttaatctatcttttgttacaggggcactagcctagaacttagaagggtagatggaaacttattctatcctcctccatagaactctctccctctagctttcctctttatctcctacctctctggcacaactacccaatcagttttgcaggctccttctgcacttccagctccttatagaacaatgtccccaaagttccagtcctcaggcctctcctcagctaaccccc

SEQ ID NO: 22691 - DNA, 316 bp, Homo sapiens
  misc_feature 245: r=a or g
ctgatttcttagttattctttgcatagttaattctcccttcaggaatagggtgtttgattcagagtgtgcttgagattatagtgagtcaagtaagtatttgattggggaacttcaaatctatagtaaactgcctcaagttagttgcaaaccaccctttagtttttcagcaataccagatcgtgatgtagagcaataagcttgtttcagtggggaaaataaaatttctaaattgcccaatgcctgrtgttaaaataaaggggagctactttctaatcccatgaaaactaatatttttaaagatacaactctagcatt

SEQ ID NO: 22692 - DNA, 122 bp, Homo sapiens
taaactcactgaaagcatgtaccatgtccaggttggatacatggcaacaaggctatgttaaattttttttctctgagttgagtccctaaaatactatcatgggctaattctaagaaggagct

SEQ ID NO: 22693 - DNA, 358 bp, Homo sapiens
  misc_feature 293: r=a or g
tcaatactgtcataatttcagaaattggattgaattgcatctgaaagctacatcttgattgaggacttgaggtggtaatattacttggaatgtatgagtattatgagatttatttgcatattttctttgtagtctgtgaatgctggaaatgaaaaaggaaacaactttgaaatattttagtcaaaaaaccatgtcattggtttcataatacaatgtctccaataggaattctatttaaactcttggtttatgagatcacatttaaagactggattgatgtctgtgacataaarttttaattttttgcctcattcaaatttatgagacttcaaagtcatagatgttttaaattttggta

SEQ ID NO: 22694 - DNA, 115 bp, Homo sapiens
agagtaggaaggagtcgctgagctgaatctttgtggagtggagtggggcgagagtcctccgagtagtctggaaaattagacttctgagccttaattcatacttataagcagctag

SEQ ID NO: 22695 - DNA, 330 bp, Homo sapiens
acagtgtgatgtggttcagaggcagcttctagacctgcaggagggagattgtattcagaggaagagcatcattttggcaacatctgaaagtgaaaacggaagccagaaacacttggccagccctgggggatttttttcttctatgcctctctggtggaatgacatttgctgtgtaggcatctttcctctgactgtatttcttggccttgaagagtactgagtttaaaaagacagtatgtgacagtccatggaaattgcctcttctgtgaaatctcgccacctgctccgaagacatgttgttgtctcccaaattctccttatccaccattc

SEQ ID NO: 22696 - DNA, 97 bp, Homo sapiens
  misc_feature 24: w=a or t
  misc_feature 44: k=g or t
  misc_feature 46: d=a or g or t
tggagaaggaacgagagaaggatwttagtgatgatgaggcagaktdagagaaaggtgagaaagaagaggaagataaagatgatgaagaaaagccgat

SEQ ID NO: 22697 - DNA, 105 bp, Homo sapiens
cattctgagcctgcagccgccagatttccccccaacaccagactttgctgacccctgatctatgtacaagtgaagtccattttcccatgaaactttagtccttgg

SEQ ID NO: 22698 - DNA, 225 bp, Homo sapiens
tatgattggtaagaggaaattagagtagaatagttgtttagcctcttttgtaacacttgtgcaactttagtttcaacttcttgctgaggtaattctagctaatagatttctttttattagcttattataaaagtaatacttgctcatgtgaaaattgtaattgacataaaatttgaaaatattgccttccttcctcattattctactgtgtatattcttcccgca

SEQ ID NO: 22699 - DNA, 95 bp, Homo sapiens
ctaaacatatttattatttctgtgaaaaaaatttacaggtcaaagaattgaaaatgcctggaagatagctaaaggatctggaggcttttggggca

SEQ ID NO: 22700 - DNA, 263 bp, Homo sapiens
  misc_feature 40: r=a or g
  misc_feature 52: k=g or t
  misc_feature 57: k=g or t
  misc_feature 177: k=g or t
  misc_feature 198: k=g or t
  misc_feature 211: w=a or t
  misc_feature 215: k=g or t
  misc_feature 216: k=g or t
  misc_feature 219: d=a or g or t
  misc_feature 243: k=g or t
aaatttggtattatcgagattttatgttcatatatttggrataatatatttkaattkcaattgtagtatttgcaaaacacttcacttaaggtctttttccagttattgtcggcctcctctgagctcagcgctgactcagtattcctgagcaccttatgccctcgctcgtatgcagtkccaccctgggaagccttcttkatgggccatggtwtctkkctdttacatagtgaaaacaggcctctkgttcactggattcttgagaa

SEQ ID NO: 22701 - DNA, 130 bp, Homo sapiens
agatggggacaggagctggtgagagatggttcatttgtggacactgctgaaggaagaggcaaagcaatgtgtctggaaatgagatttggaggaaaacagaatgaatcctacacatgtgtacagacccgca

SEQ ID NO: 22702 - DNA, 183 bp, Homo sapiens
atgagcatgttttatatgttaacatctgaactaagttgaagaacatactttttccacccaagagtctgtatctgattttatgtgtttcagtgtatgtcaagtggcatcttatttttcctttttaatgcataattcgaatggcttccaaatggcttaccatatagtgcttaagattatgattgt

SEQ ID NO: 22703 - DNA, 100 bp, Homo sapiens
ataatgaataaatggacttctttataccattttactttcatactttatttgaaacaaggtcttgctatgttgcccagctggccttgaactcctggccaaa

SEQ ID NO: 22704 - DNA, 203 bp, Homo sapiens
aattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccgg

SEQ ID NO: 22705 - DNA, 114 bp, Homo sapiens
actgggtgtggtggctcacacctgtaatcccaaagtgctgggatttgtatatttcttaataatgaaagcaagctgagaatcagatattttgaagtagctgttttgaggtggcca

SEQ ID NO: 22706 - DNA, 204 bp, Homo sapiens
tactgtttattgattctttgattatggccattcttacaggagtaaggtggtatcacactgtggttttgatttgcatttccctgatcattagtgatgttgcatttgatttgcatttccctgatcgttaatgattttttcatatgtttgttggccatttgcgtatcttcttttgagaattgtctatttatgtccttagcccacagt

SEQ ID NO: 22707 - DNA, 216 bp, Homo sapiens
ttgaaaataagcaatttataataaaatgtgtattaaaatatgtaaatacttgagcacactacattagatgtcacagtgaggtagtaaaatacttataccagcacataaaatcactgtgaatgtgatagctggacaagctgattgatacgtgatattggtgatgcagatgccaaagtggcattgacatgatttccaaaatggtaaacaactcttagt

SEQ ID NO: 22708 - DNA, 200 bp, Homo sapiens
  misc_feature 101: d=a or g or t
  misc_feature 127: w=a or t
ataaaactaaataaaatagagacaaaaatacaaaagattaacaaaatgaagcttgtctttttgaaaagataaagtcaacgaatcactagctggactaagadaaaagagggaagaaataaaatcagawacaaaaaaggagacattacaactgataccacagaaatgaaaaaagatcattagaaattattataaacaacaac

SEQ ID NO: 22709 - DNA, 131 bp, Homo sapiens
tatggtctctcttggagaatgttccaagtgctgataaaaacaatgtatattctgcagtttttgggtagaatgttctgtaaatgtctgttaaggccatttgttctagtgtatagtgtagatccattgtttct

SEQ ID NO: 22710 - DNA, 389 bp, Homo sapiens
tgattgatcatgggttaaaaagagagaatattgaaatagatgttttaatacaggctggaaatcaactattcaacactatcattgatttagtatacaagaaatcatatggattaactgaacttaatagtactcaagtaggatatgcaaaatttatattttacataatctgtgaacgtttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgc

SEQ ID NO: 22711 - DNA, 275 bp, Homo sapiens
gttttccataatagctgtactaatttacattcccgctaacagtgtgcaaggctttctttttctccacatccttgccaacactagtatcttttgtttttgtgctaatagccattgttaacaagtatgcagtgatagctgattgtggctttaatttgcatttccctgatgattaattatgttaagcattttattatataactcttgtctctttgatatgggagaaaatatttgcaaaccatacatctgataaggggttaatatccaaaataccggga

SEQ ID NO: 22712 - DNA, 360 bp, Homo sapiens
  misc_feature 270: r=a or g
  misc_feature 275: r=a or g
  misc_feature 279: r=a or g
  misc_feature 323: k=g or t
  misc_feature 355: s=g or c
aaatctaaaattcatacggaaccaaaatagagcccacatagccaaacaagactaagcaaaaattacaaatctggaggcatcatattacctgatttcaaactatactataaggccatagtcaccaaaacaacgtggtactggtataaaaataggcacgtagggccaggcgtggtggctcacgcctgtgatcccagcactttgggaggccgaggagggtggatcacgaggtcaggagatcgagaccatggtgaaaccccgtctctaccagaratacraaarattggccgggcgcggtggtgggcgcatgtagtcccagctgctckggaggctgaggcgggagaactgcgcccaccascgcgc

SEQ ID NO: 22713 - DNA, 114 bp, Homo sapiens
tgtatagttataaaactcattgcgacctaattgatgaaataggtagagtgacgatttccacttgatgaacgttgcacatgaactatcacacgtcgaaacagcagaaactttttt

SEQ ID NO: 22714 - DNA, 103 bp, Homo sapiens
ctacaatcaactatcccttgggactcctcctcagttttgcttaactctctcattctgcttcccttttttctgccctgatattcagtgcttttatacggccggt

SEQ ID NO: 22715 - DNA, 177 bp, Homo sapiens
atcaaacctagggcaccattcttaaccttgagccttacatttctgaggcttattacaatctggcctgctagatttttatatttgggtcacacacaggcagagtgtttctgacatttccagtcaactcccttacctcaaatatcatcaatttcaccactgaaaatgttccaacagcga

SEQ ID NO: 22716 - DNA, 215 bp, Homo sapiens
tcacttgaagctttggttggtggagattttccagctgagttgtcagttttaataaggttattgtttggggttttgttttctttcaaatggcttaagttggaggggaagtctagtaatttaattctaccatgtggtctggccatgaacccaaggcctgaggactggtgcctttctgctaattaattctcgatgtcagacatctggaaacccgccta

SEQ ID NO: 22717 - DNA, 249 bp, Homo sapiens
  misc_feature 229: b=c or g or t
ctttcacttaattcattgtgagtctcagcatgcaggttttctggcattatggcatctatcccatttatagtgaaactataattttggctctcttctgtatttacccaccaaacaaggaagtagaataaaagtgtcccagcctcagcctcttgttttctaatgtgttgttttgtttctcctgttttgtaatggttgactttgcttagtggtctgtttcttcaaaccagcbattgcacatctgaatgccct

SEQ ID NO: 22718 - DNA, 122 bp, Homo sapiens
attattatattgttttataaatggaggtacaggatatcacctgaattattaatgaatgcccaggaagtaattttcttctcattcttctaaaactactgcctttcaaagtgcacacacacgct

SEQ ID NO: 22719 - DNA, 192 bp, Homo sapiens
  misc_feature 66: k=g or t
gtgtttttgaaactcgtgattaaaatggtcaatataaatatgtctaactgtattctaacaccagtktggcatagatgataactgtattaactagaatattaggtaatttaaaattccccagtcatgtggacaaaagaaagtttggttggcttgtttgcctttataaaaatatttaagttagttaggccaggt

SEQ ID NO: 22720 - DNA, 239 bp, Homo sapiens
  misc_feature 81: r=a or g
aaaaggctatcttcagtagccacatacatctgtattcttattacctaatttgtagcacgtggtggagcagcccaggcagtrttgaaggttaatctcagcattagtgtggcatcagtaattcattctgtagagctggatcttccactcaggtttaatgcatcagacaatcagttccagtcacaataaggtggcatgtagaggtatctggacaaaaagaataatttctttatgaggggcga

SEQ ID NO: 22721 - DNA, 364 bp, Homo sapiens
  misc_feature 274: w=a or t
  misc_feature 275: b=c or g or t
  misc_feature 307: b=c or g or t
cacagccaagaggagcctaagaagacattactactaaatgtcacatggtgtcatggatgggatcttcggacagaaaaaggaaattgggccgggcacggtggctcacacctataatcccatcactttgggaggctgaggtgggtggatcacctgaggtcgggagttcaagaccagcctgaccaacatggagaaacccccgtctctgctaaaaatacaaaattggccggggtggtggcgcatgcctgtaatcccagctactcgggaggctgaggcwbgagaatcccttgaaccggggagacggaggttbcagtgagccaagattgcgccattgcactccagcctgggcaacaagagtgaactctgt

SEQ ID NO: 22722 - DNA, 94 bp, Homo sapiens
aattttataggaccccatgagtttatattatggagactacggtgatcttaggaatgcttgcctcaaaacagaacaatttttattaacacaacaa

SEQ ID NO: 22723 - DNA, 188 bp, Homo sapiens
tcccaccaagagcgcctggatccatccgacagccgcggtgcgtggtcgtgcggcaagtgagcgatttggtgaacagacactcccttctgtagccatggattgttacagaacttcactaagcagttcctggatttaccccactgtgatcctctgcttatttggtttttttctccatgatgagaccccgt

SEQ ID NO: 22724 - DNA, 111 bp, Homo sapiens
ccttataaaaagaactctgtttttcttatataaagacatttgatcatttaaatttttaactttaaaaatcttaaaagttttattttcaagctttattgagtttgtttttct

SEQ ID NO: 22725 - DNA, 287 bp, Homo sapiens
  misc_feature 82: r=a or g
  misc_feature 183: k=g or t
tattacaaaagcatcatgaaggatttcagatgggtatggtttcaaattccctctctttatagttattttatatttgtatgaragaccagttttggatggtctttgaatataggggggaaagattagcagtaatttcactacatcccttttctctgactttcatgcatttctcatacatcttckttctgatgcttgactttatttgcttcctagcaatagtctgcatttaaagaaaggtgtgttcaattcatcagcttgaaattgactatttcatttttccaggatat

SEQ ID NO: 22726 - DNA, 125 bp, Homo sapiens
gacttcttcaagaaacagacaaagaatgacccatttacctcggatccattcacgaaaaacccttccttaccttcgaagctcgacccctttgaatccagtgatcccttttcatcctccagtgtctt

SEQ ID NO: 22727 - DNA, 228 bp, Homo sapiens
  misc_feature 56: m=a or c
  misc_feature 132: k=g or t
  misc_feature 153: k=g or t
  misc_feature 209: r=a or g
ttttgtacattagatgcattatatactgtgttattacagtaaagtaagctagagamaagaacatgttattaagaaaatcttggctgggtgtggtggctcacacctgtaatcccagcactttgggaggctgakgcgggcggatcacgaggtcakgagatcgagaccatcctggctaacaccgtgaaaccccgtctctactaaaaatacaraaaattagctggacgtggt

SEQ ID NO: 22728 - DNA, 176 bp, Homo sapiens
cagagtctaaaagaaatcctggacaaggatcaacccaatttatgtgagtgtaacactggcattatgttgaatgaccaagttatccattatgaaacacagaggaaatagaacataatgcatgtgttcttggccaggcacagtggcttacacctaaaatttcagcactttgggagtgc

SEQ ID NO: 22729 - DNA, 293 bp, Homo sapiens
atctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgct

SEQ ID NO: 22730 - DNA, 401 bp, Homo sapiens
ttttgtgaacgtaggctttcatttctcttgggtcattccccaggagtgaaatttctgggatgtctgataaatttatgtttaactttataagatactgcctgacctttttccgaagtggttgtaacagtttacactctaggactgtttttgattaatctgggttaggagagacacatttatgtgactcatcgaaacaggaccttgtatctttgccttgcagaggaagaaattgaggggaagaagggtggcatcacttgttcaaggtcatccaactggtaggtggcagagctgggatcctgtttgactcaaagccccaggggggttcctgttgtggtgcacagcttcttgctgctttttgcagaggagtgaagcaggcagaaaacagatgactgacttctcaa

SEQ ID NO: 22731 - DNA, 208 bp, Homo sapiens
cagtgtgtatagaaaaacatcaggtgtagaagactttctactaagggtttacaatcttagaaaaactagaaagcgaatacaatctgatctctaaaacactagaaggttggctatcttaatatcagtgggatgagactggatttttcctccctggctattggagaaaaaaaaaggggaaaaatagttatatcaatcctagaagccagag

SEQ ID NO: 22732 - DNA, 192 bp, Homo sapiens
tatatacaaagtgaggaacaagacaatatgtacaaggactcatattaacatatgcaggatgaaaggggaaaaagaggtcagttaattggttttaaaaaaaagatgaaataagacaggctcaaggaaaacggaaagggggcaaaattgcgggaagtgtttggcctgtggtttcaaatgttatagacagaccag

SEQ ID NO: 22733 - DNA, 252 bp, Homo sapiens
tttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtattttttttttactgtgagttatggcaaaaaaagttttgaaagccgcag

SEQ ID NO: 22734 - DNA, 245 bp, Homo sapiens
cgtattaattataagcttatatggcaatctccatgcatccatgagcccataattctatcaattttaggtttatttacaataggctacccagacagaccaagcacatcctgcttacattgccaatctaagattggcaaaagatcaaattgtcaaatcatatttacgtaaattatagattgtacccagtaccaaatttactagtgcttgaaaggacacaggtgttagcaaaacacagaccaagcacg

SEQ ID NO: 22735 - DNA, 126 bp, Homo sapiens
attttaaaacagtattaaaatgttgaataaatttgacagcagtgctgcttctcatcatttcaaatgccaacactttctaggtcccttttctagcaaccatttcccaacatacctacgcgccccaag

SEQ ID NO: 22736 - DNA, 424 bp, Homo sapiens
tgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcgg

SEQ ID NO: 22737 - DNA, 238 bp, Homo sapiens
taacatatcttttatacagtttagccagaaaactttcagttctttgaacagctatctaatgtttcagtttagtatactcttaatcatttaaagttaaactctatagaagcgaacttttcagagcaatagcaagaaataagtgaggaaaaggcctgggatggagtgaagtttctgaaaacttcacactgaggtggttgaatcacctgattttgagaccatcccgaccaacatggagaaa

SEQ ID NO: 22738 - DNA, 432 bp, Homo sapiens
  misc_feature 273: k=g or t
  misc_feature 313: w=a or t
  misc_feature 366: k=g or t
  misc_feature 394: w=a or t
  misc_feature 395: n=a, g, c or t
acaatcagacataatgcagagttaagtagtatttgcttaaaattcaagttgtgactaatgatcaaatactaggcttgtacgaaattctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagckaatggtcatgcactgcttaatgctggtcctgaatcatgtwctcatgttagaccaacagctctccaattgtcattttttttctgcagagttttktttttccacttttaaattaaatgcatgwngtggaaaaacagtcttttaaaatgaaatttcagattc

SEQ ID NO: 22739 - DNA, 227 bp, Homo sapiens
  misc_feature 28: r=a or g
  misc_feature 29: s=g or c
  misc_feature 67: y=c or t
cgcaatgctcatgctacttcacttgttrsaagaacatattattctgtcctatagatgtactgcagtyatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccccg

SEQ ID NO: 22740 - DNA, 161 bp, Homo sapiens
  misc_feature 11: d=a or g or t
  misc_feature 12: w=a or t
  misc_feature 23: k=g or t
  misc_feature 157: m=a or c
ttttttttctdwctttttttgakacagagtctggctctgtcaacccaggctggagtgcaatggaacgatctcagctcactgcaatttccacctcccaggttcaagtgattctcatgcctcagcctcccgagtgactgggattgcaggcacgtgccamcact

SEQ ID NO: 22741 - DNA, 273 bp, Homo sapiens
  misc_feature 10: d=a or g or t
  misc_feature 11: w=a or t
  misc_feature 12: r=a or g
  misc_feature 13: s=g or c
  misc_feature 56: w=a or t
  misc_feature 61: r=a or g
  misc_feature 72: r=a or g
  misc_feature 84: k=g or t
  misc_feature 89: r=a or g
  misc_feature 172: s=g or c
  misc_feature 176: d=a or g or t
tttgattgtdwrsatccagatctccaatccagctgaaatttattttagagtatgtwgtgargtagggatcaractttatatgtkttcaraatggataacaaattggcccaattccttgctgatttgaaatggcacttgtatcaaataataaattcacaggtacacgtgagtstgtdtcatgcatcaagtgcctctttcttagccagtaacaccaagtgctaattaccattgctttgtagtatgctttgctaattttagttgaatcccagcgat

SEQ ID NO: 22742 - DNA, 150 bp, Homo sapiens
  misc_feature 70: r=a or g
  misc_feature 71: n=a, g, c or t
cgtattttcccaatccatataaccaggagaaagttctgccaaggctcccttatggtgctggaagatctarnatcgaaccagcttcccaaagctgcctggattccacatgttgaaaacagacagctttgggaagctggttctatcaagaat

SEQ ID NO: 22743 - DNA, 127 bp, Homo sapiens
gttgcccaggctggagtgcagtggcgcggtcttggctcactgcaacctctgcctcgtgggttcaagtgattttcctgcctcagactcccaagtagctgggattacacgtgtctcccctcgccgcgcc

SEQ ID NO: 22744 - DNA, 301 bp, Homo sapiens
gtttacagtaattaacttacttgtacatttagaacatgttttcgttaaaaatgttcttgaagtcaagtggaaagggacaaactttgtgtttgtctggggatggaggctacgtgcagcagaggctgtgctgataacagctttaagcctctccctttgttttctgattgtatcgtttatattcgcctgctctggagtccttgttttccctttaaggcatgtagctgttcattcagcctcctcttgtggcagttcgaagtgctcagagttttctctgttccaaaggcggtgtaagaaaagggac

SEQ ID NO: 22745 - DNA, 126 bp, Homo sapiens
aacgtcagcgcgggagagagagagagaggagccgactcggcagggactgggggaccgggccgagagtgcgagcgagcgagggagggagtgagggagcgtgcgagccagaaggggaaaggcggccac

SEQ ID NO: 22746 - DNA, 108 bp, Homo sapiens
gagaggttccggggctgggctggcctgactgaaggcggcggaatggagacgcggaccgaggacgggggcctcacccgccgccccacgctggcctcttcttgggatgtt

SEQ ID NO: 22747 - DNA, 257 bp, Homo sapiens
ctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagccagca

SEQ ID NO: 22748 - DNA, 184 bp, Homo sapiens
  misc_feature 19: r=a or g
  misc_feature 24: k=g or t
  misc_feature 36: k=g or t
  misc_feature 154: k=g or t
  misc_feature 160: k=g or t
atacaaaagaaatgggatrtccakggaacatctgtkttagatctgatttcccaatctggattattaaaatgaggaggctattttttcccagtatataaatgattctaatactttttgctgtaaaacttttggagtctctctgctaaattatgtkccagtktcgtagcttgggattcaagtcata

SEQ ID NO: 22749 - DNA, 262 bp, Homo sapiens
  misc_feature 48: k=g or t
  misc_feature 248: m=a or c
ataacaagaccccttttttcaaaaagattttttttttttaagattttkgtttttaattagctgggtgtggtggagtgcacctgtggtcccggctgcttgggggactggggcgggaggatggcttgagcccatgcggtgagctatgagtgcgccactgcgctccagcctgggccaagcagcgggaccctgtctcaaaaaagaaaagaaaagaaaagagaaactggacaggctgagagatacagtcctamaatctctgcccata

SEQ ID NO: 22750 - DNA, 191 bp, Homo sapiens
aaccccaggactgctactctcagcccctcctgtatgttgcagaactgtagtgaagacaggaacacgggggccataagaaatggaagaaggcctttgctgtgcattcctgctgcccaagcactgttcagaggaacagacaaaggatgaaatcaacccatgcttcacagaaaggcaaacagaagtgcggaccc

SEQ ID NO: 22751 - DNA, 154 bp, Homo sapiens
atgccatgcccgtgtcaactgaccatgggttcttgggctctcaatgcaatagaacattgacatgaggccaaaagagttttctcaaagcttcactggagcttttgtccagccataagggaggcagaacgagagagaaagagagatagagagaggc

SEQ ID NO: 22752 - DNA, 136 bp, Homo sapiens
agttttagggtacatgtgcacaatgtgcaggttagttacatatgtatacatgtgccatgctggtgtgctgcacccattaactcgtcatttagcattaggtatatctcctaatgctatcccttcccccgccccccac

SEQ ID NO: 22753 - DNA, 391 bp, Homo sapiens
  misc_feature 314: k=g or t
  misc_feature 362: k=g or t
aataaagaatagtttggaagttaacattaagtctgtatcttcagtttattacttcagaaatgtttttcttactgcaatttcaaggctagacctcgtgtagggaaatctttttgtatcctggaagcaatttttttgatttgtgaagtgttttattgcctctcttttcctttaaatctttattgtctaaacgattgcactgaagtagactgtcattttaaaattgtagggatttacttgtggtcgagtaatccattgccttttatagtttcatttttccaaagggtctttggacgactagttttgagttgaaaackatatgaagacaaataatttaataccacaaagaagtgaggatccttttktctagtgtgtactgaaaacagctctttta

SEQ ID NO: 22754 - DNA, 412 bp, Homo sapiens
  misc_feature 283: d=a or g or t
  misc_feature 314: k=g or t
  misc_feature 340: k=g or t
  misc_feature 350: w=a or t
  misc_feature 353: k=g or t
  misc_feature 369: k=g or t
  misc_feature 374: k=g or t
  misc_feature 377: k=g or t
  misc_feature 380: k=g or t
  misc_feature 386: k=g or t
aatcttttgacatttattaagacttgttttatggcctcaaatatagtctatactggtaaacattctatgtgccaattgaaaacaaaatgtatttttaaattgttgggtaatgtgttgaaatcttctacgcatttgcggatttttgtctaatttttctaatagttgctgttaaagcatattgcagtctttagattatggaattccttttccctttaaatctgtcattttttgcttcatgtgtttggaagctctgttactgggttcatatacatttatgattgtdacgttttcctgttgaataccccttttatttktatgaagtgtcttttttatccttgtkaatatatttwgckttgaaatgtatttgakctgakatkaakattgckactccagactaccttcacatgctgtt

SEQ ID NO: 22755 - DNA, 96 bp, Homo sapiens
  misc_feature 15: n=a, g, c or t
acttccggcgtacantggcggctaacgctactaccaacccgtcgcagctgctgccgttagtaatcgccgtcctttggggagcaggaacagggaggc

SEQ ID NO: 22756 - DNA, 98 bp, Homo sapiens
  misc_feature 20: s=g or c
agacaacagcgaggcggcasgggcgctgatcttcgctcgccagccactcgcaattgcggttacagacctgcagctccccctcccccagcaggcccgcc

SEQ ID NO: 22757 - DNA, 354 bp, Homo sapiens
aatatcttttcaaggatgtttaacaagtgactagtcttggaaaacaatctctgtctctggattacagggcagatttacttactgtccaacataataaaaataatctcccttcgaggcaaagggcagatcttcttgtagcccattataaaagatatgggttccataagtgctagggatgccacatgcagcatctgcatgggatcctttatgtcatacctgtgagtcttggggagaaagagaactgacttaaacaggatattcatgctgcttgctgtatgatgaataataaactcctctgtctctaatctgggaatcttgtgtcttttgccaggatctgtgaaatatggtagacta

SEQ ID NO: 22758 - DNA, 147 bp, Homo sapiens
agagaccgagcgagtcgccagctgcccctggcctggcgggggcggaaccgcgcgggatccccacccccacccggaatcctcgccacggagaatccctggagaagccccggatccccggctgggaggaggaagtgctcgttgaccccc

SEQ ID NO: 22759 - DNA, 304 bp, Homo sapiens
cctaaatcctcttccagtctgtccatccctcactaccatgatagtctacattctgataagctgaggccactgccaagggagggagaaatggtcactttctggtggtggttaatgctttgttagatagcttcatccagtcaatagttgaaaagttttcacataatccagtattggcatcagagccagaaatgccctccctaggtccaggaccaaagataaaacaaacacgaggaacatgtagcgtctacacaggaaagtaaagaattatagaattaactaattctacttgaaatcaggagtttta

SEQ ID NO: 22760 - DNA, 157 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaacaaaagacaaaaaaaaa

SEQ ID NO: 22761 - DNA, 451 bp, Homo sapiens
  misc_feature 236: y=c or t
  misc_feature 278: y=c or t
  misc_feature 288: r=a or g
  misc_feature 290: d=a or g or t
  misc_feature 314: r=a or g
  misc_feature 315: s=g or c
  misc_feature 336: y=c or t
tactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttycgtttgttttagtgactaattcaggatgaaagtttttttgtycttgtatttradcccttttttataagcagctgaagrsaccatatttaacactatatcycagtgatagggaaatagctgcattgatcttacatgagcataatcatccttatacttcatgaggggattattagtacaatccccattttactgtgtttgagttaaaaaccaaacat

SEQ ID NO: 22762 - DNA, 173 bp, Homo sapiens
gacttacagggagggagaacatggctgctggcttttagcacctggtgggtttcgcgccttgcaactcgacaactgccgggacggagtctggctgcccgaccccctgcggcaggtgctgggcgaggcgcctcccctgcaactagcctgccgcttcccttccggcacccccgcac

SEQ ID NO: 22763 - DNA, 236 bp, Homo sapiens
tttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaagc

SEQ ID NO: 22764 - DNA, 156 bp, Homo sapiens
gaatggggagggcggctggggtgagaattgcctcccgggcaggcttgagtggaaataactgagttgtttccattacttccatttccttgccaccaccacccgcctgacctccgcagtgttaaaagagataaattcttgcagaaaacagggaatccc

SEQ ID NO: 22765 - DNA, 225 bp, Homo sapiens
agtatgacagtgaaaaaaaatcaaaacttaaatttcctgttgaatgcaatttgaaaatatagccaatgattccacttttcttctctagtaaggttggacattctgatctacttggtgttttattatagaactcctagtgtgcctgagagttacattgtaaagatacttttttaaaacttgagatataagaggatgtaaatggttttgtatgagatcaggctggat

SEQ ID NO: 22766 - DNA, 160 bp, Homo sapiens
ctctggaatttttgattttctgtttttcatcactttgggaatgggtgagtttgtaaagagagaatctggtgtgtgtgttcaggaaggaggggtgggagctacatgcattcacatccacagttagaactatatcctttactataatacacatgcacaccca

SEQ ID NO: 22767 - DNA, 249 bp, Homo sapiens
atttttcctctccagaatcactggggtgggtagtgggagtcttgtggcattaacctgataagtagtatgtcttgtgctcaatccctagcacctagtatgtaggcactaaataaatagcttatggttgtgtggtttgcatggattgaaatgaaatagattaaaaagttcttagaagcagagagtatcagagtatcacgctctggttattttcctaggaacacagacagacctatgggaacacacgggtaa

SEQ ID NO: 22768 - DNA, 156 bp, Homo sapiens
gacatcacaggtgatatgaatttttttagctccatagtaatcttatgggactactgtcataaatgtccattgttgaccaaacgttggacatactgcatgactatactgcaaataaaaaaagtggaaatggaataagaaagataaactataagcccc

SEQ ID NO: 22769 - DNA, 310 bp, Homo sapiens
taaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgctc

SEQ ID NO: 22770 - DNA, 201 bp, Homo sapiens
  misc_feature 7: n=a, g, c or t
  misc_feature 159: d=a or g or t
aattgtntgccctttatttccttctcctgcctaatttccctggccagaacttccaacactatgttgaataggagtggtgagagagggcatccctgtcttgtgcccattttcaaagggaatgcttccagtttttcccattcagtatgatattggctgtadgtttgtcatagaaagctcttattattttgagatacgcccctt

SEQ ID NO: 22771 - DNA, 189 bp, Homo sapiens
  misc_feature 92: n=a, g, c or t
aaagtttgatctgaacaagcctgtgcgggtttgcaacatttgttttgatgtactgactctgggtggggtttcttagtgagccccccggaggntccaggccacgtccttggtcacctccccagcagctgctctgctcaccagcctgaccccacccagagcaggagctggcgggtgtcttcctgcggctaa

SEQ ID NO: 22772 - DNA, 344 bp, Homo sapiens
  misc_feature 159: b=c or g or t
atgagggtcttcaggggaggagggagaaggtcagagggtgaccttcctacttctgcagttttctcgatttctttcagtttacagtactcagtaggacaaggtgcatatttggggatatcgtgttctgagccccaacagtaacaaagaacaaagaaagcbtttaggcagtttttgctgagactctcaaataggaatttagagtgatggtccttgagtcagagaggccactagagaaagtttgactttccatgtagaatagcaagctctcctctggcaagtcttttccagacaaggctctataattttttgctaataaatgtgtggacaaagttatgggatgtata

SEQ ID NO: 22773 - DNA, 176 bp, Homo sapiens
  misc_feature 115: k=g or t
aaaattacccagagttgcacatgttttatgaatttagtgcagctgttatggctcacctcagaacaaaagagaattgaaccaaatttgggagtttggggttttatgttttgttttkcttttctaaaatgaagtgagattgttcacacacacacacacacacacacacacacacaaac

SEQ ID NO: 22774 - DNA, 379 bp, Homo sapiens
atagggcaggttctccgcccagcctcacttatcgccattgcgcatgcaccacagtaagttctgctcccatgggctttgaccccacgcctcacctcgcgtccactgctaagacttgctgccacaccgcggccattccccggcctcctcctctggcgtgtccgcccgcggcagcctgcaggacaagggcctggaatgtgagcgtcccgagcgaagggatctagttccgtcccttccaccaggcgaccattgccatagacatcgagtccctccgcgccggagatgtcacgaactcccacccgggtgttaccatggtcatcaccccagccctgcccttcctgggcagcgccgggtgacacacagcgattcagaacagacacaa

SEQ ID NO: 22775 - DNA, 216 bp, Homo sapiens
ttatgtatctgtgtgtctgtctgtatctgagttgatacattgtgctgtatgctttttacattatatcatttggatctcacaacaaccctttaagatagatattattgttattctttaaaactttcaagaaattattatcaagtacataagttatttgctcattagaagagttcaaacagtacaaatatgtttaagtagaaaaaagtatcctttaat

SEQ ID NO: 22776 - DNA, 224 bp, Homo sapiens
  misc_feature 149: w=a or t
atcagggaagagctcggtcttcagaggaattacctctgagagctggaagagggtgttcctggtaacttggggcttctctgtcagtctccccacggaaaccacagtcagagctgtgctctgtagaaagcctgcagtggctgctccctcgwgctgttctgctctcgactctcactcactgtggatagtgggctggtggagtgcgggcgccagagggtagggatgct

SEQ ID NO: 22777 - DNA, 253 bp, Homo sapiens
ctgcaggcgcccgccacttcacccggctaatttttttgtatttttagtgaaaccctgtctgtactgaaaacagaaaaacaaaaaattagctgggcgtggtggcgggcgcctgtaatcccagctactcgggaggctgaggcaggagaatcgcttgaacccgggagacggagcttgcagtgagccgagatcgcgccactgcgctccagcctgagtgacggagtgagactcccatctcagaaaaaaaaaaaaaaaa

SEQ ID NO: 22778 - DNA, 187 bp, Homo sapiens
ttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtc

SEQ ID NO: 22779 - DNA, 237 bp, Homo sapiens
caaatgtattctagattgtattattttctgagtattttgttacagatccttcacgtatatatgcgaacttaaagtaaacaaatctaaggaactagaaaaacacaggcttgtctctgtgcaaggtctttaaaattatcaatgtgattataatgaatgaataacatatagcccttcgaagggataaggtaaacaccaagattggaaaggcagacataaaactttattcacaggtgactt

SEQ ID NO: 22780 - DNA, 245 bp, Homo sapiens
agacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccaggtctcggaagctccagggggaggggacggcct

SEQ ID NO: 22781 - DNA, 167 bp, Homo sapiens
aaaaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgactgc

SEQ ID NO: 22782 - DNA, 200 bp, Homo sapiens
taaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagcact

SEQ ID NO: 22783 - DNA, 364 bp, Homo sapiens
  misc_feature 321: r=a or g
  misc_feature 322: s=g or c
cactcaactggggtaagtgggtaagtttggacctttcaaaggtagtgtttcataatcacaacaaatctcatggataatgaaccttatcaaggttttccataaacaattcttttctggtaccttcctaagcatttcactatgtgtagaaaatcagtgtgatttaataagctgcggattcagtatcctgaaaagaacttcctaatgtcccccttctaaagtaaaaaaatcttaagccccaaaggaatctggtcattgtttattcattactcattcatgaattatgttatcttaatgaacatgaaagcatgccctagtcataarsacacacacacacacatccttaaagatgaatattattaactta

SEQ ID NO: 22784 - DNA, 177 bp, Homo sapiens
gatatttttgtctggttttgaaatcaggataaaattggcttcataaaatgagttgggaagtgtttccttttctatagtttctgaaagggtttgtgtagaattgataacgattccttgattttttgataaattcaccattgaagccattagagcctggaggttctttttttgggggaa

SEQ ID NO: 22785 - DNA, 446 bp, Homo sapiens
  misc_feature 410: r=a or g
aagacaattatttctatcttcagtttaataaactttgtgttaagaaaattacaaaccgcagagttagaatctgaaaacaattaaatgtgagtagatggatttggagggtagagtttgtttaagtaggcatttctgtgccaaattactctgcatacttttctaattgaaatgatctttgtatatggggaaatctgaaaggctgagagctaagtcactttctacaagtcctttaatatttatttacctagaaatatttcagcagttgtagtttaggggaaagaagttttgggtggcgtagactaacactgatttcacacatatatgcattgccccaataactaagctattttgctcagagtgaaaacattctacattttctaccatatgtaatttctaggaatctgaataarataatgtgtcttgtctcttgatctctctttttaaat

SEQ ID NO: 22786 - DNA, 352 bp, Homo sapiens
tcattgctctttgtcatctctctcttatggcatttctgacattctgccatgactttcgattatttctcttcctgtttcaaacctctgaaaatataaagtcatctgccaggtgcagtggctcgcgcctgtaatcacagcactttcggaggccggggcgggctgatcacctgaggtcgggagtttgagacagacctggacagcatggtgaaaccccgcctctactaaaaatgcaaaaattaggcgggcgtggtggcgggcgcctgtggccacggccgctcgggaggctgaggcgggagaatcgcttgaacctggggggcggaggttgcattgagctgagattgcgtgcgccatt

SEQ ID NO: 22787 - DNA, 134 bp, Homo sapiens
tcccttttaactgctaagtccagttgattattcctcctaaatattcctctaatcaagtggttttcaaactttggtatgcatcagaatcatccagagggcctgtgaaacacccattgttatggctcacccgctgc

SEQ ID NO: 22788 - DNA, 314 bp, Homo sapiens
taaaggaaaattacagtcaaaggggggttgttctctggcgggcagggggggcggtcacaaggtgctcagtaggggagcttttgagccaggatgagccaggagaaggaatttcacaagataatgtcatcagttaaggcaggaacaggccactttcatttcttttgtggtggaatgtcatcagttaaggcaggaaccggccatctggatgtgtacatgcaggtcacaggggatatgatggcttagcttgggctcagaggcctggcaagtataatgtggcatttctggaaatcagactccccaccccgaccccaagc

SEQ ID NO: 22789 - DNA, 97 bp, Homo sapiens
  misc_feature 11: n=a, g, c or t
taccggatgcngtcccacacgaggcgctggtgccactccatcgggagggcgaggtactgccgggtgacgccgcgcctcgtgtgggactgcatccggt

SEQ ID NO: 22790 - DNA, 399 bp, Homo sapiens
  misc_feature 167: r=a or g
  misc_feature 381: r=a or g
ttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagacaggacaacataagaraaaccctaccttctaaaccaaaccataactgatacagacattaggatgagcagattaagtacattaagacagttactataactgtagttcatatgttcaaaaagctatagaagtgtaattcaccatattgatcaactagaaaacaaagaaaaacaattcatatggttgtctcaataaatgtagaaaaagcggttgacaaaacccaacaattatraacatcttcagaagactt

SEQ ID NO: 22791 - DNA, 171 bp, Homo sapiens
  misc_feature 6: h=a or c or t
  misc_feature 7: n=a, g, c or t
  misc_feature 8: n=a, g, c or t
  misc_feature 9: n=a, g, c or t
  misc_feature 160: w=a or t
tgttthnnntacggcacataacatttgcgatagatttttttgtttgtttgtcaggcatactttattaggccaaggaatttgctttgttttctattttgtacctgacaattacagtgcttggtgtgattccttgtctttttccccttataactctccttcwaaggaggctca

SEQ ID NO: 22792 - DNA, 226 bp, Homo sapiens
ccatctaaaacagggaattggaaatgggaccaagagttattaatgatgataatgatgatgatgcctgcttaccaagcatctaccatatatcaggtactctagatctagtttattgtgttttatttcttttttttaaacaaagaagatactattcttaattgtatacaagaagcagctgagcttccagaaatgtaactttcccaatgatacataattgctaacttca

SEQ ID NO: 22793 - DNA, 410 bp, Homo sapiens
cagagaatgacgtgaaggagggcctacagcgatcccacattttatatgaccgggcaggtaagtaattcacctgtggaaagagtgaaaccatacggaaagaagtgtgtgcacacattctcatttccggaagcctgactgggttccggaagcattccagctgggtccagagcattccagtgattctcaggtggatctgcatgttggtattaagccttctacacagggctgacctttccgaagagaggcatgaagcagaagctgccctgttgagaatctagaggagttttggggttggaaatggcaggctgcacattcaccttagaaggtagttggctattccccaccttgcaggatacaatcacctttgaaagcctgtgcattcacttgacaatgaatatgttttgtgatca

SEQ ID NO: 22794 - DNA, 241 bp, Homo sapiens
ttccgtttacaacatacggtatttacctctcttcttacctcattctccttccctgaagtaactgcgtttatgtggaagcgtttaggttatatcaccctcatacagcttaaaactatctcggatatttacatctaaggacaataccagatgcattctgtccacctagaaatctctgtcgcctttctcctctccaattcataaaatgcaaaaattcctttagcatggaaaccagccattctca

SEQ ID NO: 22795 - DNA, 432 bp, Homo sapiens
  misc_feature 308: b=c or g or t
acatggttcttgatcactgagatcaaggtgaaaatagggttgtttcctcctgaaggccatgaccgggagtctcctccatgcctctctcctagcctgtggtagcttcagggtcttccttctgtatgtgtgtgtctgtgtccagatttctttctttaataaggacatcaatattgttagattagggcccactctttaatcatcttatttccaaacaaggtcatattcctaaatgctggaagttagtactttaatttctcttgtggggactgaattaaacccataacactaagactagagcaataaaaggbaaatggggcacaatggtggactaggaagctccaggcccttgttttcttagggaaacattccataagcaagtaagaccatctgaaagaacttcacatgtgctctgaaaaccaaagatgtacagca

SEQ ID NO: 22796 - DNA, 321 bp, Homo sapiens
tttgtttaaatctttaataaaggtactaattttctattgttgaataacatcacaaaaattaatacttaaaacaatgtccgtttttatcagttcagttttgtaaatcagaaatccagcacaatgtggcaggattctcttctaagattatcatattggctaaaatgtagtttgccaggctaagttctatcagaggctctgtggaaaatccacttcaaagcttattcttatcgacaggtttcagttcctgtggttgtaggactaaggtttctgttttctggctggctgccaatcagggtctgttctcaggtgctagaagctaca

SEQ ID NO: 22797 - DNA, 191 bp, Homo sapiens
caataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactc

SEQ ID NO: 22798 - DNA, 347 bp, Homo sapiens
  misc_feature 308: v=a or c or g
cataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtagvgatatggggaaagggtgggaccagcaggaaaccagccgt

SEQ ID NO: 22799 - DNA, 51 bp, Homo sapiens
gacctttcagcttcgcgctagtgctgttttttttttttttttttttttttt

SEQ ID NO: 22800 - DNA, 373 bp, Homo sapiens
  misc_feature 334: k=g or t
tcaattaatgattagcttttagtatcctcaaggtctgatatcactcatgtatcccacattattatgatatatattttatgtatatatcagaatatatactatgtatcatgtatactacatattttataattatacatccctatgtatttagtgaaagtactattattctagtacactagagactaatcacactagttctttaacgtaaaagaacttaatagaacagaataaagtaggttcttatttctggagattgtgttcattcttttaaaatttaactgaactgttcagagacaattgtgagttcgttggccacattatttatttggcatakttgcttagatacaaaatgaacttaaaaagagcacccaca

SEQ ID NO: 22801 - DNA, 231 bp, Homo sapiens
aagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattacggtgcagc

SEQ ID NO: 22802 - DNA, 162 bp, Homo sapiens
ttaaattccaggtgccttataagcatcttcagattgttgctgggttgatagctatgaactgttttcttgaaacactgagacaaatagttttcatctgctgatgtacacttagaaatataactcaggagtctgtgcatctgcagagattttattcccacacag

SEQ ID NO: 22803 - DNA, 195 bp, Homo sapiens
  misc_feature 13: s=g or c
tacgcaggcgcasgctccgattcggcgcggctcatggtccggttcgggctcgcgagtctccgtctggggtagggcaggttcttagactctgtgagtaaagacagcttcatcttcccagttcatcatggcttcaacatccaggtaggagtgctgtttgatcaaatgttttattgaagaatttattcccctatgctg

SEQ ID NO: 22804 - DNA, 372 bp, Homo sapiens
cccagcactttggaaggccaaggtgggaagatcacctgaggtcaggagttccagagcatcctggccaacatggtgaaacccattctctactaaaaatacaaaaattagcagagtgtggtggcaggtgcctgtaatctcagcctcccaaatagctgggattgcaggcacgtgccaccatgcccagctaattttgtgtttttagtagagacagggtttctccatgttggtcaggctggtttcgaactcccatcctcaggtgatctgcccgcttcggcctcccaaagtgctgggattacgggcatgagccaccgtgcctggcctagtgctacacacttttaaacaaccaattctcatgagaactctatcaccagt

SEQ ID NO: 22805 - DNA, 172 bp, Homo sapiens
caaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggcata

SEQ ID NO: 22806 - DNA, 429 bp, Homo sapiens
  misc_feature 347: r=a or g
  misc_feature 348: n=a, g, c or t
  misc_feature 352: n=a, g, c or t
  misc_feature 356: n=a, g, c or t
  misc_feature 387: k=g or t
cccaggtaaaaacagtgtccacattttcttttagaatgtcatgtgtttagaattgcagtcatttacatttctacttctgatgcttttgcctaagaagattatttcaactacctttccccttttcttctcatgacagtgaaaggacttctttaaaataattctcccctatatatcagagacttgtctttattctctccatccaggcttcttacatatcacaaataatactcatcttgagtttatatgctgaaatattggaagtattccctatgttgacaggtcagcctgggcaggtgggaatataaaacattcttattggggatggtgctgggtcctcagatatcagrngggnaganaagtgcactgtttaggttccatctgaatgckccatcagctctatgaagaatataatttttaaatgcacacatt

SEQ ID NO: 22807 - DNA, 155 bp, Homo sapiens
tgtctttcttgtacattatgtatccccagtgcctagcacagagcatggtgcatcatgggccctccttttgcatttgagaagctaacaaatgatcaacttgcctagcctcatttcttcatttcctgccatctccttcatcccctcacggacccccc

SEQ ID NO: 22808 - DNA, 189 bp, Homo sapiens
  misc_feature 186: d=a or g or t
gattctgaatataatggagccagaagatcttgaagcttgtcagtggatcagtttccacagtgcctacacaacctgataatccattttctcaccctgacaaactcaaaaggatgagcaagtctgttccagcatttctccaagatgagagtgatgacagagaaacagatacagcatcagaaagcagtdaat

SEQ ID NO: 22809 - DNA, 418 bp, Homo sapiens
  misc_feature 122: s=g or c
  misc_feature 170: k=g or t
  misc_feature 265: m=a or c
  misc_feature 397: w=a or t
ttatagagtggttcttaacccatttcttcataggtggttggaagtccattagatctgtggaataaagtaatagagatgctgaaacgaacaataaagccaggatgttaaaatagattctagtsaaaacttaatattttgaaaatgtacatggtcctctgttcctctgagtkaagcaaggattcactttccaaccatggatcgtcacggatcatgatatcatacatcattatcactaccacctgcctggacaaggaaactgtgtgamaccactgattgttccagcagtgcagttggagtgctggctccatttcttgctctgcttcttactggcagtgtgacttggagcaagttacttagcctctctagcttcagtttcttccggggaactgaatggaawtaacagtatctaattgacaga

SEQ ID NO: 22810 - DNA, 323 bp, Homo sapiens
  misc_feature 11: k=g or t
  misc_feature 321: r=a or g
attttttttgkttctagggaacacagtaggagcaagggaagggcagaggggcttatttcatataagggcttcttgtcgcctgaactatggttgaagttccctcacagaacagagcagctggtcacagctctgcccaggcatttctgtgtctgcatcttcctgctgtacttgcatatcaagaagcatttcagaccacaggaatgcaggattccaaggcgccaatttaccttggaatttgaaaagatgatggaaatgatgttaaagaaaaagaaaattcgagtgattttcttatttgaggtcaaaatgggtcataaagcagtrtc

SEQ ID NO: 22811 - DNA, 128 bp, Homo sapiens
  misc_feature 10: k=g or t
  misc_feature 11: k=g or t
  misc_feature 27: k=g or t
  misc_feature 28: w=a or t
  misc_feature 33: k=g or t
attaaactgkkgtgggggatgggaggkwggttkctgtatgcctttgggcacgtcactcctcctcaggccctcaggttcacttctgtaactaaggcttcaggatgggtcattcagcaaccccagagcct

SEQ ID NO: 22812 - DNA, 151 bp, Homo sapiens
actcgctcgttcagagggaggagaaagtggcgagttccggatccctgcctagcgcggcccaacctttactccagagatcatggctgccgaggatgtggtggcgactggcgccgacccaagcgatctggagagcggcgggctgctgcatgag

SEQ ID NO: 22813 - DNA, 231 bp, Homo sapiens
atcaccttgacttttccccatcttcctattaaaaaaaattgttttaattctggatttatgttttctaattttcttttccagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaatgg

SEQ ID NO: 22814 - DNA, 316 bp, Homo sapiens
cacaggcacaatcatagcacactacaacctcaaactcttggcttcaagcagttctctcgcctcaaccttttgtgtagctgggactacaggtgcatgccaccacacccaactctaggaagtcattttgaattgagattgctcttgaggtattttggagcatgtcatttgttatatgcttttaaaaataatttaaagtgttataaggcaaattttaattaaacagtgtacattcagttatttaccttcaaagtgaaaagttcattgaaacagtgttcgtaagatgctggttcctgtctgatttattactgggtccgct

SEQ ID NO: 22815 - DNA, 137 bp, Homo sapiens
  misc_feature 112: s=g or c
acgtggaagcggcactcaagatggtaggagaatgagctcctgtttcggagctgcgccgcgaggcccgcctgcgccgcgagtacctgtaccgcaagcccgggaggaggcgcasgctcagcccaggagaggaaggaggg

SEQ ID NO: 22816 - DNA, 333 bp, Homo sapiens
actacaaacagctcaacaaaccagccaaacatctccctctgcccccacaaagaaccctttgcaaaccacgtgattctctagctacttctctcccactgttctcaaatttctgggctgagttgcctatagtttctctgtctatctttagtcactattccctccataaaccctcaaattcaacttctgtttcaacaactccatggaatcaactcttactaaagccaccaattattttcttaccacttaatcaactgtactcgagtagtcctcatatcatgccacctctcagaatcattctacaaagttgagcattccgtcttttgaaatactttt

SEQ ID NO: 22817 - DNA, 383 bp, Homo sapiens
  misc_feature 10: k=g or t
  misc_feature 286: k=g or t
  misc_feature 293: w=a or t
  misc_feature 297: y=c or t
  misc_feature 300: s=g or c
  misc_feature 303: k=g or t
  misc_feature 314: y=c or t
  misc_feature 317: b=c or g or t
  misc_feature 324: w=a or t
  misc_feature 328: k=g or t
  misc_feature 333: r=a or g
  misc_feature 344: k=g or t
  misc_feature 347: m=a or c
  misc_feature 351: w=a or t
  misc_feature 353: w=a or t
  misc_feature 357: d=a or g or t
  misc_feature 361: y=c or t
  misc_feature 363: b=c or g or t
  misc_feature 372: k=g or t
catcactgtkaaggctgtgattatgtttgatattcacctggattttaatacaagccaatatcagcttcccattgtgtaataacttgggtgtttaggagtcttttcacattttttggggatatgaactagatgttcaagaactccttctgaactgtggatactgaatcagtgtactattggctgcagaatttgtttcaattgaaaatagactcaggaagattgctgctcagaatatcatataatgtttattttttgaggtgtttttgtttttatttgtgtgtttttkttttttwaagycasctkggaactttttyccbggggagwattkgggaragggaaaggckgtmctawawattdattycbaaatgtttkgaccgggcata

SEQ ID NO: 22818 - DNA, 73 bp, Homo sapiens
  misc_feature 19: s=g or c
  misc_feature 20: s=g or c
gtccgcgcgggttctcgcssaagaaggggtgcgagcagcggcggcggcggaggctgccatggacgacgaggaa

SEQ ID NO: 22819 - DNA, 186 bp, Homo sapiens
aaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtt

SEQ ID NO: 22820 - DNA, 336 bp, Homo sapiens
acctcggcgccggctcggctctaggacgtgtcgggctgcacgggtcgggggcggctccctgctgcttccgagcctagccgcctggccttcggcatttgcaggcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggc

SEQ ID NO: 22821 - DNA, 170 bp, Homo sapiens
  misc_feature 9: n=a, g, c or t
  misc_feature 10: m=a or c
  misc_feature 11: d=a or g or t
  misc_feature 12: r=a or g
  misc_feature 46: w=a or t
ttcttgtgnmdrctgccttttcaaatacatttgagtcagtttattwatatggtgcaatcatagctcactgtagccttggactcctgggctcaggtgatcctcccacctcagtgtccgagtagctggaaccgcagtgtgtgccactacacctggctagatttttttaattt

SEQ ID NO: 22822 - DNA, 313 bp, Homo sapiens
ttctacctttactcatggtcaatcaattgtaaaccttacctggggccaacttgccaaaggttttacagttaacaaatggtatttgaaatttgtagtaagagtaaatgctttggagtaggaatgcctatctcagcaatcctgctaagcactatactctggataaggtaattaccttcttttgtagaaaagaactcgtgatataattcatataatataaagttcaccattttaaagtttagtgacttttagtatattcatagagttgtgcgaccattgccactattatagtttacaacactttcatcaccacaca

SEQ ID NO: 22823 - DNA, 373 bp, Homo sapiens
agtaattacccaaaggcgttgactccaaagaaaagctttgttttgtttttcctttccttttggaagaaattttctttggccaggtgaatttaattcaactcaaaggactttctcttaaaaaaagaaacagtaaggacgattttcatgtcttatgtttcttctaggtgctgcacttaagtgttatcaggaatagtaaatagtagagttgtattccttggtagaataagctgttatacttcactgtttcttttgagactagtcaccacctttacttactacacccttggggcgttttgtcacatagcattaacacatattagaaaattgtgtagtgtcaaagggataggaaccaccagcattcaagcaatgttgt

SEQ ID NO: 22824 - DNA, 274 bp, Homo sapiens
  misc_feature 222: k=g or t
  misc_feature 229: k=g or t
  misc_feature 239: w=a or t
  misc_feature 252: s=g or c
  misc_feature 254: r=a or g
  misc_feature 255: s=g or c
gtggaactcagaatcctataggccatgttaagtgatatctattctaggagcaatgggaagtgattacatatttttaaagcaggtatttcaagggtatgtttagtttgtaaagatccctctgtaagcatacagaagagttttcaataaggatggtaatatatctgtgtaagggtatagatatattaccatccttattgaaaactcttctgtatgcttacagakggatctktacaaactawacaccctcaccastrsaatcttcctaggaacatga

SEQ ID NO: 22825 - DNA, 271 bp, Homo sapiens
atcgagtctggacgccccgtgacccgcctgggccggagcgagggcggacggcgccttcttggccctttctgcctctagcagcggcgccggggtagccggagccagcgactgggaaacggctgcattccactgcgtctccttggcctggctgggcggtcggaggctggtctgccaagattactgtttggagaccgctgcagcccacgtccacctgatagactatttactacacatagtagattcagagccgctaaatgtccaagaccatgta

SEQ ID NO: 22826 - DNA, 144 bp, Homo sapiens
tagcatgagcttcagaattggacagtcttgggttcacataccaaagctatgttctttggcaaattaagaatcagttttctcatccataaaatataggtaggaaaagtttctagctactacacttgttgaggattaaaagaggcc

SEQ ID NO: 22827 - DNA, 179 bp, Homo sapiens
gtatcattgcttgtgttgaaagaatacaacaggatttaagtttctctttaaaaattgcactgaagaaaggccgggcgcggtggctccccctgtaatcccagcgctttgggaggccgaggcggggggatcacgaggtcaagagatcgagaccatcctggccaacatggtgaaaccccaca

SEQ ID NO: 22828 - DNA, 99 bp, Homo sapiens
ttggggaccttcaaatggggtctctgagtggatgtcctttttgttgatgttgatactattcctttctgtttgttagttttccttctaacagccaggccc

SEQ ID NO: 22829 - DNA, 149 bp, Homo sapiens
aaaaatatattttcaaattcactttctaattggccaaaagagatgagttccagtctgaatacaggtagatattaaagggctaataaaaaatgagaaaccggtcgtccaaggtggatgctgtcaatgcccgagtgacacatgagagcaac

SEQ ID NO: 22830 - DNA, 280 bp, Homo sapiens
aaatatccttgaacattattggggggaatgggaaatgttacagtcttcctaaaaaacaacctggtaatctccaataaaataaaaaatatatttatcctgttgcccaacgattctaatcctgagaagaagaagaaaaaaataccagttcataacaacatatatatgagaatattttctactgacataatttatagtagccaagaactagaaataaagtaatgcccacctatagaagaataaatacattatggtttaataccagatattgtccagccacact

SEQ ID NO: 22831 - DNA, 370 bp, Homo sapiens
attagtcttgttagtggtctatcaattttgctgatcttttcaacaaaccagctcctggattcattaattttttaaaggattttttgtgtctctatttccttcagttctgctctgatcttagctatttcttgccttctgttagcttttgaatgtgtttgctcttgcttttctagttcttttaattgtgatgttagggtgtcaattttagatctttcctgctttctcttgtggacatttagtgctagaaatttccctctacacactgctttgaatgtgtcccagagattctggtatgttgagtctttgttctcattggtttcaaagaacacctttatttctgccttcctttctttatttacccagtagtcga

SEQ ID NO: 22832 - DNA, 429 bp, Homo sapiens
  misc_feature 7: m=a or c
tgttaamaataccctacctcattatacgatcatggtagcatacatagatattttaaaaacaatgctggattttgttgctggtttaatagtgtctctctgcttatttaattttggcactgtattacatattatttaaagtaacttaaccaaactgctaggggagtagtactactactagagcattaacttgatgttaatactttccttgatgtctttcatttctgtttgatattctgtcatttattctgtgctacttctgtgaataaagtattcatatgatacttgcctgggaagcaataatagcttaatcattattgactaatgaataactgatgagctcaatgcaagagaaatatacttagtaatattcaacaaatgtttattgaatgcctactgggctgaagcaagatcaagtatactactaatttt

SEQ ID NO: 22833 - DNA, 114 bp, Homo sapiens
  misc_feature 10: r=a or g
tgtatttttrttagagacagggtttcaccatgttagccagggtggtcttgaactcctgacctcaggcagtctgcccgccttggcctcccaaagtgctgagattacaggcgtgta

SEQ ID NO: 22834 - DNA, 396 bp, Homo sapiens
  misc_feature 7: r=a or g
  misc_feature 8: r=a or g
acaaagrracaaaaagtacgggagaggatcagttcattctcctgactcctggttggtctcaagacctcccctgttgcctgtgctctggaagattccccatagtacctactaggtgggccagagaaggatggatttgtgggaccctggaaggcagcatatcgggggcggtttaagcagagaaatgataggatctgatgtatatttttaaaggatcattaagtctggtgtggtgaatagactcttgggggaagagggaacaaaggtgggcatagagagaccagttaggaggcactgagaggagggtatggtcagaaaatgagatgtttgatgattttggaagtaaagcagttacaagtgataacggtctgggacgtgtctcaggtatcaaggcagagc

SEQ ID NO: 22835 - DNA, 233 bp, Homo sapiens
  misc_feature 10: k=g or t
  misc_feature 31: d=a or g or t
agtttagtakggatatgttttagatcttgadtcaaacgaatatatgccattttaaatgaatttctactttaaacatttacattttacatttctgaaagtcatcacttcaagttatggtattagctgagttacaggatgtaaatagagagggtctgggtaatttatggatgagaggtttggcacattgacttaccaaacctctctttaacagtgttagtcagtttaccagccta

SEQ ID NO: 22836 - DNA, 418 bp, Homo sapiens
  misc_feature 9: w=a or t
  misc_feature 10: d=a or g or t
  misc_feature 11: d=a or g or t
  misc_feature 12: r=a or g
  misc_feature 33: k=g or t
  misc_feature 34: k=g or t
  misc_feature 329: d=a or g or t
  misc_feature 392: r=a or g
gaagtgttwddrggtttagagaaaaaaggtggkkggaaatggaagatgagaggatcctggacaacctgggggcagagggacttcatggctctgagtgggagtggagaagatggcattttggtggatgggtggaggaagagcataggcacagatggccacgtggagtgtggtccacagataagtcacctggtggagtgcagccacagtgcctgagtcaggaggtctcagctcgtgagtgtatcttagctcaacgatacactcaagatccttgagctaggagaaaccctataaaccacctaagtggatgccttctctttagagaggagaadgcttaggtcacagagaggctgtgacctcccccaagggtggtgcagaaagcggccatagcagtraaggggaaaggcctcgtggcgttggg

SEQ ID NO: 22837 - DNA, 235 bp, Homo sapiens
  misc_feature 11: n=a, g, c or t
  misc_feature 65: m=a or c
  misc_feature 82: w=a or t
  misc_feature 156: w=a or t
  misc_feature 164: w=a or t
  misc_feature 187: d=a or g or t
  misc_feature 193: w=a or t
tgaaacagatntggtaaatgttttccttagctccttcatgggcatgctggtgaaagaataaatamatccaattaaagctcawgctggggtcggggagaagaggatactgaaacatttgtgaaatgtatgaatgcacttctgtaaccagatacttcwgttcttcwgttcaaattgtggggtttttgtdacagtwaggacgcccatgaagatttaggggtgaaaaaaacagcagagc

SEQ ID NO: 22838 - DNA, 91 bp, Homo sapiens
  misc_feature 11: v=a or c or g
  misc_feature 31: k=g or t
  misc_feature 32: d=a or g or t
  misc_feature 33: k=g or t
acagccctggvtgcaggagtccagctgccgkdkccgccgccagcggacggggcggggatcctggtgccaggtcttcgttaacccgccccca

SEQ ID NO: 22839 - DNA, 106 bp, Homo sapiens
  misc_feature 33: k=g or t
tttgtctctgtctttacaacaggttcgggcgtktgggaagacgggggggtgcggggccgccccagcccgggctttcttggggccgccccccttctaccgggtgtat

SEQ ID NO: 22840 - DNA, 192 bp, Homo sapiens
actgaagtattagaaaatagaacctgggagtatgtgaaatggaaggcttgtctgacactagtagccaatagaagttgacctagattgtggtaatttttaatgatctaattgaaatattaatcatctaaatcaaaattggcaggcaagtcctcaaaaggtaccagctcacaattattttttgacctacccctc

SEQ ID NO: 22841 - DNA, 272 bp, Homo sapiens
  misc_feature 11: k=g or t
  misc_feature 33: k=g or t
ctatcattcgktggacatttgggttggttccakgtctttgctattgtgaataatgccgcaataaacatacgtgtgcctgtgtctttatagcagcaagatttatagtcctttgggtatatacccagtagtgggatggctgggtcaaatggtatttctagttctagatccctgaggaatcgccacactgacttccgcaatggttgaactagtttacagtcccaccaacagtgtaaaagtgttcctatttctccacatcctctccagcaccacca

SEQ ID NO: 22842 - DNA, 332 bp, Homo sapiens
  misc_feature 10: d=a or g or t
  misc_feature 11: k=g or t
  misc_feature 32: y=c or t
  misc_feature 319: y=c or t
tgatgacttdkcaaggttcccagggcctgacyaaaattttggcttctcttaatacaaagtggcacctggaattttagctctgtgtacattgatattgggccccaaatgggtttctgtgggatgcaaccccagaaagggtactctgatagtactggagaaggtttactgcttgtcctgtcatcgtagttcatgtttttttccccaaggccaaagattgggctgggattggggtggtagtgtatttgaatgatgctggagataaccaaagccaacagtctttgccagagctgggctggtggtatttaactgtctttgagtyaaatgtaaagtta

SEQ ID NO: 22843 - DNA, 81 bp, Homo sapiens
cctagactttgttttgcagtaatgtgtgccagttttataccctaaagccatctgagtccccttttcctttccctgtctctg

SEQ ID NO: 22844 - DNA, 202 bp, Homo sapiens
ttttgttctcctaaaccttatgtttacacacggtcctgccctctaccattttctcttctctggaaagcttccctgcccaagggatccgtccactccttcgtctccaaataccgacgggagctgatgactctcaaagctccacttcattcgagcttgccctcaatcctaaaaccatgtgtccaacagaccccacaaccccaac

SEQ ID NO: 22845 - DNA, 259 bp, Homo sapiens
acagatgatttttgataagagtgccaagaccattcagtagggaaagaacaatcttttcaacaaatggtgttgggaaaactggatatctacatgcaaaaaaatgaagttggaccttttccttacatcatatacaaaaattaactcaaaatagatcaaatacctaaacataagagctaaaactataaaactcttagaagacaacataggggataagcttcacaacattggatttggcagtggtttcttggatatgaccacc

SEQ ID NO: 22846 - DNA, 227 bp, Homo sapiens
  misc_feature 84: s=g or c
ttcctcccgccggggccccggatgcactgagcggctgcggcgcggcttccatcctcccgccctcctgacgcggccggagcgcascctgaggcccagggagaacgacacattggatacagaagggaggtgatcatgcaccatggcactggcccccagaacgtccagcatcagctgcagaggtccagggcctgccctggcagcgagggtgaggagcagccggccctttt

SEQ ID NO: 22847 - DNA, 384 bp, Homo sapiens
  misc_feature 10: k=g or t
  misc_feature 11: k=g or t
  misc_feature 276: b=c or g or t
ctaaggtctkkcatccttttggactgaaatattctccttctaactgagaagtatgtgaagagagaaagcattcattgcatattcatctgagcagctttctagaactgatccagtcagactagaaaaattctaccaagctcaaaaatcatcacacaaaaaacaaccacttagagtctctggaaactgtcctaacagaaaatgtttttgaaatggcattatattctgttggacctaattaaatccttttctctcttcgcatagtaaggacccatagtbcctccctggtgacacttcctacttcagctttctttcccttgttctcagttttaggtgcaccctacctcaagttcttactgcttctgctcgtgggactataacaacaca

SEQ ID NO: 22848 - DNA, 462 bp, Homo sapiens
cataggtatttatattaaatattgagactatatatttcaaaagttcagtttttttctttgttaagtaatgtagatattattcaaagttttcagcctggttgactagaatcttaattacattttcattaaattggtacaggaatgttagaggaaggttcagtttcattttgggaataaaatgttaggttaaaggtcacctactccacttcccacccaggtaaaaatccctgtaacacttattagatgtacttctaatctttacctaaacacttccatacttccaatgagagggagctcacatgtagcagccatttccacttctggatggtgcgacatgcttatcatcaactgaaatctgcctttctaatttatacttactatacttagtggccatcccattctctgtaaatgaatcttgtttttccacatgacagctcctcagatatttaaacaaacttatat

SEQ ID NO: 22849 - DNA, 151 bp, Homo sapiens
tcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatca

SEQ ID NO: 22850 - DNA, 385 bp, Homo sapiens
  misc_feature 272: k=g or t
atcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctttcgccttccaccatgattgtkaggcctccccagccacgtggaactgtgagtccattaaatctctttttctttataatttacgcatcttaggtatgtctttatcagcagcatgaaaatggactaatagaataaat

SEQ ID NO: 22851 - DNA, 205 bp, Homo sapiens
catttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagaccca

SEQ ID NO: 22852 - DNA, 258 bp, Homo sapiens
  misc_feature 93: k=g or t
  misc_feature 156: r=a or g
  misc_feature 240: r=a or g
  misc_feature 243: k=g or t
gattgcgggcgttagcaccatgcccggcctcactgaaaggatttttttaatgtcacgtggctctcacaggtgcggtgtgttcgggtgcaagtkaagattatgactgatgcttaaaaccaaacgtaaaattccaggtggtgttgctatgggaagaarcattagaacaatctgagtggtttcagttgcaagtgtgtgtctatgtgcaagaactacaatcaagattcaacttctggctttgarggkctctttaataacagt

SEQ ID NO: 22853 - DNA, 155 bp, Homo sapiens
acgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaagg

SEQ ID NO: 22854 - DNA, 462 bp, Homo sapiens
  misc_feature 11: d=a or g or t
  misc_feature 12: d=a or g or t
  misc_feature 419: w=a or t
ttcggattgaddtttagaaactagtcctgctttgtgtcatttttgtccttagccatgtataaaagcaacatactaatgtttacactaacagtagattttagtcttattatagagctgtgtatctattggcataacattaattctgtggacgaaaactatgtataagaatattatcaatagtattgactgattcttgaactcctggtttcaagtgatcctccagcctctgcctcccaaagcactggtattacagtgcccagccggtatcaactgattctaaaagattactaaattccactaaattataaatagtatttgttgagtaacaaatttttcttagatattatttatttagtcagcagcagtttccaaagaggcatcatcagcaggtgttcttaactctttacagagatggggtwctgtcacacttatttttctcatcagtttgggagcagagagact

SEQ ID NO: 22855 - DNA, 186 bp, Homo sapiens
aatggcttttcccttaggatatatctttatgagtcttggctttgaagtggagaagggctttatcttagagaaggtggtttatgtcatattccagttattctagaagttcaggacagccttagcatctgaaaaagaagcccattcctctttatagtggaatttagtaagtagatctaacccgagcac

SEQ ID NO: 22856 - DNA, 184 bp, Homo sapiens
  misc_feature 11: d=a or g or t
  misc_feature 78: k=g or t
  misc_feature 79: y=c or t
ttcccttcccdccttccttctttccttgcttccattttttttgagacagagccttgctctgtcacccaggctggagtkytgtggcgcaatctcagctcactgcatcctccacttcccgggttcaggcgattctcctgcctcggcctctggagtagccgagaatgcaggcacccaccaccacgaa

SEQ ID NO: 22857 - DNA, 142 bp, Homo sapiens
tcaagctactggcactccattataggcaaccctatctcaaaaaagcaaagcaaaacaaaacatttttccccttgattatagaggtttgagaaaaatttgagggaagattcagaaaattacctgtaactgaacagaatgccac

SEQ ID NO: 22858 - DNA, 206 bp, Homo sapiens
tttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccaaa

SEQ ID NO: 22859 - DNA, 287 bp, Homo sapiens
  misc_feature 9: k=g or t
  misc_feature 10: s=g or c
  misc_feature 11: d=a or g or t
ccttaaatksdtttggattacaaaaatacctgtgaaaaataataaaagcagatacattctgaggttttcagttatattgcatggcaacgaaaactttgctagtatacctgttttctttgttttaattattctagctgattgattctgcttcacacctgaggacaagggcattgccagaacatggacttaatttttttccctgttcttagtctgttagccatccatggatacaaacataaatgtggtccatggaagataggcaagcaatttgatttcttaccgtcgtc

SEQ ID NO: 22860 - DNA, 188 bp, Homo sapiens
acggcgcgggacccgagaggcctacgttggcaaacgcagcccgctgcccctttgctcgcttcccccgggcctggagtggctcctgtcgcttctggcgctccgatttcgagaaatgactttcagctgtgcaagccaacgagtggataaagaaaatgtgatatatatgcactatggaatactaagcccgt

SEQ ID NO: 22861 - DNA, 338 bp, Homo sapiens
  misc_feature 7: w=a or t
  misc_feature 11: d=a or g or t
  misc_feature 12: r=a or g
taatatwtgadrgaaaacactaaaatgcaaagagaaataaatggtgcataatggtttattttggcaaaggatgatatggacagtattaattagataatgtttttgttctgggtcagtagcaagttcaaaattgttcattttaagagaaaaggaaataaatatactccaagtaatgattgcctgaattaatgattaaatggaagatgataagcaaggatcaatggaggattttctcattttttaagtcatctgttttgttctgtactcctcagaacagatgctttagaggtgattcaatctctcatcctgctcaccagcacgttggctgcatctcgtgt

SEQ ID NO: 22862 - DNA, 75 bp, Homo sapiens
  misc_feature 10: d=a or g or t
  misc_feature 11: d=a or g or t
  misc_feature 12: w=a or t
  misc_feature 16: n=a, g, c or t
  misc_feature 75: k=g or t
acttccgggddwacantggcggctaacgctacaaccaacccgtcgcagctgctgccgttagagcttgtggacaak

SEQ ID NO: 22863 - DNA, 169 bp, Homo sapiens
  misc_feature 22: s=g or c
  misc_feature 158: n=a, g, c or t
agattctcgttggcggcggcasggcggcggccctggactgcggggaatgggaatcctaggtccctgactgagcacctcccccgcctccctgcccccgacatggctcaggagaagatggagctagacctggagctgcctccgggtacgggcgggagccngcggagggcaa

SEQ ID NO: 22864 - DNA, 212 bp, Homo sapiens
  misc_feature 11: k=g or t
taaattaacgkcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagcccag

SEQ ID NO: 22865 - DNA, 281 bp, Homo sapiens
  misc_feature 11: k=g or t
ccttttatggktgcatagtataccatggtgtatatgtgccatacttttttatccagtctgtcattgatgagcattcaggttgattccatgtctttgctattgtaaacagtgccacaatgaacgtacaaattcacgtatctttgtaacagaatgatttattttcctttgggtatattcccagtggtgggattgttgggtgaaatggtatttctgattctagatcttcgccacacaatcttccacaatggctgaactaatttatattctgaggggacacatcc

SEQ ID NO: 22866 - DNA, 183 bp, Homo sapiens
attatttgagactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgaccccgccc

SEQ ID NO: 22867 - DNA, 335 bp, Homo sapiens
  misc_feature 7: s=g or c
  misc_feature 10: d=a or g or t
  misc_feature 11: d=a or g or t
  misc_feature 143: k=g or t
ccatatsgcddtgtttagctttttcttattttggcttcttgaactctgaaataacacaatcatttaaaaatatctaatgttcaaaatcttgtaagtttaaaattttttatgacattgaaataccatatttattttcaattttkttctcttactaccaaaaatacatttatcttgtctctgggatagaatacaaatgttttgtttcattggaatgtttgatgttagtacaacttgccatgtggtaaatggcctatatgtatttgttgacacaatgctaactccttcaaatatactttatttcaattagaaagtattttattagtgtatcaatgttc

SEQ ID NO: 22868 - DNA, 112 bp, Homo sapiens
gcattgttgacatgaaaatgtcctcaccaaataatgaagaaaaatttgattttcttatgtggaaaaagcaggaccaaaagcaatcaaccaaaatcgtatctactacctggca

SEQ ID NO: 22869 - DNA, 205 bp, Homo sapiens
  misc_feature 10: b=c or g or t
agggcgatcbgcccagctcccctagaaagttggcaacctagctagccaaaagaagagtcccctattcctgaaacttactctgtccgtggtgctgaaacattgtaccgagacccgcccagacgggcgctgtcagccgctgaaaaaaaaaatcttccccgaggctgcccaaatcagaactgtgtatcttttatttactcacgtccgt

SEQ ID NO: 22870 - DNA, 152 bp, Homo sapiens
tgatgaggaggtgcgtattctgctggttgtagagagtattagagaaaatttcaaaaactattggcaacatctactaaatttgtacacgtacatgtgctctaacataagagtaatggctccagtgtgcatcaagataacattaaagacatatc

SEQ ID NO: 22871 - DNA, 383 bp, Homo sapiens
  misc_feature 10: n=a, g, c or t
  misc_feature 11: d=a or g or t
  misc_feature 12: n=a, g, c or t
  misc_feature 13: m=a or c
  misc_feature 33: m=a or c
  misc_feature 34: k=g or t
  misc_feature 59: w=a or t
  misc_feature 60: y=c or t
accttgacandnmtggttgactgagaaaacagmkataatgggcttcctaaccctgctcwyctggcactaacacttttcaatcttcaggcttcattccttcccaagagtgcttttgactctgagaccagcccacccccaaacagctagtggagaaggagcaatgctgaggggtgaggcctctctcccactccagccccaggacaggaaacagaactgcctgaaaaaggtgaagtgaaacttggatctctatttctcccataagggacttctgaaacagggaagccccctcccatgtgaaccaaggaaaggaggcacagcccagagaacccctttggggatactaaagacagaagaggggaaggtggcccttagagacagagctt

SEQ ID NO: 22872 - DNA, 267 bp, Homo sapiens
  misc_feature 10: k=g or t
  misc_feature 12: y=c or t
aacacttctkgyttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatga

SEQ ID NO: 22873 - DNA, 282 bp, Homo sapiens
tttaacaaaggtgattaattctgtttatctattttttaatccttgggtcaatactatactctcttattatatttttagaattattcctgacacctgatagagtatgtcctaccattttattttttttcaaaattgtcttggctcttcgcatttctacacaaattttacagtcagcttctgcagttccataaaaaaacaaataaaaccctgctgaaattacttggatgcaattatcagtttgggaagaattgccatctttataatatttaaccttccaaccac

SEQ ID NO: 22874 - DNA, 317 bp, Homo sapiens
  misc_feature 10: d=a or g or t
  misc_feature 11: w=a or t
gttcatctadwctctttaaaatcctaccaaatacgttgcaggtggtgggtatgtagtaaaagtggataggaggagggtaagtattgaaatctgtttgagatatgaaattacatgagtaaaggtttggggttttcaccacaatttcactcgcgtccatgtgaagagaccaccaaacaggtttgtgtgagcaataaagctgtttatttcacctgggtgcaggtgggctgagtccgaaaacagtcagtgaagggagataaggatggggccattttataggatttgggtagataaaggaaaattatagtcaaaggggggac

SEQ ID NO: 22875 - DNA, 138 bp, Homo sapiens
  misc_feature 9: k=g or t
  misc_feature 10: r=a or g
  misc_feature 11: d=a or g or t
  misc_feature 12: s=g or c
  misc_feature 25: s=g or c
  misc_feature 47: y=c or t
  misc_feature 89: y=c or t
  misc_feature 103: y=c or t
  misc_feature 112: s=g or c
  misc_feature 114: s=g or c
gcagttgakrdsacttggtaatgtsaacgcaagaagcaggcttgatytttttttctccccccttctctctctctctctctctctctctycctctctccctctytctcctctstsacccacactcacgcacacctcaaa

SEQ ID NO: 22876 - DNA, 138 bp, Homo sapiens
  misc_feature 11: s=g or c
gcagttgaggsgacttggaaatgtgaacgcaagaagcaggcttgatttttttttctccccccttctctctctctctctctctctctcttcctctctccctctttctcctctctcacccacactcacgcacacctcaaa

SEQ ID NO: 22877 - DNA, 331 bp, Homo sapiens
  misc_feature 310: w=a or t
caacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgawagtctttctgttttagtaaaa

SEQ ID NO: 22878 - DNA, 224 bp, Homo sapiens
aaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccact

SEQ ID NO: 22879 - DNA, 473 bp, Homo sapiens
  misc_feature 9: k=g or t
  misc_feature 10: k=g or t
  misc_feature 11: n=a, g, c or t
  misc_feature 222: y=c or t
tagaggtckkntggggtttaatgaaattgtgttgagacttttcaacttgagctggactttgcagctctttcctctcctttccacatattttatggatttcatagcctcataccggtatataagagatgtatatatgtgaaatgtatcaagctggatcttgtttggacaagtctctgcttttgtacaatttgcaaaaaacccagatggtaatttctaagactyttgaattaaggagtctgttggaaagatctttagcattaactaggtgaggctaggacaatgtcatgtagctggacctctttgcagttaaagacttgaggacttgtacctttctgtcctattggacctggtccattttccccccagggagggaagtctgattcctaatgaagtaacaatttcaaaaacagtttcttgctctctgtgcttattctctatcacttgataatcctggtggtgaatcacttttgttt

SEQ ID NO: 22880 - DNA, 355 bp, Homo sapiens
  misc_feature 10: k=g or t
  misc_feature 118: s=g or c
  misc_feature 120: y=c or t
  misc_feature 128: m=a or c
  misc_feature 129: r=a or g
  misc_feature 336: k=g or t
ataatgagakaataaatttacatttccttcttaggtctctagaggatccatttttttctgcaaagcatctgtccacaccctcttaccatgcttgtatgccttaaagatctagcttggscytgtcaagmrgtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagaktgtgttgaccctggactca

SEQ ID NO: 22881 - DNA, 235 bp, Homo sapiens
  misc_feature 12: n=a, g, c or t
  misc_feature 142: m=a or c
cttgcccctagngtctcctttaacacagtcacgtgagggacgcgcgcgggggcagctgggagtagtactgccggttggtcagggttcggcctcaacatggcggttccggccgggcagtgaccaaggttttgccgtccgaagmtaagtggtgactgtcggcgtctccacctatcggggtggaatgcgagcacgcggggacgagcgctgagaagcggcggtgacgggaaggggggga

SEQ ID NO: 22882 - DNA, 155 bp, Homo sapiens
aaaagaaggaaaaaatatgtatgaccagaatagatatggatgaagaaattgaaagcaacgaatgcaactattcaaaaagtttaattttatgaatttcttttgtttagtcttgaagactgattttctatgcaaatagtgtttggcatcctgcaccg

SEQ ID NO: 22883 - DNA, 263 bp, Homo sapiens
ttaaaacaaaagcaattcagaattgaaattatagaaattatctatataatgagaaagatgaaattgaaatctaagaaacacatgactatgacaaagcaaatgtatctttagatacaatatacagatatcaatagtttaagaaagtaatatttattttcctatttaaaatgttaagataattaccacagagacaaatttaaatacttgttaaactaatatagtgagctattctatagacaacaataggagaaatgggggaaggt

SEQ ID NO: 22884 - DNA, 159 bp, Homo sapiens
  misc_feature 10: w=a or t
catgtaaaawaattgaagttaaatgatttgccaagctaataaataaacctggatttatatcctcattagtaaatagcggattctaggttctaatctagcttctaaaaatgacaggggtggttggtgggacaggagaaacagggtaggaaaaaggaaccc

SEQ ID NO: 22885 - DNA, 262 bp, Homo sapiens
  misc_feature 65: m=a or c
  misc_feature 113: s=g or c
  misc_feature 116: n=a, g, c or t
  misc_feature 130: r=a or g
atttgaaaacacgctccgggagctagagcctgaggtcggcggcgcacgctgattgccccgtgggmttctgctccctcgcttgtcttctcgggcttctcgccccggccgcggcsggntcctcagtagtcgrgaatgactaaaaaaagaaaacgccaacatgattttcaaaaagtaaaattgaaagttggtaaaaagaagcccaagttacaaaatgctactcctacaaactttaaaacaaagactatacatctgcctgagcagt

SEQ ID NO: 22886 - DNA, 244 bp, Homo sapiens
ctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaga

SEQ ID NO: 22887 - DNA, 53 bp, Homo sapiens
caacttatctctactagaattgcctttcttctttttttttttttttttttttt

SEQ ID NO: 22888 - DNA, 450 bp, Homo sapiens
  misc_feature 412: r=a or g
taatggagatacagaatgactcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttgattgcagtttaattattatgccttttggggttaaatgatgtgaagtgtttccacctactgataaataccatatgaaaacacgactaaragactgatttaagaaacttgttatttttaaaaatatga

SEQ ID NO: 22889 - DNA, 429 bp, Homo sapiens
  misc_feature 10: k=g or t
  misc_feature 156: r=a or g
  misc_feature 428: s=g or c
tgaactttakggtatatgaattatatcctagctttactaggataagatctggaacaagacaaggatgtccattttaaccacttctattcaacattgttctggaagtcctagccagagtaattagacaggagaaaggaatgaaaggcatccaaattrgaaaggaggaactcagggccgggcatggtggctcacgcgtgtaatcccagcactttgggagtccaaggcaggaagatcacctgaggtcaggagtttgagaccagcctggccaacatggtgaaaccctgtctccactaaaaatacaaaaatgagccagttgtggtggtgggtgcctgtagtcccagctactcaggaggctgaggcagaagaatcgcttcagcttgggaggcagaggttgcagtgagccaagattgcgccactgcactccagcst

SEQ ID NO: 22890 - DNA, 70 bp, Homo sapiens
  misc_feature 10: k=g or t
cagaggagakcgccgaagcgctggaaaagccgttccgcccacgacttctggtgccgggtcggcggcgact

SEQ ID NO: 22891 - DNA, 180 bp, Homo sapiens
gtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctc

SEQ ID NO: 22892 - DNA, 270 bp, Homo sapiens
  misc_feature 43: w=a or t
accactttcaggattgatcccatccactggcctacagtaaaawgcttcaggcttgatataagtgaagtgtagaaaaatatctttaaaacaaataatggtttcccataatatgccattattttaaaacttttaatattttgacatcttttatttattatcattattgtttacatggaataaaaaattcttatttttatgaaaatagattcaaactgtatataattatgtgaattatgtgtcttgacttttaatttaaaatatataatgaac

SEQ ID NO: 22893 - DNA, 305 bp, Homo sapiens
  misc_feature 62: w=a or t
cattgattattatactttattcagtaatgtttctgaccctttccttcagtgctacttgagtwagttaaggattaatgaacagttacatttccaagcattagctaataaactaaaggattttgcacttttcttcactgaccattagttagaaagagttcagagataagtatgtgtatctttcaatttcagcaaacctaattttttaaaaaaagttttacataggaaatatgttggaaatgatactttacaaagatattcataatttttttttgtaatcagctactttgtatatttacatgagcgct

SEQ ID NO: 22894 - DNA, 283 bp, Homo sapiens
  misc_feature 10: k=g or t
gacacatgakaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcata

SEQ ID NO: 22895 - DNA, 214 bp, Homo sapiens
  misc_feature 93: r=a or g
  misc_feature 94: r=a or g
taaggaaatgaggatgaagcggtaaaaatgttttgggttacattatactctcagaagctatgtggtttagagaaaagggcccccaaccacaarrgttagtggttcttattctgtctgcttcgtactaggtatatggtaactgagaaagtcacttaacctctctgaaccttaacttcgtcatctataaagtgaatctaacattttccccccggcc

SEQ ID NO: 22896 - DNA, 113 bp, Homo sapiens
acgcaatgggcgggacttccggcgtctcgtttggtattcactttcgcgactcaggtgaactaacctgcgagaagctggttgtgcgctgaggcgaccagcgccggaaggcacga

SEQ ID NO: 22897 - DNA, 216 bp, Homo sapiens
cttagccactaaatggcttccctttactgatgattttactctgcctttatcctatagttacttataggcagctatatttacttcctccaaatagattaactctttggtacctggaataagtcctgtgtaatcctaaacgctcaataaatatttcttaaaatgaagataattctccttgacagaaaattgatcttactgagcatatatccactgagt

SEQ ID NO: 22898 - DNA, 110 bp, Homo sapiens
ttcttttcacccatgggaaaatgataattttttaataaaccaaggctcttaccatagctgaactttaaaacttagactgtcttttctgtaaacgattctgaggcaaagtc

SEQ ID NO: 22899 - DNA, 171 bp, Homo sapiens
acagtgaccgccaccgttgcccggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccca

SEQ ID NO: 22900 - DNA, 419 bp, Homo sapiens
agggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctgggac

SEQ ID NO: 22901 - DNA, 220 bp, Homo sapiens
tatcaccagcaagagcgggtcagtactttacttgcatgatttgcagggctgttgttcacttctctattgaagttattctaagctcatcaaggaccttttagaaacagtgcttacattgtgtaatgtgaaatcccacctgccccatgccattagaccagagggagtatgatgtgaccattaaacatgctatgcgtatatcagaatatcacatgcccccgcc

SEQ ID NO: 22902 - DNA, 266 bp, Homo sapiens
  misc_feature 9: b=c or g or t
  misc_feature 10: d=a or g or t
  misc_feature 11: k=g or t
  misc_feature 32: k=g or t
  misc_feature 33: k=g or t
aaatatttbdkatggatgtaatcatgtagtgkktttgttcttatttcccagtgattcttgacaatggccaagtagtacaagacatctgaatcctttatatgaagtcaaaaataattttaggcttggtaaaggagaaatcttctaaattggttttttgaattatatttgtaaattttgaataatattttgtaaattttccattgtcatgttctaatagaatgtgagcccctctgatgatttgactggcatgatagatgagcccccat

SEQ ID NO: 22903 - DNA, 442 bp, Homo sapiens
  misc_feature 32: v=a or c or g
  misc_feature 33: n=a, g, c or t
  misc_feature 34: n=a, g, c or t
  misc_feature 35: n=a, g, c or t
actagctgcggtgtaggtccagctccgcggavnnntgagaccagcgtttccgacccggcccggaacaggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgcttccccagtcctggaagacccccggaagcctccaagcagaggacagcaacgcctctaagacgcactgcaccatgtgctagtggcgca

SEQ ID NO: 22904 - DNA, 428 bp, Homo sapiens
  misc_feature 10: k=g or t
  misc_feature 282: r=a or g
  misc_feature 284: r=a or g
  misc_feature 290: m=a or c
  misc_feature 318: r=a or g
  misc_feature 349: r=a or g
  misc_feature 361: m=a or c
  misc_feature 390: r=a or g
tcatagaggkaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaararaaagamcccaattcctttttagctgataaaagargttcagaaggtgatacaggccttaatttaargatcatatagamctatcagtccatacggccagcctcagggrgtaactgggaatcccttctttatctccttactttcctc

SEQ ID NO: 22905 - DNA, 249 bp, Homo sapiens
  misc_feature 32: k=g or t
attatttggcgtttttgcaacagatctgccakcgctcttcgctccctcgctctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaaggatggaagagaagaggcgag

SEQ ID NO: 22906 - DNA, 131 bp, Homo sapiens
  misc_feature 32: w=a or t
taaactgaaggcatttttagattatttgttcwccgtgaactagaaaggagcacacggtgatgaattgtgaagtgcccatcttgcccaattaaatatacatgctcccctacaaagaaaaggaaaggagttta

SEQ ID NO: 22907 - DNA, 106 bp, Homo sapiens
tatctcagccttccaagtagctgggactacaggtatgcaccaccatgcatggctaattttttgtatgtttagtagagacggggtttcaccatgttggtcaggcaaa

SEQ ID NO: 22908 - DNA, 334 bp, Homo sapiens
  misc_feature 10: s=g or c
  misc_feature 11: d=a or g or t
  misc_feature 12: s=g or c
  misc_feature 145: k=g or t
  misc_feature 146: k=g or t
  misc_feature 274: v=a or c or g
ctccgccggsdstggtctgccattcgccagtgcagggatctggcacggaccagatgtggcgaatggcagcacagcgcggtggctgggtctgcacactggcctctgcagccagatttctatattgggagttttttaaaaagacatkktcatagccaacaagaatcagtagaagtgctgggagcagcagctggggaagctgccgcccacgggctctgcccttccagctggagccgcccgtgcctccaggggccaagaggatgatgtcgtggcctcvattctcgtttctatgcagccccatagtccaaggacacccagtccacatctaccatacagc

SEQ ID NO: 22909 - DNA, 377 bp, Homo sapiens
  misc_feature 33: k=g or t
attggggacacggtttcaccatgtcggtcaggktgttctcaaactcctggcctcaggtgatccacctgtcttggtctcccgaagtgctgggattacacatgtgagccaccgtgcccggcccaccagtggtattacccagggatatgaatagctaagctatactttaggcacaaaccagcactattatcaagatgcaatatgtgaactcatctttcttctagcatcagttcagaattaattttaatctgtgtattgtatactgctgccaaaaactcattaaccacaattaaattatgaaagtacatgtgtaaatttatggatagcaatacacaatccaaaatatgagtttgctataaaaataaagtatatgggtagtc

SEQ ID NO: 22910 - DNA, 100 bp, Homo sapiens
tcttccccgacactgctctttaaaatgtgatttcgatttgcatgatttgcatttccctcatgatgaatgatgtactttttcttgcacttacgggcccaga

SEQ ID NO: 22911 - DNA, 205 bp, Homo sapiens
  misc_feature 10: r=a or g
ctttgacaarcctgacaaaaacaagcaatggggaaagaattccctctttaataaatggtgttgggaaaacaggctagccatatgcagaaaactgaaaccggaccccttccttacaccttatacaaaaattaactcaagatggattaaagacttgaacgtaagacctaaaagcataaaaacccgagaagaaaacctaggcacttca

SEQ ID NO: 22912 - DNA, 150 bp, Homo sapiens
  misc_feature 143: k=g or t
aataagaacgccttcaacttttatatgtgttctatatttttcttcagacctcatacctactcttctgctttctgtgtaaggtttctctgtaatgaccccatttttcccccacacccattaaatctgtgatgaagtcatgctgkcctccga

SEQ ID NO: 22913 - DNA, 249 bp, Homo sapiens
caggctattaccatgggcatttgttctctgttggagctgtaagcagatgaacccaagtagagaagatagatcttggaaggatagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagca

SEQ ID NO: 22914 - DNA, 220 bp, Homo sapiens
  misc_feature 33: k=g or t
  misc_feature 34: b=c or g or t
agaaagattaaagccatgttgactattttactkbcactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacaa

SEQ ID NO: 22915 - DNA, 289 bp, Homo sapiens
ctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccat

SEQ ID NO: 22916 - DNA, 359 bp, Homo sapiens
  misc_feature 11: y=c or t
  misc_feature 32: k=g or t
  misc_feature 33: w=a or t
aagaaaaattyttctgccttgggatcctgttkwtctgtgaccttacccccaaacctgtgctctctgaaacatgtgctgtgtccactcagggttaaatggattaagggcggtgcaagatgtgctttgttaaacagatgcttgaaggcagcatgctccttaagagtcatcaccactccctaatctcaagtatccagggagacaaacactgcggaaggccgcaggtcctctgcctaggaaaaccagagacctttgttcacttgtttctttgttcacttgtttatctgctgaccttccctccactattatcctatgaccctgccaaatccccctctatgaaaaacacccaagaataatcaata

SEQ ID NO: 22917 - DNA, 255 bp, Homo sapiens
  misc_feature 8: h=a or c or t
  misc_feature 51: y=c or t
  misc_feature 128: y=c or t
atgttgthtggaaggctgacgctctggttaaggagtcaagagaatcttttycttttaaattatttattctttagagcaattgggtgaagtatgtttttatgagcaaatttacctttctctcccaagtyctcccaaatttggaaaccctgagaaaccctgaaaatactctgtcctgggcttatatgccttagacacaactgggattgctgagctcaagggttgcagagcatcctactatgggaagaatgaggacgt

SEQ ID NO: 22918 - DNA, 200 bp, Homo sapiens
  misc_feature 13: s=g or c
  misc_feature 32: s=g or c
  misc_feature 120: w=a or t
tagcttttagtasgtcagaggaaatcagtatstcaaagtactttcatgatttagttatttttaagttattgatcattttggattttattttgaggttgatagccatataatgatttcacwttttattttaaatggctagctgttgtcccaatactatttactgaaaaatctacattttgctcactctttttttttttttt

SEQ ID NO: 22919 - DNA, 178 bp, Homo sapiens
  misc_feature 10: k=g or t
caatcaagtktcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagaca

SEQ ID NO: 22920 - DNA, 331 bp, Homo sapiens
  misc_feature 31: k=g or t
  misc_feature 32: d=a or g or t
  misc_feature 33: r=a or g
actcatgatgatcagacaacacattggcagkdrgttcatctgctctactctgctttggaataacacatgtgattaaccaggtggtgaaatgacagaactcattcgcttctttgattggtgattttgaaataatctttcatcaagttccatctcctttaccctcatatggaatatatctctctgtctgttgttaaactatgatgacatgtctgtagctatcagaaagagaagctgggaagaacatgtgacccactggatgggacagccttttaattctgatgatcgtaacacagcatgtcatcatggactagtagctgacagcttgcaggcg

SEQ ID NO: 22921 - DNA, 155 bp, Homo sapiens
  misc_feature 10: k=g or t
aggctgggtktggtgactcatgcctgtaatcccagcactttgggaggctgaggcgggtggatcacctgaggttaggagtttgggggcatgctggccaacgtggcgaaatcccgtctctactggagatgcagggattggctgggcatggtggcaga

SEQ ID NO: 22922 - DNA, 472 bp, Homo sapiens
  misc_feature 10: d=a or g or t
  misc_feature 30: w=a or t
  misc_feature 32: w=a or t
ggggacgaadgctgcagctcctcctgtgcwcwttcctttgtttcttcctcttcctctcagcctgtatctctattttcgacctcacaaggtactgacttgggcaacagcagtgactacaagtgccatactgaccaattggaagagtctttgcttatcggagctgttctaaaaggcttattagtttttggtcttcattctatttaatgttttcatgcctttataaactttttacttccagcccaatttttcccattgtcttggtacaggtcagctgtgtccaagtttgttagggtttcagctagccaaaaatggtattttcatttgctgaaattctaaacaaaataattaaagttaaagcacagatgatgatgctaccttatttttctacatgtgggaaagcttgattgatagtaatgattagcgcctgcatctcacaatcactgagaaatgaatgcagcactgagctctgttt

SEQ ID NO: 22923 - DNA, 299 bp, Homo sapiens
  misc_feature 10: d=a or g or t
  misc_feature 11: d=a or g or t
  misc_feature 12: k=g or t
  misc_feature 32: k=g or t
  misc_feature 33: k=g or t
  misc_feature 34: w=a or t
caaagtaggddkgcgtggtggtgggtgcctgkkwatcccagagagtcgaaaggctgaggcaggagaatcgcctgaacccaggaggcagaggctgcggtgagccgagatcgcgcaccattgcacttcagcctgggcaacaaaagcgaaactccatctcacattaaaaaacaaaacaaaacaaaaccaaaaaaaagagactttttttgttatgttgataaattaattcttttttccaaaagaaaagcttatgtcatttataaatgtctttaatttatattttatatgtatatatggaataa

SEQ ID NO: 22924 - DNA, 353 bp, Homo sapiens
tcaggcatgatcctgcactagtttgtgggcatggattcagtatggacttcttacttcagggagtgtgtccccaggtcaccttggttctgtggacgctgagagcaggcctcttgtaatgcaagtgctgagaagacttagagataattagggcagcgtcttctctgcagagaggttgagccactcagctggtgtcacccagctggtcagtggcagggagccaggctgcacgtctttgatttttaacctacactctcaccagtgagatcagccctgggcagcctgtgaatctgatcgtgttaccttccattgattcccagataccctgtgttccaggcagtgccaagaaccagtga

SEQ ID NO: 22925 - DNA, 109 bp, Homo sapiens
tagattttatgccataaacaagtctataggagccaaaacctcccctaccccttgagcaagaaaagatggtccgggggaaacctttgatatcacataatgtagccatgca

SEQ ID NO: 22926 - DNA, 199 bp, Homo sapiens
tttctttttaaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggcctaa

SEQ ID NO: 22927 - DNA, 127 bp, Homo sapiens
  misc_feature 9: r=a or g
  misc_feature 10: d=a or g or t
  misc_feature 11: s=g or c
gatattctrdsttaaaggtccttctggtctcgaatcaaacctggacctcggttcagttttcatccaacaatgccacatgggtaatgcctggtcttctttttaactattcaaccttcagtctcctcct

SEQ ID NO: 22928 - DNA, 148 bp, Homo sapiens
  misc_feature 1: k=g or t
  misc_feature 9: n=a, g, c or t
  misc_feature 10: n=a, g, c or t
  misc_feature 11: d=a or g or t
  misc_feature 12: r=a or g
  misc_feature 33: y=c or t
  misc_feature 143: m=a or c
  misc_feature 148: r=a or g
kgccgggcnndrgtggctcacgcctgtaatccyagctctcagggaggctaagaggcgggaggatagcttgagcccaggagttcgagacctgcctgggcaatatagcgagaccccgttctccagaaaaaggataaaaaaaaaamcaaar

SEQ ID NO: 22929 - DNA, 183 bp, Homo sapiens
  misc_feature 102: r=a or g
  misc_feature 125: v=a or c or g
agttaggttggagatatatatatatatatttaaaaattaaattgttcattttaataagtggagtgtgaacatgacataattaaatctgtcttaacataagaragtaaaggacttctttagaatavagaatatataaaaatcaacctttaatttctccagtattttcacctaagcccacctatg

SEQ ID NO: 22930 - DNA, 520 bp, Homo sapiens
  misc_feature 11: b=c or g or t
  misc_feature 12: h=a or c or t
  misc_feature 13: h=a or c or t
  misc_feature 311: y=c or t
  misc_feature 312: m=a or c
  misc_feature 388: y=c or t
  misc_feature 389: m=a or c
  misc_feature 485: n=a, g, c or t
  misc_feature 495: n=a, g, c or t
tgaaagtattbhhataaagccagtgtaatcatatctttgttacaaaaatgaaatctttgaacttttaaagtcaggattagtgatagttcatgtagctttatctagtaattctgtgttactaagcatttttccttaatttttttctctcagaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgaymatcattttgaggtatgtatgatcataacccacatcatctataatccttaaatatatgaaagagaaatagatgctaymgaaggattctgtatgcatgccattaggctatgtgcttctagttgtttttcttatgtggatggtggatttcgtgaatccattcctgcccacttgccnagtttgtgancaattacagacattacagaatggct

SEQ ID NO: 22931 - DNA, 139 bp, Homo sapiens
  misc_feature 15: r=a or g
  misc_feature 117: r=a or g
  misc_feature 127: m=a or c
aaacccaatagctcraaaacactatcatttcaacataggatcaatataaaaattattaatgagttattttactttttttcatattaggcctttgaaattcagtgtgtattaaacacrtctcaattcmaaaccatcacgt

SEQ ID NO: 22932 - DNA, 213 bp, Homo sapiens
tcccataattactaagttacggaaggggtgtgaggagctggcagtggtggtgaataggcattgtttgcattactaaatatatataccatttcttaagataattggaactcaagcagtcctaattttctctccctgttatgagcaatcagtaaattagtagtcaatttaacttattatcagttggtatagcgcatgtcacagaataggatagct

SEQ ID NO: 22933 - DNA, 408 bp, Homo sapiens
  misc_feature 9: r=a or g
  misc_feature 10: d=a or g or t
  misc_feature 11: d=a or g or t
  misc_feature 32: k=g or t
  misc_feature 130: k=g or t
  misc_feature 135: w=a or t
  misc_feature 141: d=a or g or t
  misc_feature 295: r=a or g
attttttarddctctcaagagtctctgtcctktaatttatttaaaccattcacatttaaagtacttattgatatagttggattgatacctatcaatgtttgtaacagcttgctattcactgacttgttckttgtwtctgtdtttacttctcttttctgccttttctggttttaatagagaattttgtataattccactttatctcctcttttagcttagcaattatactcctttttaaaaatagtcattatcctagagtttgcaattagtttccagctaataagtccattttcarataacactatacccctttaacagatagtgcaggtactttataacagagaacttctgatttctcttttccatgccttataacattgctgtgattcatttcacttatccccaagc

SEQ ID NO: 22934 - DNA, 231 bp, Homo sapiens
  misc_feature 10: k=g or t
  misc_feature 11: d=a or g or t
  misc_feature 12: k=g or t
  misc_feature 33: n=a, g, c or t
  misc_feature 34: n=a, g, c or t
tgttttttgkdkctggcccctctaccaataggnnagtagcctcctgccctggatgggtataaggtgggcttggtccaacaggttcccagagggtacatactcctttctggggagagaatgctccctaccatatagttgacagtggttaggaactctccctttccctacctaccttccttttaatagcagaattcctatttttcccttgattatgtgtattgatcaccctgc

SEQ ID NO: 22935 - DNA, 258 bp, Homo sapiens
  misc_feature 1: r=a or g
  misc_feature 12: d=a or g or t
  misc_feature 13: v=a or c or g
  misc_feature 14: s=g or c
  misc_feature 33: n=a, g, c or t
  misc_feature 34: d=a or g or t
raggtaccgcgdvstacttggcgcgccactgtndttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttccccctcttcctcttcccctgggcaaatg

SEQ ID NO: 22936 - DNA, 154 bp, Homo sapiens
atagcaaatacattatgccatagttaaggtacaagcagaacaataccaatagattaattttaagagttgtcttagaatgatttctttcgcattaagtctggatgcaaactgtgcagcccttaggttcctgctgtagttttgtacgacctggctg

SEQ ID NO: 22937 - DNA, 386 bp, Homo sapiens
tttctcaacttgcattccccagtgcagggcccagtggtgccaattctgaacatagtaaatttacaagaaagcccttcctcacctataacttcagggatgttttcacccataaaccaaaacactcaattgcaaggtttggggataatcttctcccagctctctttctctctcctacagtttcattgcattgcctcatctctcttttatcttttcccttatgagttatttcagcttccttttcttaacttctagtttcctatttctctaataatctaagtcagggagaagtgtaaattcatgtgcatggaaactaaaatttccccgaggatataatgtacagagtaaatccatcttcactagaattttagaacttgagatcgggctcg

SEQ ID NO: 22938 - DNA, 248 bp, Homo sapiens
  misc_feature 29: b=c or g or t
cagtgatattctatggcttgcccaaggtbgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagcctg

SEQ ID NO: 22939 - DNA, 263 bp, Homo sapiens
taaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgtgca

SEQ ID NO: 22940 - DNA, 230 bp, Homo sapiens
  misc_feature 138: s=g or c
tattacagaagggccctgctgaggtttgaaaacagctgagctgctgatgtctcaggcctttccctgaattagcactgcggttctccaggatatcagcaaagagggcaagtaatagaagcccctgataaggagcgtcascgacaggaagcttgggaggctgtgggaatgggtctgcccccagcttcacagacctcttcctccagcctctgaatcccattagccacagccgg

SEQ ID NO: 22941 - DNA, 392 bp, Homo sapiens
  misc_feature 20: v=a or c or g
taatttgattaggataatgvcctctagctggattcatgttgccgcaaaggacatgattttgttgtgtttattttttatgactgtatagtagtccatgttatataggtaccacattttctttattctatccatcattgaggggcatctaagttgattccgtgtctttgctgttgtgaatagtgctgcagtcgacacacacatgcatgtgtttttatggtagaacaatttatattcctttgggtatataccaagtaatgggattactgggtcgaatgggagtactatgttaagctctttgagaaatctccaaactgctttccacagtggctgaactaatttacatttccaccagcagtatataagagttctcttttcttcacaacctcaccagc

SEQ ID NO: 22942 - DNA, 124 bp, Homo sapiens
  misc_feature 22: k=g or t
aaatgagcatctctgccttgckttcaatgggccggtgctgctgtcgctgctgctgcccgcgcgggttgtggatgttgtcggctccgtgttgtgatgacaggagaatgtgtgtgtgtccggggcc

SEQ ID NO: 22943 - DNA, 270 bp, Homo sapiens
caaaaaactctgaggcagatagggcaggaattactgatttcattcattcagtgaatattcattgaatatcaggtactattctcaatgtttaggatatgttaaaggacaaaggtaagattctcctctccaatagggtttacattctagtgagagaagcaagacatgaacagtgataattaataagttctatagtatgtagaaagtggtaagtaatgggagaaaaaaagcagtgtaaaggggaatcgattgtcaagaggtggaggtggagca

SEQ ID NO: 22944 - DNA, 146 bp, Homo sapiens
gttcgagctatctctcctcctcccctctgctcccagctctccgcagtccagcttgtcggctgatcatcgtccatagaggccaccgtacccgacgtttgcggacagtgacaaagagtcaagcttggtggagcctgaggacaggacgc

SEQ ID NO: 22945 - DNA, 457 bp, Homo sapiens
  misc_feature 215: w=a or t
  misc_feature 455: y=c or t
caaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttgtwttgttttaaggctccccttacacaccctcctttaagctttgggttttctctcttatagtttgttgactagatacatgctaaaaatgtctttggagaaaacttctgcctgataaacacccaattctagactgtgggtggattttcgagctgacggtggtcaattcctttcattaagcagtgatctgatttctccacatggccattctgccttcttgggggcagagtagatgggcagcagtyca

SEQ ID NO: 22946 - DNA, 382 bp, Homo sapiens
cccagtctctccagcactttgggcttctccatcttttcccctcctagccatctgttcctgctgctccagcagtctccctgctctctccccgccaggacctgtctgagcaggagggtgtgagggcctctgatgaggtgggcctcggcccctccatcactcgcagcctcgaggagagcaccagctgtctggcttcatttgcatttttctctcccaaataacgaaattagccatgagtttcctgaggtgatgcaagacgcaaatttaggctagatgtgtcagtgtgtgatggagagggaaggggaaggtcagggaagtattttgataatcaatttgcagcactaaaacagaaggggaaagcaatacaaatgttactggagatgga

SEQ ID NO: 22947 - DNA, 229 bp, Homo sapiens
  misc_feature 13: s=g or c
  misc_feature 21: s=g or c
aatatagcctgtsataacaasacagccacgcagactgaaggaggctgaagctgccatctgtaaaagatggagtctcgctctgtcgcccaggctggagtgcagtggcgcagtcacggctcactgcaacctccgcctcctggttcaagcgattctcgtgcctcagcctcctgagtagctgggattacaggcacgcatcaccacacctggctaatttttgtattttaagcag

SEQ ID NO: 22948 - DNA, 297 bp, Homo sapiens
  misc_feature 11: n=a, g, c or t
  misc_feature 12: n=a, g, c or t
aaggaaatttnnagctgtgatcccatgtttccacagaatcttctcattgattatcactgaactatggcccagagagtttttaacatgcccaagacctcgtactcctcaccctaagtcctatatcccttctacctcccctgctgctctactcaggtagcttgtgggacctcactgcagccacctggagaaaagaaccccagcttcttttgcagtttctctatcttttgcagtttctgctcatgactccccttctaatgtccaggcagtgaacctcactgcaccccccctaccccgccg

SEQ ID NO: 22949 - DNA, 206 bp, Homo sapiens
  misc_feature 11: d=a or g or t
  misc_feature 12: r=a or g
  misc_feature 32: k=g or t
aatttaagacdrcacagctattggaaagccakgaaacagacccagagaggcggatgcatgtgggagcaaagagctttgctctcttactttttttgcttacttcttactatgtgattctgtttcttctctgaactgagagctaaagccattatatctgcaaacagtgtacacattatttttccttttttcttttcctccctttcctg

SEQ ID NO: 22950 - DNA, 194 bp, Homo sapiens
  misc_feature 12: k=g or t
  misc_feature 13: d=a or g or t
  misc_feature 14: r=a or g
  misc_feature 132: r=a or g
  misc_feature 133: r=a or g
ggtgatccacakdrccttggcctcccaaagtgttgggattacgggtgtgagccaccatgcacagccttgttttgtttgtaaaaatggaaaataattaatgttagccccctctatagcttttatggatcccarrctaagaggctgtcttctaattttagatatggcattgttctgtattatttatactcatgagt

SEQ ID NO: 22951 - DNA, 340 bp, Homo sapiens
  misc_feature 9: k=g or t
  misc_feature 10: d=a or g or t
  misc_feature 11: b=c or g or t
  misc_feature 80: w=a or t
  misc_feature 273: k=g or t
aaatagcakdbttaataaacagccactttaaacttgttctggcaaaccagaccctgctgtagatatagtctaaggtagtwaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctktttttctttggagggagggtaacattatttggacagatgcagaaggaactgttagtgagtcaagacg
